United States Patent 6,812,339 (POLYMORPHISMS IN KNOWN GENES ASSOCIATED WITH HUMAN DISEASE, METHODS OF DETECTION AND USES THEREOF) - sequence listing, part 55

SEQ ID NO: 15450 - DNA, 147321 bp, Human
  misc_feature (1)...(147321): n = A,T,C or G
aatcagtcctcagtctaggcatcattaactcatttaaaatttttgaatagttcttgaatcctttcactttcctttatttttaccaccaccaatctcagccaaacctgttatctgttgattggactcgaattgtgtcttgaagctcccacccctgtctacttctggtatgatctccaagtatagaaactattcccccgccagttttatatgtgcatgtgtatatgtttatacctacgtaaactccttcaatggttattaggatgaagaccagactttttagaaggtctgtaaggatatttctggcttgtgctgacctctttactttcattggtcactctcttctccccctcgtaggttacaggacattcagtgggaccatgactagtttatgcttttcctgtttcctctgcctggcagtcagcccctctccttcactctcaccttgactcctacttatccttctaaccttcactgtctggggtaagctttccctaaccatctccttttgccccagaccattatcaattctggttacaagttactgtagcaccacttacagcttgtaaagcagtttgaatggattattaatgatatttatgattattaatgatttctatgattattaatgtttgtatttccctcctagactctagttcccatggctgctgatcactatagtacgtactcagtatgtttgaatgaatggacacatctagtcttagctgcttgattttcttcctgaggaaactgaagcttgaacagtgtaacacagttttattcaagtatagagttagattaccacttaatagctgaaggaagttacttcacctctccaagtctccatttctttatccgttaactattgataaaagtagtgcccacctcttgggttgtggtggggattacatgagttaattcgcttaaagcacctggagcagtgcctgaggcctactggtggtagctgttgtcagtagtattgggacctacccaaagtcattcagctgtttaatacagatcctgtcagatagcagtcctttatgcttttctctgtactgagagcatttggaattcttgcaaatttactcttgtgagcagaagttcatctttatactttaaagaatgggtctgcacagtttcttgcacagcgaaggcatgtgtacattttgttgtcttcagtttagctcagttgcaaataagaaacatacccaccctgactcagtggaaggtatttctgatacactgtgaaaatttgtctactccaagaacaagaaggttagtagaggttgtgtagaactttgaatatcaaattaggatctttgaagttggatattttgaaataaataatgaaaggattttaagtaggggatgcattctatgcatagtactgtttttagaaaattggtaactggaaggaatgggaggctgggtttaggtgatggtctttgattaaaaagtggggcagttaggagtgacagctgggtttgtgggagagataatgaactttgttttgtataggttgagttggaagtacttcttggacatcttaaatggaagtgccctcaggttaagtatatcagacagaaatcaggagagaagcttgggatagaattactgaaaactgtgtagtatgaacaacaaaaaaatggagatattaacaactggtcctagaaaaagcagatgctataatacctgcatgtgacaaggtttattagcggttactttggtatctacttgaagatgatgaaaccacattttaaatagtatcctttaacttaaaattttcactaataagtctagtcttccctctagtttgagttagtgatgtaaaatttaccaaaatgttgcaaattatcttggtgcttaagaagagatcgattgaagggaacgtgatgtcatgaatttctttgatttgttaagttcgaagctagctagatgtgtgatgtagagtctgttctctgaatgccttgctcactcaagtgcttgtactttttttcccctttaactaggaattgtggtgcttggaataaacagagcttatggcaaaaattcactcagtaaaaatcttataaaaatggtgagtgtaaagattaaactgtttgcttctaatattaagatatattattgtcatcaatgtaaaaatgttttgttttttttttctctttttcctcctatgcttcctatttctgtttagctatcaaaagctgtggatgctttgaaatctgataagaaagtacggaccataataatcaggagtgaagtcccagggatattctgtgctggtatgtaaatatgttgtattatgaaattaaactgtagtctgatttttcctcaatagtaatctgttttccattagaatgttctttggtttgaaccccattaccaacaactcctctttgtctgtgttttactgattcacaagaaaaaaacatgcttagtctgtcagcattagaaagaagcttttgcaacatttagattgttttggaagttgaaaaaaaatctttgagccattaaaatacttgtttgtagtacctgtagtacatgtagtacaatgttgtttgttgtgtcttaattgtggccaatattctttagtttcattctttttttttttttgagatagagtcttgctctgtcacccaggctgcagtggcgtgatcttcgcttactgcaaccctcgtctccccagttcaagtgattctcccgcctcagccccccgagtagctgggattacaggcgcctgccacctcgcctagctaatttttgtattttgagtagagacaggatttcaccatgttggccaggctggtctcgaactgctgacctcaagtgacccaccatctttggccttccaaagtgctgggattacaggggtgagccactgtgcctggcccctagtttcattcttaaggattctcaattttttaaagcttcaatctctgtggcttctgccttaaaatattgcagaatagtgtgatatttagaaatatgcagtgtattttggcttttgataaggttttattgcctccttaatacatttcttaaaatgtaggataccgaaaagaattagttttaattccagttgagtaaccaaagagtgtaggtttattactcccagctgctagggttatggtgttatgcagtacagatttctgttttcacatttgtcaaatgtgagtaatactgtctgcttagtaggagtgcttataagggttttatgtatattttgagttctttgtttttttaaacaatgtgaaagacttatatcaagagaattaggattcttatgtctagatcatattcaccaggtgaatatgatcttgaggtaaaggagtataacacatgactgatggttgagaggttctctaaaggtcattggatggcttattgggaagatacagagtagctttagggtttttaaagaaggcccaattatatgaatttttgaggagtgatatcaatgttgtgaagacagattaacattttaaaaataagtgttagtggtcatcccggcattgtttttctgttggcagtaggttttataattattgcactatagttactggtggaattctttttattttacatattcttttgcagcccatttgttctagatttctgcattaggaatatactttgaaaaaagctttaatgctttagcacagtttgtggatgtctgttacagattgcctttttgaggacatgcaaaatgtcctcaaataatataccacatgctgtttattagaataacatgttagccttgagtactttttaacaagttaatttaatctatttactttgctttatgtgcttttaaactttcgtacaatcaggataatcttttaactcaagatttgtgactgtattttgtcaacaaaagtcagtgtcttaattatagaaaaattggggcatatcattctcttttagtaattcagtgtatatgatggaactgttctttcagatttctccgaaaggttttcctttcttgtttttttttttgagacggactttcacgcttgttgcccaggctggagtgcagtgccacgatcttggctcactgcagcctctgcctcctgggttcaagtgattctcctgcctcaccctcccgtgtagctgggattacagatgcccgccaccacgcctggctaaatttttgtatttttgctagagacggggtttcaacatgttggccaggctggtcttgaattcctgacctcaggtgatccacctgcctcggcatcccaaagggctggaattacaggccacacatggcctcttttttacatgtatttacatttataagctgaccagtaggtctgccttttttttttttttttttttttttttgagacggagtcttgctctgtcacccaggctggagtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtgagtgttgatagtgcgcacatacacacacacacaagtcaaaacaattctgctatttcaaaatgtttatgtagttaaaattttaatatttgccaatcacaaaattctaaagaagtctgattgggctgctgcgttggatgtaaatgtgaaatcaccgtcatctgtttatttttgttcttttacttttctaattcaaagtaacaaagtgcacatgcattgtttttaccagaacatttttgaaatgaaattttgtgagaaattactgagaatgaggattttttcttttgaaatttcctaagatatatgataaacaattcttggtaattgattgctatatgtagaaccctaaattgtttcactgaattacaccagtgtgggttttataaaaaagtaaaggtagttttgcttctgcttttgaattctagtaaattatgttatgactaaagagtgacttgtcactaaaattgtcaacatgcattattgaatgttgtgtgctgttcatatggataaaaatgtcatgatctggatagatgtgtgggcacgttggactatgaagtaacctggccgttgttgtttcagaatcttagattgtcatatttatgtatttaactgttagtccttcagagagtttgataagtaacgtgaagggatagataccacaaatttgtagtagtttaacaagtttgtattagtttagctatatagggttttgtttttttgttgttgtcatatattgtttgttggaataaaaaatgttttatttaggtatgaattacttggaataaagtttaccaatttaaaatgtataattgatgaattttgacaggtatttaaaccatgatcagaatcatgatacagaacatattcgttacttaaaaagttttcttgtgtccatttgcagtcaagccccttcccttgccctgatctctgaaagtactaatctccttgctgctcctagtttagcatcttctgtaattttaaaataaattgactcatactatgggtagtcttttgtgtctgacctctttcatttaacataatggtttgagcttcatccatattcatgtttcactagtttcattttattggcatgtattttattttattgctgagaatagtatttattgtatgactgtttcacggtttgtttattcattaggtgatggtcatttgggtttttccatcgtttggcttttatgcatcacttctgtgaccattcacacacacctttttggcaatgcataattttatttctctcaggtaaatagtcagaagtagaattactggttttatcctgtgtgtttagttttgtaagaaactgccaactgttttcggtatcattttgcattcccactagcaacggatgagagtttcaggcgttccacatgcttaccaacacttgataatatgaggtttaaaaattgtaggcatcctaatggatacaaagtcatatttcattgtagttttagtttacatttcatatgtgtcacctgtatatctgttttgatgacttgtttatttgaattttttcccaatgtttttcttagaatctcatctcattgagttgtaaggttttttttttgtttttttttatattcttgatacaagacttttatctgttatacttggtaagttttcttccactaaatggcctgtcatttttctgccttataatttgttttgaagaacaaaagttttttatgtgaagactgattttttaaaaatttacatattgtttcttttttttattatactttaagttctagggtacgtgtgcacaatgtgcaggtttgttacgtatgtatacatgtatgaagactgatttatcatttttttttccttttatggtttgtacctttttgtgaattttagaaattttgttttaccccacagtcagaaagattttctcctgttttctaatacttttgtagtttttatatcttatatttaggactctgaagtattctgagttaatttttatatatgttgtgaaagagaataaaaaatatatttggtctttgcccttgttcttggtacagagctcttaaaaccctgggagtttcctgaatggtccaagtgctttttgttgtgtaatgagatgaccctagatagcttcaggatgggggggcagcttgtcagaaaaagcagccatgggttagaggattagaacttttagcaccctctccccccagaggggaaaggggccagagattcagctcagttaccagtggccagtgatttagtcattcatgtctccctatggaggtaatgaaacctccataaagacccttaaacagcggggttcagagccaggcacggtggctcatgcctgtaattctgccactttgggaggctgaggcaggtggatggcttgagtttgagaccagcctgggtaacatggcaaaaccccatctctaccaaaacaaacaaacaaacaaacaaacaaaaaaccctcttaactgggtgtggtggcacattcctgtaatcccagctacttgagggggctgaggtgcaaggattgcttgagcctgagattttgaggctgcagtgagctgtgattgtgccactgtgctccagcgtgggtgacaaagtgagaccctgtctcaaaaaaacaaaacaaaaaatggggctcagggagcttctaggttggtgaacacattgattttctaggaggttggcactcctaaagagggcatggaagctctgtactccctcttcccataccttgccctatgcatctgttccattggtctgttcctgagttgcatatagtaaataaagtgttttttttttttttttaaattctgagtcattctagtgaattaagtaacctgaggagtttaggggaatccccaaatctatagctggttgtttcagacatatgggttgcccctgggacttgtgagttgcatctgaagtgagggcagccttgtgggaccccttaacttgtgggatcccactaattttggatggtggcagaatttaactgaattgttggatacccgcttgatgttgaagaattggtgtggaaaccctcagacatttggtgtcagaagtggtgttagaaaaaaagacgtcataattggtctcaggaatgggatttgctagagcatctcacgaaactcaggaaagtgctttatttactattaccagtttattataaaagagaaaactgaggaacagtcaagtggaggaggtacttagagcaaagttagggtggagggttgcagagcttccataccctctccaggtgtgccacttacccagcacatccatgtgttcactaacctgggagctccctaagccctgtttcagggattttttatggaggcctctttacataatgattgattacatcattagccattggcgactgagctcaatctccagctcctctcactccctgaaggtgtgggtagggcactgaaagttctaaccctctgatcatggcttgatatttctggtgaccagcgcctgtcctggagctatctaggggccctctaagagtcagttcattagcataaactcaggtttggttgagaagggcatgttaggaataacaaaagacactctgtcactcaggaaattctgagggttttaggagctttgggccaggaacctggaataaaaacgacgaagtattttttttatacacaggtggctttttttggggtttttgttttgttgcattttcaattctcccagcaccatttgtcagaccaacttttcccccattacattattttgggacctgtctaaaatatcagttgacagtatatgtgtgagttatgtcagggttctctgggtactttttttttttttttttttgcgatggagtctcactctgtcacccaggctggagtgcagtggcgtgatcttggctcactgcaagctccacctcttgggttcacaccattctcctgcctcagcctcccgagtagctgggactacaggggctcgccaccacgcccggctaattttttgtatttttagtagagacggggtttcaccgtattagccaggatggtctcgatctcctgatctcgtgatccacctgcctcggcctcccaaagtgctgggattacaggcgtgagccaccacgcctggccttctctgggtatttttaatgccaataccgcactgtctgttaccatgttcaggtcttagacatgtttggttaaatttatttctaagtttttcatatattttgatgttactgtaagtggcatttcttcttaattttactcccaattttttattactagtatattgctagtatattgatttttgtatattgtctttgtatcctgcaaccttgttaaatgcactttttacttctaggactcttttttgtagatactctggggttttctacaaaggtagtcaagtcatttgtgaataaagatagttttacttcttcctttcctatctgttcaccttttatttttttttatatatccattacattttcattatagagttgactaaaagcagtgtgagtgttcgtctttgtcttttctcaatcttatggggaaggcatccagtcttttactactaagtatgatgttagctgtagttttttcacagatgcagttcatcagggtgaaaagtttctttttatttgtagtttgctgaggcattttttttttttcatgaacatgtattgaattttgtcaaatctctttttggcatctattaagattctcatattatttttcagcctgtcaatatggtgaatgattgattgattatcaattattaacaattgtgtattcctggaacagacctctcgatcattaatcctttttatatactgctggatttgatttgcttaagttttttaggattttataacttttcataagggaaattggtttgccttcttttattgtaaggtctgtagttctggtatcaggatagtgctggtctcataaaatgaattgggaaatgttccttccttctatttccctgaacaagtttgcatagttgttattatttcttacttaattgtttggtaaaattcaccaacgaagtcatttggtctaggaagtttctttgtgggaagatttgtaactatgaatttgatatctttaataaatacagggctacttgagtttcttctgtttgaaaagtcaaattctgtaacatattcgaagagatttattctgagccaaatatgagtgaccagccccaggagatcatgagaatgtgtgcccaaggtgttcagtctacagcttggttttatacattttagggagacataagacatcaatcaatacatgtaagatgtacgttggttcagtctggacaggtgggacaactggaagcagtgagggatagggggccttccaggttataggtagattcagtgatgttctgattggcaattggttgaaagaatttatctaaagacctggaatcagtgaaaggcagtgtcttagttgtggagaccaaggttcttattatgcaaatgaagccttcaggtgggaagcttcagagaaaatagattgtaaatgtttcttgtcagacttaaagggcctgttctgtcagtcttcaggtcctgtgttgatgttaatgctggtcatctgtgcctgaattccaacgggaggagagtataatgaagaatgtcctactcccactcccactttccatcatggcctgaactagtttctcaggttagctttggattgcccttggtggaggggagggtccatcagtcagttggcgaactcagaattttatttttggtttacatttctttttgagtgagttttggtaatttgtgtcttttaagttgagtgagttttggtaatttgtgttttatctaagttttcaagttaattgccataaaattgttcatattattccttatccttttactacattgaatctataatgatatctgattgattatttatttatttattttgagacagggtcttgctctgtcacccaggctggagtgcagcagtgtaatctcagctcactgcaacctccgcctcccgagtagctgggattacaggcatgcaccaccacacctggctaatttttgtatttttagtagagatggggtttcaccatgttggccaggctggtctcggactcctggcctcaaggccgcctgcctcagcctcccaaagtgttgggattataggtgtgagccactgtgcctggccgatgtctgattatttatttttgatattgatacattgtgtcttttttcttaaatactagcaaaacattagtcacttttgtttatcttttcaaataagtggcttttggtttcctttattttgcttttctttctattcattgatttcttcattattttcttctctctgtttgcctcgggtttaatttactcttatttctagcttcctaaggtggaagtttagataactgatttgaggcccttcttttcttatagttgacccttgagcaacatgagaggttaggagagatgacacctccacctgcacccctgctcccacccctcacagttgaaaatcctcctataacttgacttctcaaaaactgaactactaatagtctactgttgactggaggcctcactggtaacataaagggttgagtaacaaacattttgtatgttatatgtattatatgctttattcttacagtaaagtaagctaaagaaaagaaaatgttactaagaaaaccataaggaagagaaaatacatttactatcaagtggaagtgggtcatcacacaggttatccttgtcatcttcatgttgagtaggttaaggagaaagaggaggggttgtcttgctgtctcaaaggggtggcagaggtggaagaaaatctgtgtacaaatagacctgatgttgttcaaaggtcagctgcacttaaattttaatgttttcatttgagcacgtcagagatgccgttaaaaatgactcagagtactcgtgccctttctgtgtaagtaatgattgattggttgttgctaattcatttctgactctaattccattttttaaaaagcctacctgttaatattttaggatctgtagagattttaaggaatatgaaatatatattagaataaactgctgactaatctgcttccattcttgccctttccccacacagcaggccaagtgatcttaaaaaagttaatggatcacatcactctgctatttcagacactgttcagaataaaagtgtgtgggaggcagaaatgaccaccaaagtgtcccacgtcctaatgctggaaccttacatggaaacaggaacttcgcagatgtgaggaaggtcaacatcttacgatggggagattttcctgatgtatccactgggcccaatgtaaagacaagggttcatacaagagggaggcaggaggactctgagcaggagaaatgacaacaggaagcagaagttggagagaagcaaggaaggggccatgagccaaggaatgtggacagcccctagaagctgggaaaggcaagggagctcatcttccctagtgcctccagaaggaatgcagccttgccaacccattttagacttctgacctagaattgtcaggtaatccctttaagcttgtagttatttgtccagcagcaccaggaaactgataccaagtgtgtcaggtctcgcctactctggccacattgccttttcccaccaatttcccactgcctttcttactctctctgcttgacaaagctcattcttctctccaactcgttgtgctcagtgttctctttgtgttcagaaaggcctctgctctaatgtcatcttaaatagctgttccctcatcacttaaaccaaagcaggtctccctgcttcccccagcctccatcacatttttctattttagcttcatctctgaacgtttctgttcttgaatttattttttacttattgattatcagtcagcctcccccgcagataagctcctttcgttggcattaggacagaggcctattgccagaacagtgcctggcccatagaaggcacttagcaaatagttcatgggatgactgtgaaccattttggttgttgaggaagtaacattggcaaaatgtcatggttaaataaaacaagctttgatacagagcatgcgtaggtggcttgtgtggttaagaagagtgatttgttcttgagatattgtcagtcttataaatagaaggttgtatctagggtaccagtaaatttaaccagtggagattaaaacattagctttatgacttaccgttaaacctgtttcaaagatatggctttgatgtgttcccagatggacttcaagttctctctcccacctgctaccacaagggatgtcttggaggagcacagctgcctctgttggggtgagcagagaatgggccccccctagtgggtgggcagctggtcagagagcctaggtggttctctcagtcccctttctccaaggctgcccagttatgtggtgaggtgagcattgtgggcagtgggaggctggaaggggtccttcctgcaggagacccctcttgcatgaggccaggggagtggaattcagctctagaactttggtcagcttgagtagagctccggcagttagaaagggagacttcaaaagttagaaaaaattagatttttgtcagtctgcttctggaaattgatactcagtagtagtttgccttctcagggctttctctgggaactggcattagtctagactgaggttagtaaattttgtgtgtaaaaggccagatattttaggctttgtgtgcctcttaacaatttttgtcacatattctttgttttatctttacaacccttagaaaagatgtaaaagctgggtgcagactggcctgcaggctgttttttgctgtcttctggttcacactccagttttctctgtttgttccagctggaggagcaggggtcagttacactgggctttgcaggaagaagctggagaggcttggccatggaggctgtttttcttgacataaaaataaaaatgttcattttttcttgtgtgcttggtgagtgatctggaaacagttgtacaactcatagtttgagaagtattttgttcagtgatagtgtcatttgggtgaatgctagatttgaaggccagcaccaattaggatgatcttgaggtttatggttcttaaaaactccctgagttgaagtttcatttgaataatgtattgcttttcggggtaaaataaggttgaaagagatggaggtagtcaatatttttacattctctaaagaaaaaggcaacatgattaataccagtattatttactcattaaattttatattaatggatattatgtttgttacctttttgtgactgtaaacatttggtaattttttttctttagaattatgtgaaataactgtcaattggttttgttttgtgacagataggacacatgcctattaggtatctttcttattcagtgtggttttgctgcagaaggtagttactgtcctggaggatcagtccagctggacataggtgttgacaagttctctctattcctgctggtcatagcgtgaatgcctttcagctcagtgtaatctctaggatttgttcatttcatagctccctggttgttttttctttctctagtaattttctatgaattgggagtttactgttcagcctaagcattagggaaccctagtgcattttactggagctcttcctctgagaggttaccccacctttccatttatctgccctgtaaattccagccacctcagcctccctgcacgctgatctcgatcagcaagaccacagtgctttgttggggtacccctgccttctaccagtctgtcaggtgtcttcaggaagaaaacagggacagtcacaggatcccagatggtagtcttttactgcctgttgatcaatagctgagccatttcatatattttgagggaggggatccagtaccagttactccattgcagccacaggtgcaagttcttagttcctattagtggggaatggtattgaagaaccaagatctgggtacaacatgtgctcactgttacatgggtgtctttgcttctcaagacagacctaagaaataagtagataaattacattacatattcacacacacatgtttacaaccatttctgtacttacatgttgaaaaccatgagtttatattgttacctccatttccagtttatcaccacagggttcattgttaccttctccctttccatatttgtagtacctgcagtatattgactcatttgctcaatcctgtaacttactgaaagtaatttcagagttgctgatccataccactgtggtaaacataccttttatccagagcttattacctattgacagtacagtccctcacttaatgatggtttgacttagcgatttttcaatttacgatggtgcaaaagtgatacgcattcagtagaaattgtaaccccattttaagttgaggagcatctgtaaaatgcattttccagttgtgatattttcaacatcccatgagtttattgggatataaccccattgcaagtcaaggagtagctgtactttatatctttggactgaaggtatgtaatactgtaatatacaatactaaacatattgtgtgaagagttacttaggttatttctttattgtggttgtgttttattcattagaggtaatgttaggtttcctcactcctatttattttattttgatatatgaaatattaatatggtttcagaagtctaaactattcaaagagatataatcatagaagtgtcagtacccacttcctccctctaatctcttccctccagttcccacccttgagggtgttagtgagtctcattagtttctagattatccttcatgtttctgtctgcaaaattaaggctatacctatttgttcaactatttccaatctttcttatgctagtagcattttatatatattcttgcacttgagtttttgcagttaacaatacctcttcccagcactttgggaggcccaggtgggtggatcacctgaggtcaggagttcgagaccagcctggccaacatgatgaaacctcatctctactaaaaatacaaaaattagcagggcgtggtggtgggcacctgtaatctcagctactcgggaggctgaggcaggagaattgctggaacctgggaggtggatgttgcagtgagccgagatcgcgccattgcgctccagcctaggccaacaacagcgagactctgtccccctgccaaaaaaaaagtacctcctagaaatcagtctctgttagttcattaaaatgtagtgatggctggaagtgtatgagggatctatgagactttttcaggatggaggtgttactatagtttgcatgctgatgaaactaatctgatcctattgaagagggagaggtgtcatcacgtttcagaaagaagcctcgaagtaggccttcaagaggggctgagacgctggacagaaatggagggttttggttttggttagtgaaaggacacttcactttgaggaaaagtgacatctgatttattagagccttgaattctaatagaaatcctgtggcagaatagtccttttcatcaaatgggcaggtaaaattttactggttgagtttccaagatagaaattttttatttaattggagtaaaaggtgggtgcaggttctggatgaggatataagtgaaagcacttacaagttggtattcttattgaggatctagtgctctagaagctctgacagtagtcatgttataccaagaaggtcatgctccttaatctcacttgatcctctccagacattacctagaaactttctgtaatcattagagctaattttatatctccaccaatcaattccttcccttgagaacagatgtggactgaagcagaaccaatttgtaatcatttctaatatgtcatctagttagataatgagctctcacctccatctaacaaagcattttcacaaattgacttaaactataagcctgttaggattgcctgaatccagtcattttgaatttttctgaaattcctgtagtttactctgtttgccagctttatatatgggttggtggcctaaaacttcagttctgggccccatatccatgcatgactttcttgaaagaaagagaatactctgctgcaatccaagctggagcccttcaattgagcttgatttgattgcttaggggagtggaccatgctggttagctcaaactaaccatagtccactcctggatgtgggggtagattcatcttcttccaaagtatatggactgtggggagttgggagggcaccagaacaaaaggctgccatcaggaaataggaggaggtaagttggagaggatgttaaggtaaatggttagtattcatacctcttaagcatttttactgtaactcttcatcagatctcaactacaaagaaaacacatgaatttcattaattaattcatgtatttaatattttttagagagagcctgccatgtgtcaggtactgttgaggatatagcagtaaataacagagaaataatctctgctctgtgggcagtggggagggaccatcccattttgccaagaggatgtgcgatagtattgttggatctcatatgatgtttatatgtgaacatttacttgatacagcttgtaaatgatgtgttgaaggcccttgtgtatacaaaggtgataagaaggaaatagatggcatagaaatgaaaacaagtcattggcttgatcattctgactgatgtttataaatctaaaaatgaaagtatattgcaattagggagcaaagaatatggctgtcctctttaaattaagagccatcagtgttttcaaaaacattgcatttctacagtgcaagtccaagaagaaccagaagtagtgatagtaatgatgatctgctagagatgtatttgaaacctagattcagcttttataaacctgtgcaatccaggttcatttcttttttctttctttttttttttttctttttctggagaccgagtctgtgtgatggaggttcatttcttttttttttttggagaccgagtcttgctctgtcacccaggctggagtgcagtacagtggtgcaatcacggctcactgcaacctccgcatcccaggttcaagtgattctcgtgcctcagcctcctgagtagctaggtttacaggtgtgcaccatcacgcccagcttatttttgtgtttttagtagagacagggttttgccatgttagccagactggtctcaaactcgtggcctcaagtgattcacccgccttggcctcccaaagtgttgggagtaggcatgagccaccatgcctggccaatccaggtttatttctgtctgttaacaatttcgttcaaatgatgtagcctttttcagatgtgtttgtgtatgtatgtgagtatatatttgtatatttataatatgtatgtgtttgtatgtatgtgtgtgtatatacatatatatgcatatgccaggaaaatataaaatagcaacgtgggttttttatgtttaaatttttactaaaatttctaataaagttgttttttcactattatttttctttaaattgtttgtaaattgacctaaatatgaaataaagatctaaggagtccattggccccagctgatagagtgttggttacttttcctggtctactgagggttaatgtaatatacctttgtggacattcatccacagtggttgatggctaggcattcgtttcaggcacacatggactatttatgaaaattagccatctgctaggccataaaacctccacagatttcagaggacagctatcatcagaccacattctgtcaccacaggcagttgttagaagtcattaacaaaaaacgtaattagaaaaagtcccctacattgggaaatttaagataacttctaaataacttacagctcagcaaatgaatcttaatggaaattagaaagcattcagaactaaatgctaacaaaaaatactttaaaaattgtataagatagctaaggttggacttcaggaaagaaaaaaggctgaaaatgaataaactaagcatgtaccttaagtgaaaaaataactgcagaataacccaaatagggtagatgaaaggaaatgaagtgagcataaactaatgacatggaaaacacattaagtagtaaggataatagagcctagagctgcttctttgaaaagccaaatagtcagacttttggcaagattaattgtgagtgagggaaaaaatacacaatattcagattggaaaagggagccatagatataaattccacagagattaaactggtaagataatgttaagaatgtgcaataaagtcaagattttaggtggaatagataaattactagaaaataaaaattaaccaaaactgacttaagaaatagaaaactagtaataccagagcaatgtggaaattgaagcatcagttaaagatctttccacacagaaagcaccgggccacaatgacttcagaagaatgttacatttacacctaagcattcatggagcagataattccagtctttatatactctttgagaaaatagaaaaagagagtcttttccagctcattttatgaagctagggtacccctgacaaccaccacgtaagagcagcgggaaagaaaaacagactagtttcctggtcctagttggagatattccaggactcaggagaatccccgctttatccagatttgcttgcaggttaagatgtggatttagccacatggaaatcattggttatcttgacctgattatttggctttattggagagaataaaagcctgtttggagtgggatcaagagaccagggtgtgttttttccccggccaaaaaaaaaatttttttttgggggggggcccccccaaaggtcccccccaaaacggccaagttgggttacaaaaattggaacgattgaaatcatgactttaatcactgcgtaataaccccctacaattttgtgaagcatttcatcttttacttctgagaaaaatgcaacttaaaattaccatttctcattcactagattgccacaatttaataagtgtattagggttctccagataaatagtatcaatagaaatataaaagatttattgtgaggaattggctcacgggattatggaactgaaatgtcccacagtctacatctgcaagctggagacccaggaaagctggtggtgtaattcagtctgcgtccaaaggcctgagattcatgggagccagtgtaaatctagtccaagggcaggggaagatgagatgagatgtcccaactctagcagtggggcggaaaatagaggccagttccttcctccttcaccttttgttctattgaggccctcagggaattggatgatggctacccacatgggaagggctgcttctttgcagttcacgaattcaaatgctagtcatccagaaggacccttactgacgtaccaagaaactgtattttatctgggcaccctgtggcccagacaagtagacacataaagtgagtcatcacagcaagtatgacaatgccgtgtactggaggcagtgtgtggatgtgcagccactttgcattccatatgacctggcaactgacttctgactgatgtgacttaaaaacagagatcccctggctggggctgggatgtttctaggcctcaggaggtgcacacatctgtctaatacataaagggtctgtctaatacataacgtgtaccctgtcataaaactcttcaggctgaactggaggttccagttctctttctcttcatagttgcctcttccacaatggaaagttattcctgatctttgctttgttgctacagggaggggaaaaaagcctatgaattgccaaaaaagaggcctttaaaatattaatgttgagaatttcagctgagattcttattctggcagtttctggttctttgctttcaacatagtttgaagacagtttactagaattgttgggaacttgttagatgtttcttgattacgatgtgattttttcaccagagtgctaaaggaatgacattgctgtagtaaacatcttccttgtttatgtgaaaaggttttctcagcatgagtaaaattgatggtaaatcctgcctcactctagcagtaaataatactcattcatgaatatatgaaataatgagaggagggaaggtagtcccatctatctcattgtgatgcatgtctaataaaagtttatatttagtatttaatagttatcaaatttgaaatatatttttgcttttgtcagttctgtgctaataatacttgtaatgaaaattcaatccagaagaaaacttttaaacttggcactttatagggaatttaataaaaattaatttaatttgcatacacattttgttgcaaagaaatgtgacagaatgacaaataaaatattttaaagcacaaataccagttatatcaggaaaaaaaaaattgaaagcagagcaaaaataccagttaatgaagaaaggagataatgtaacattttttatattgagaaataaaaatgaaatgctaagccaactgacttggacaactgtgacctccttttggccgaggaaaatctcagccatgacaggatgggaggtcggacatctcttgtaataccccctccctggagaactgccattaggctttctttcctgaaggttaaacaaaccagccctttggaaagacttgctccactgctgatatctactgcctggtgctgcccctgccttttgtagttttaactgcttaccagcgttctttcctgataagagagcgagaaccgcagagtggttctgggaggtctacgaaggatgcacagtgagggtttttgtgtcctctgcttcacctttgacagcagagggctgaaaactctgccctcgggccatgctcacgcccccattttttgtacatgacccatgaaagtgcatgaagctcaattgtgcgcacgcatttctccttttataatattcatgactcttagaacttgttaaatatgtatattcagccacctcgttcatcataaattccacttccctttgcctttcccttgaagtgtctgtttctggcttctggccaaaagctgtgctccccagcctgtcagtatggcacaagccgcaaccatttatgagaaataaaactctcctttccaagtttatgaacctcctcattcttcagtttacactttttaaggataggtttgtttgtatgttttatttatttttttgagacagtcttgctctgttgcccaggctggagtgcagtggtgcgattttggctcactgcaacttccacctcctggattcaagtgattttcctgcctcagcctcccaagtagccgagattacaggcacccgccaccactcctggctaatttttgtgtttttagtagagtcggggtgtcgccattttggccaggctggtcttgaattcctgacctcaagtgatctgcctgcctcagcctcctacagtgctgtgattccaggcgtgagccaccgcgcccagcttgttttaaatgcggtatgttttaatgcggatgattttgagaaccaaatcactgatagtgtaggttccactggattcattgaaaatggcatatgagttttgtttaaaaatgtgagtgttcatagtacattgaaatctttcaaactacttaaacttagatgaaaaatttcaaatgtcagcataaaaatgttcaaaggagcacatacttcaaaattcttttagcaataataggaacaaaaaggttgaagatcactggcttaaagcattagatctcaaggggacgttaacacccactgtggagccttttggaatttgagggacgtttttggctgttgaagagctttattgacatatggttagtgggggccaaggaagctagacatcatgcagtgcataacagagaatagtgtgttttcccataacttctctaaagttcattggagtagtttactgcaaatataagtatagaaatttaatacatactaatcctaaagaatatttaaaagaaggaatttattaaaacactgaaattttaggagagggccattatagtgggtggtgtttaaaatatatgttttctcaaaattgttaaataatgtatcaattccatgcgttgtctacttagtgtattatacatttccaactatatatttaaatgaaaagagtttgcagtagataatgcaaaagcaatacaagttattactggcaagttacatacaaatatgtaacaggagatataaagttcatttaaaatgtctgagaaccaggtattaaattattagatacacttgaaatacaaggaacatatgaaatcttattgaatcttattatactttctcttagaataatctctcctcagataaacctcattggctatgatactgccattcacaaagcttattatacattctcaaatagaatggtatttatgacatcgaatattgtgacatggtcaccacctttaatacccgtctgtactttcttcacctttttctccaaaacatttatccccttctatgtagattactaatttgttatgtttattttttactctttttgtctcccttgcttggagacagtataggaggagagcatgggaggcaggtcttctgaagagtttggcgtaaaaaggaggaaaaaattggcagctggagggggtagggcgtatggaatcaggaaacttaaaaaaaattttaactgaagtataatgtggacatacagaaaattgcacaaattaaaagcacataattctgtaaatttctacaaaatgaagtcccagcacaccacagtcgtcccacatgtcccttccttatcattacccatctcccacccaaaagacataggcaattattatgacttttatcgccaaatactaatattgcctattttcaaactttatgtagttggaattttgcaggctgatctcttccattgaacatatttgcaggattcagcctgtaccattcgtctaggagtagtgcagtcctgttccttgtagaaatatttcataatttgtgtcttctactgtttgcttgttgtttgaggtgttcccagcttttagctgtttctaatagtgctgccctgactatgcttgtacatgtcttttagtacacatcatgcattttttgttgagtgtgtatatttggagtggaattgctttccaaaatgattgtactggttttactcctagcagtcttaagtcagaggtctcattgctttacaccttcaccaatactttatgcggtatcttgactgttgttggcactttgcattttcatcttattaattttcagaaaaattgggatttttattggaacaacatttaatctattaatttggagagaatttacatcttttagtatgaactattctaacacatgaatgtaatgtgttcttttatttggggcttctttatttcagtaagatttttcagtttttgtgtcaaggtcttatgttccttttgttagatttattctttcactccttgatttttggatgttttgaaagtgatatcttttcgagatttcacattcaaatttcttttgctagtatatagaaatacagttgatttttgtatattgagcttatatccagcaaccttactaaatttacttattttcatggtttgaaaattctttaggctattcttcatatacagttatctgctaataatgactgttttattatacctttcaatccttgtaagttttattttggtcttatcacactcgctagtacatctgttacagtgtttaaaagtgttagggaacacccttgtctcttttcttggtccctgggaggaagcttttagtaattgactgttaaagattatgttagctataggtactttacagttactttttattataaagattcccttttcttcctaatttgctaagataatttaatcaggaatgagtgttgatttttagatattaccagaaaagcacaactgataaaaatttataattttgattaattttaatcaaaattaaaatttgtgcttcaaaaatcaccaagaaagtgaaaggcaagacacaaaaatgaagaaaatatttgtaaatcatatattttagaaagggcttgtatctaagttataacttacaactcaataaggagaaaacaaattacctgattttaaaaaaatgagcaagatttgaatggacatttcactagagcagctgtttgaatggccagtaagcacatgaaaagtgtttaacctcattagtcattagggaaatgcaaattaaaatccttataggtaccacttcacactcactagaatgggtataataaaaaagacagacaattgttggtgactaggaaaacagagaccctcatgcattgctggtaggaatgtgaaatggtgcagccaacctaggcaaacagcttggcagggtttttgttttttttttttcttttctccaagttaaacaaaaatttacagtatgacctagcaattctactttgtctttatccaagacaaatgaaaacatttgtccaccaaaaacttgtaagtgaatgtccatatcagcattagtcatagtagccaaaaagtaggaatgatatgaatatctgtcatccgatgaagggataagcaaaacgtttatatgttcatacagtggaatacttcatgcttataacatgcatgaacctgaaaagcaagccatatgaaagaaaacagacaaaaaaagaccacatattgtatgaatttatttataggaaatgtccagaaaagaccaattcttaggaacatagattagtgattacatggtgctgggatggaaacagggagcaactgcatatgggcatgagagatctttttgtgataatggaggtgttctaagatcagattgaggtgatggttgtacaactctgtaaatttagtaaaaatccttgaattctatacttaaagtggctgaactctattttatgtaaattattcttcagtgaagatgttaaggaatgaatattgaattttatcaaatactttttctgtaactaatgaaaatgtatacgattttcacctttatttcattaatttggtgagtccctttagtgggctctcttgttggtagttcctttttctccgagatcttggcctcaaagttctggctgagcctgtagtcttcactgccagtgtttgtctccccacttccaggagattacagagatttctgagctgctgcttcgtgctacggcttttataccctctttacccgaccagtttataactcagtgtatgttttgggaggaaagcagaggcttaccatagtttcccttctctggctttccagcctcttacatcctggctgccttagttgctcaagcagctgtcttacatattttctgcagtatttcatggaggaattggtctgatgatgacctattccatcatagctaacagtggaagtctatgtgagttttttttaagatgtcagtattacagcattgctatatgctgatgggaacgaacctctaaggaggggtagtattgatgccagccaaggagagcgcgtaagtgctggagtgagtgatgtccccaaggagattagaaggggttgaatccagtgcacaaggggatggattggcctccctcatgatgttacaggattccttcagtgccactttgccagccagaaatctttgctgcccctgccacctctgtctgggccttgcttgggccccctggccttactccaccctcttggcctggcaggttgtgcttggttcgcgcccacttgaatcccgtgcctgctgcacctccacactcagcttgaggctggactgggcatgccatgaatgacttccatgtcaggcaccggtgtctagacaaggggaatgtggtgtcacccaaaaactcagagataaaaccagcattcatggagccccaagcagtgttacaactcttgctcggggagtcctgaggtctgggaccccagaaatgttgcagctcttcactcccatagcttggctagcgggagcatgttacagctcttttattcccgttgcacgcagcttggcgagccggccaggggcatcacagccctttcattcctgtcgcctgcagctcagcgagttccaggtccttgtcccgcgaccaagaggaatgaggtgcgtggacaccagagagtgagtaaggcagagaagaattttattgagtgacataaggaaagctctcagctgtgagaggggacccaaagtgggtagccacctgagagggtgagtctggggtttttatgggttagaatggaggtgtgtgtgctgattcatccctgggtgggcttggaaaaatcactgtttgattggttaaaaggcatcatccagaaggaaccaatcaagagagtgagggtaatatggggatagaagttctctctctgtttatggactctctcaaaccagcagctcggtttttagactttaaactgtcagtggcttgaaggttgggtttcactggggacacatccctgtctgctggggaatttgtctgtcttctgtcactctcaatgagttagttcattcatggtaacaggaggcagggcggagtatataggttcaagtcctggatggatagctttggtggtaagtactggtagaatgtcttttctggcttttcgtaggattgataggaggttttaagattcgtggagagggaagttgtgaagtggtctatatgtgagtaggagagtgaatgaactcaggaaatacagtaggattgctgggcagcagaatggcccacttgagatgagtggtcataaatgtaaaatatttaaatttatgaagtaatggaactgagaaatactgggcctcaaagaacagtttggcaccaagttaagccagttatttgtttttggttctgccaacatttttctttgttacatattaattcttcatggaaaaattaattacaaagacatgtatcaggcattccaaaacatttaaagacttgcatatttagcacccaccacccaacctaagcaatacaatattacaaataaaattgaagtcctctgtgtacccattgccagtcatactccagcccccataaccaccaattgaatttatcatttctgtgtgttttatatccctgaatagcattattgtttttaaaatttgtgttcattatcctgtgtatctttctgtaattaatactttttcaataatattattcattggatttatctgtatttactcttaattctttcaccttcatgcttatacaggtaacattctatttataattatgtccttgttttattaattctcctatggatggatatttaggttatatccatttttttgctagtctttgtatgctcccttgaattttattgtacatattttcttgggtatttgagagattttctagggtatacatatctaagatctgatggatgctgggatatgtgctttgtcaactgaggttctcactcccctggaagtgtgtgagatcagaatgcccctgccctagcccttacttatattatgtatcagcatgattgatttgtaatagactaataagggtaaatagctgagtgtatgccttctatactgtaattttactttgttgttcgtctgtttgtttaattggggacccatcttttttcagattgttaattttgctaaagatcttctttgttctcagagttaattatcccttaaggaattccatgtgtttatttttctctgttccaaagttacgattctgtgctaaagtcataattatgaaatcatcagtttgttcatactttaaatctatgcttctcccttgtggttgacagtccccaaggcaggcatccatgaagtcaaaaggactgaccaaagtgtaatctgccctttttactgggttggcatttgtgctaatacactgcaaaagcagtggtggataaactgacagcaccttgcaaagcagcaaggtggtgtcaccaatttgtcattatttatgttaacattaatgggttcatttgtatttttaaatgaataaacatttaaacaatttcttagttttgatttctaatagagtaactatagatcagtagatgccaactatagtgtcttcctttaagagcgtgaaggggcctgagactggaaagctggagaagcaccgctttaagcacatggtagacgtatgaatagacaaatactttattcttgttgaacatggtcattgggaaggaaaactgaggtaatgtcattctattaaaagatgaattaggctgatcttgaagttgtatactaatcttaagtaaattttcaattctttgccttaaaattttgtttacaactagattatatttgtaaataaaatactttgcaggtgctgaccttaaggaaagagccaaaatgagttccagtgaagttggtccttttgtctccaaaataagagcagtgattaacgatattggtaagcactattaagttcttctttcagcatgccgaaggggttcttaaatgtcacatttaaaaagttacacattatatataagcattggttaaatatttatataattagataatcatgacctatagctgtttaacgtgacacttaatatatttaatttgaaaaattatgtaaaatatttaataattacagatgtcttatgtatgataaaatatgaaggtatttatttattagacaacaataataatttgccataagcctttgacttacaatatctatatttaactatatacatgcaaacatacgtttgggattcctttgttttttaaatatacaggatcatacttttttaagacttacagtaactatcaatttattttatttttaatttactgctgtatattaatccagtcttatccaaaattttatattatttcttcattaatgaacatttttttcctctgtttatgttatttataataaggtagtgaatacccttgtacataagcatagattcttaaacagggaatcgctgttccagttatcatttgttcattttatattttagtattaataaattctacaaaattatattcccatcggttaaagacagtatatgtttcctcacattcctgccagcatataatgttgctatttttgaagtttgcctaggttaaaaaaaaaaaaactcaacattttaatttgtattgccccaaatgcttatgtgatgttttatcttttcaaatgagatttggctttctttttttttttttatttggttttagtttttttttttttttaatttttgattttttctagagacagggtctcactttatcacccaggctggaatgcagtggcatgataatagctcactgtaacctccaactcctgggctcaagagatcctcctgcctcagcctcctaagtggttaggactacaggtgtgaaccatcaggcctggctgatttttaattttcttgtagagatgggggtctcactgtgatgccctggctgatcttgaactcctgcctcaagcgatcctcctccctcgtcttcccacagtgttgggattacatgcatgagccacattactcagccttttcttcatttgtaaattgcctttcacatcttcatcctccttttataggattatttaataactacttgtttatttaaaaggcatttttatattctttgtgtttaaatgtgttatagatattgtcctctaatgtgcttaatttgattccagtatctttaaatttaaaacttttaatatctagatgatgctaggttctctttattattctttttccttgaaggttttctctgttgattctcgcacatcagtttttccaaatgaatttagaattatttttttaaggcaaagaggaaaaatttctgtattgcaactgtgattggaattttataaattttgttaagaaaattttgacatttttatgatagtaaatctttctatccatagtgtgcatggctcgtattttctggggtcattcatttttttaatgtctttcaaggaagttttatacttttcttggtcttatatctttttttccccctcaaatatattcctagctattttatagcatttattcctttgaatgagaccctccccttgttttcgttgtagtcttgttattatagtctgtaggaaagttattaagtttttttttttttttgagccggagtctcgctctatcaccaggctggagtgcagtggcacgatctcagctcactgcaacctccgcatcccaggttcaagcaattctcctgcctcagcctctcaagtagctgagactacaggcacgtatgaccatgcccagctaatttttgtatttttagtagagatggggtttcaccatgttggccaggatggtcttgatctcttgacctcgtgatccacctgccttagcctcccaaagtgctgggattacaggtgggagccaccacacctggccaaaagttaataacttttatgtgcttattttatatcatgtcagctggataattacttgtgttaattcttctttaattttcttgtgttttcagttgaaaagtacaatataggtaattacctataagtaatgcagtttttatctcctcccccaacattttaaccttacatattcatattttttcatattggttcaggccctcatagagtattcatttgttaaggtgagcgtgatcatccttatctttctttgactttggtgggtgcctttaatattttgccagtaattatgatattcaggcagttctcttctatttcaacttgttaggagattatttctgtttttaatcaagaataagtattaaagtttgtcaaatgcttttaaaatatgcatcgggattataattgatgtatgttagcgtttgccttatttagcctttattatactgagttgtgttaatagatttactaatgctgcggtggccatacattactagaataagctctgtctggtcattgtggttaggggtggtgttggtttttaaaatatattgctggattcaataaaatgcttttggtagaatcataaaggagattgagcttttaattttgttttgtgttattcttttttggtttggtgtgaaggttatttgtcttcatagaatgaggtgaaaagctttccatgtttttctatgctatatacagaacaaatcattttacttgaaagaattgtagaatttgaccatttgacacctttttgcatcttctgtggttttgttactgttttctcactttcttagaattaaaatttaaaaaatacgtgttttgatttctataatgtctttggcttagctgtctattctgcctcttctcattctgtgctggtattgttttaggccctgcttctctccccagcttcagcctcatgtttatgtaccttctgacacagagcatgaactttgtttagaagttggtcagagagcttgattttagaagtaaaagttgatgctacctgtaagtttatatatatgcaagggggtggctaagattggtttcattgttcaaattaccttgatgtttgttccagagtgtctttctgttctgtggattctgaaattgggatttttctggaactctttctgtctttgcaatgtcattttcttttttgtgattgtagctatagcttttcttttctgggctagttcttatctccattttttcttgggagttcctccatatttattaatgatactttttattataacattacagtagacttactgtgatgattccagacattttgaaggacatatggaaactaagtatcttaatagtatcttaatagaatccactcatttaatatgttaaaaatcacaggcaggcaggctttatcttgaagggtcatatagtaaatattgtaggttttatggtgccatatggtctctgttgcagctatacaactctgactttatagtatgaaagcaaccatagatgatgtatcaacaaatgtgtgtggctctgttccaatacagctttatttatgcatacccaaatttgaatttcatttgatttttatgcattttgaaacaattttttattttgatttttttccccaggcatttaaaaatgtaaaaaccattcttagctcacaggtttgtactaaaacaggcagtgggtctgatttttctttgaatgtcatttgtctcctatcttcatttttcctgttgtttggagttaattcctctatatttattcaagaaatctcacttcagttctaatttgaacaacttgatgcatgcttggcttatacctttgtcattgggttttgctttttggagtcataaagcttttaattttaaggtcttcgctttgatagggagtttaaaatattgcatctgggggttttgtattcttgataaaattcaaagaaaacaaaacaaaacagttcaagaaaaaacaaaacaaaaaccaaagataagttcatccaatcttaaaaaaatgtaaagagaaaaaatagcataaacttagaacatcttgaatagtaagatgttgaaataagtcaagtactcactattaatgttagttgattaaacttgcggtttaaagacatagatgttcagatttgactaaataattgacatcagctgaatattgttaaaaatagccacatctgggatacctctttttgtacctgaagattactagccaaaaaaagatatatcagtattgatattggtcaaaatacatttcaaaataaaaagcattactagagagagagttgctgcatgtgataaaagattcaatttttcaagaaacatacccttaaacttgtatgcacttaaaaacaaaagtctcaagatacacacataaaatgatatggataaattggtaatttgtcatcactgacaaaattatcaacccatctccctcaatttaccatgaggtcaaaaagacaaaagttaataaaaattttttagtgatttgaacaacataattatcaagtttggtttaatagactcaaccccaacttatgtattctcatgaacacaagaaatgtttaaagatatgggtcacgtgcaggaccctaaggtctctgttaaatttcagaaaattggtgtatagagaccatattttctgtccacggtggaattaagttatgttaaaagaaaaacttcagccaaattaagtttaaaggagtttaatagaccagtgaacgatttatgaatcgggcagtccccagaatcacagtacattcagagagactccagggatgccttgtggtcagaacaaatttatagacaaaaaagaaggaagtgacatacagaaatcagaagcgaggtgcagaaacagctggattggttacagctcagcgtttgtcttattttaacacagtttgaacactgggcagtgtatgagtggttgaagtatggctgctgggattggccaagcctcaggtactgtcacagggcatactcctaagttaggttttctgtcttttctacctattaagttaggttgcagttcatccacaagtatagaagtacagagtctttctaaggccgtatttagtttgctttaacagttagaaacaagatatgcatacgtacagattctaaaaccgtatatttgtaaactgagaatactgaacagctcatgggtcaaagaagaaactataatggaaaagaatactaaaactgaatgattatacaattaccatatgtccaaatatatgagatttgattaaagtggtactgttagctgtgatgtatccatgtcatgcagcacaagtatgttagcatcagtgaatctgtacaggtctgtagcaatctcagttcttgcctcctcagaagaaagaattcgacccaggggcataaggctggaggagacactggggcaagttttagagcaggagtgaaagtttgttaaagagctctagagcaggaaggagaggaacttgcacaaggatcaagtagacgacttgagagatcaggcgcaccgtttgaccttttgaattggggttttatatgttggcattcttctggggtcttctgttgcttctcctgtgattcttcccttggggtgggctgtctgcatgcgcagtggcctgccagcccttgggaggggctgcacgtgcagtgtgtttactaagttgcaggcctgcctacttgaggcaccttcccactttgcagccccgtgttcctagagggacgtcatccgccattttgcctcagtgctcatgctcaactgcacttgcccagctcctgagatcttatcaggaagctgctgatcaccagtttcaggtatttctatctggaaatacctgatatttcgaggagactgcctttctctggtgttggctgtgaccaattattattttagagagacagttaacagccgcctgacaattacatggtcacctgacattcctggtgtgtgtattttgtggggagccctttccaactctgctcgtgtctgattagctacctactgtaacagtacttgaggggaatttacaacattaaatccataagttagcaaggagatgtcattgatgataaatagctaagcattaccttaaaaagatttttaaaagttttaagttcaaagaatgttgaactaaagcaacaatacaaggaacagaaatgagtaaaatggaagacagagatgcagtgcctagggtcaacacaaggccgtgctctttacagtggagtaaaaagtgttttaacaatacgtattacaaatgaaaaaaaggtgtgattatagatacaggagagattataaagataataagaaaatactgggaaaaaactttatgccaataaatatgaaacttctgtctcaagaagaaatcatgggctggaatagtcatgtaaccaaaagagggtccaacttctcgccgcttgtagaaagaagccaaaataacaagagtgaggtatgataaagagtgtgaattttattaattgttgccagcaagggggaaagtggacagaatcctttcccaaaactgccactttccaatttctggagagtgcaggggtttaagaagagggatttggaatgcaggagaggcaagggggctgggaggtgcccaatggcatgacttgctcctatggcttatcctgaattattgttccatctggtgaaggggccagcaccatcttgggcccaaccatgccaaatcagtcgcagtcagtcttgctgtcagtctctagccgggagtaactctggccttgaagtaatatcctgctcgggagagaattctggaggtgcctggtttgcatcaggatttggcccctgaagcttctaaggaaacataggaccagataagtgagcatggtgtgagcttaacaaacatccaggtaaatacatgtgcatcaggcatgaaagcataaggtgggaaagggaggggagtggagttttaaagcacattccaaggctgtatttagagacaaaagaaaacacatctgtagtttgtctcaaagctgtgtcttgagactgggatgaaaagaggaaaggaaaaaaaatttctaaaagcagtttgaagctaagctgcttggttacagtcatataatcactgaagtgatcaaccaattcttatagtaaactttttcacagagaaagcaccagacccagttttttgatgatagagatttacttttaagatgttttacccaatgcataaggaacagattcttacaatcttatacagacagttccacaggatagtaaagtgagagtttactcctaactcattatttcagactagtgtaatctttatacctaaatccgagagaaacaatggaagaaaggaataggaggagacagcctcacttgtgagcatacatgaaatccagcagattgtaacaaaagaccaaattgggctttcccaggaaggcaatggtggtttccactggaaaatattaaattttaactcatgatgttagccaatgaaaataaagtcatatgtgtatctcagtagattgaggaaaaagcatttgagaaatatcaacatgtattcatggaaaatgttctcagcaaactaggaatagaaggaaacttccttagcctgacgaaaggtatctctttcttaacaataaaatattagaagtcatctcctaaaatcaggaacaaggcaagaggacccactgtcaccacctctgttctatattattctgtaaatcctggtttctgtagtaggcaggaaacaacaataaataaggaccgaaaaagaaataacagagtccttctcatgtggtatggctgtctccatcaaaaagctaaaagaaacaataaattattagaaataagagtgttgcaagatggctggaaatgagatccatattcagaataatcaattgcctttctttataccaacaacagacaaaagatgtcaagtaaggataccctggaaagtaggaacaaaaatgagtctaggactacatgtagcatatttggagaaattataaaactttattgtaacatgtttaaaaaaataaatggagacaaattatcctcttgaataggaagattgagtattaaaaagatgattctcacaaatggtgtaattcagtgtaattacacctagactctcagtattgattttgtgagggacttgatgagcaaaaagagacccccaaatagccaaacactcataaagaagaaaatgaagcgtcttgccatttcagcactcaagatttattataatgacatagaaatgaagacggtgtattattcgctttcggatagataagtataccattgggttgaaatatagaacccccaaaagaccacccaagtggggaagttgatatgtgacagaggtggcattgcagatcgctggggaatggcaaagacttaatatgtttagaagtggaaactaaaacttcaatgatcttaacagagagaagagtttcttaaaacataaaatatgacacataaaagaaaacagtgatcaattttaccaaattaaacttaagaacatcaattcatgaaaacatactataaataaagtagaaagaaaagacacagactgggagacaatatttgaaacacatagtggccaaagattcttgtatgcattgataagtacatacaggaatcaatacatgcatacatatgtacagccttgaagtcagcaagaggacatgacagaaaaacatttcacacagaggtagaggagtgagggtagacataggaaaagatggtcagccacagtagtagtcatagacctgcaattaagaccacagtgggatgccattttacatccaccagattagccaaaaattcttaagccaggtcttactaagagttagtgagttaagtggattaccaggcaggaagatttatacttctaatgggagctgaactggtgtaactgcttaggaaaagtatttgatattgtctttcaaatttgaatatccacattccataagactcggtagttcactttttaaggggtatttacatagagggataacttaaagactgtttttattggacctgtagtaagaaatatatctacactctggcccagtaaacacataggggtgggagagtatcaaaggttatggttcttctgtctgtacactctagtttgatactaccctgtgtcattaaaaaaaattcctcatcttgactagctcatgaatgggttgctacttggatttgaaaccacattgttctgcagacattttgcacatgtgtcctagggacacttaacattgttaatagcaaaaagctgaaaaacaaccaaatttctatgacaggagaatggaaaaatattttggtatatttatacaattggatagtagagagcagtgtacataaatgaataatacacacatgtaccaatatggataaatctttgaaacacaatgttgatttgaaagtatgacttattttttataaaactaatagcattcaaagctaaacagtttgtgtttagggatgtgtaagtgtgtaataaaatcaacatatacacacacacacagactttacaaggatggttatctttggtttggaattcaggtggaaggatagttgaagagctcggtggcagacaggtgttagttctgacctagatctagctttgagtggtgattgtgttggagtttattatgattatgctttattacatgtatatgaatatattctttatatgtgccaaataagaccaatttttagaagattcatctatcttgaaacttgtggacatttcttatttactgtatttttttttctttcttactgtcaactgaagaatgacaaggttcataactttagaaaggagagctttatgtctcataaagggttacagcctgcaaggtggctattcccacactctgggaagcacagcctctggccagaatccagaaactgccacttggaaggtggggtaaagggaacaggaatgtatgctgagcagggtggccaggtatacatagtcaataagctgcaggaggagtcatgaatatttatgaaaggagaaacaggcacatgcgcatttgagcttcaggcctttccgtgggacccatgtgtaacaaatggcagccagagcaggatctgagggtggagtcttgggacctctgctgtcaaaagatgaaacagagggctgggcgcggtggctcatgcctgtaatcccaccacttttcgaggccaaggcgggcagatcacctgaggtcaggagttcgagaccagcctggccaacgtggtgaaaccctgtctctactaaaaaaatacaaaaattagctggacgtggtggcgcacgcctgtaatcctagcctgtagtgccagctattagggaggctgaggcacgagaatcgtttgaacctgggaggcggaagttgcagtgagccgagatcatgccactgcactccagtctgggtgacagagtgagactccgtctcaaaaaagaagaagcagatgacacgaaaaactctcattgcgcctcctctgtagatgggccagaaccaccctgtggttggtagtctctttatcaggaagaaatgctggttggttgttttgacagaacggcagaagggcggggcagcattcaggctgttggttgaaatcagcagtggcatctttcaagggctggtttctctttagcccgttagaagaaagcctaatggcggctattgagggagatggtctgacctcccatcacatcatagctacgaattcagcctctgaggtttctctgtggtccccttggccaaaagaaggtcagttcagttggttgaggggcttagaatttttttttttatttctcattattttcaagggaagccaagattttacatgtctagaaaaatagctcttgggcttttggttttaaggtgttttttttttttttttccttctttgagagagggtctccctgtgtcgcccaggctggagtgcagtggtgcgatctcagctgtctgtagcctcgacctccggggctcaagtgatcctcccacctcagcctcccgagtagcagggatgggctctaccatgcccggctaagttttgtgttgtttcgtcatgtttcccagactggtttcgaactccttgactcaagtgatcctcccgccttggcctcctgaagtgctgggattacaggcatgagccactgttcctggccccctacttttaaggtttttgacattaaaacttttcttgaaactttttctctttgatgggagagaaaaatccttttgcatgtctaacaaaatgcgtttatgggcaggcacagtggctcatgcctgcagtcctaacactttgggagcctgaggcgggcagatcacctgaggtcagaagtttgagaccagccttgccaacatggtgaacccccatctctactcgaagtacagaaattagccaggcgtggtggcacgtgcctgtaatcccagctactcaggaggctgaggcacgagcatcacttgaacttaggaggcggaggttgcaatgagccgagatcgtgccatttgcactccagcctgggcgacaagagtgaaactcggtctcaaaaaaaaaaaaaaaagagcgtttatggaccagatactgcacagaggcctccatctttctttctggctctcttttcactagttcttctcataaagtttgttcattttcttttttttttttttttttttgagacggagtctcgctttgtcgcccaggccggactgcggactgcagtggcgcaatctcggctcactgcaacgtccgcctcccgggttcacgccattctcctgcctcagcctcccaagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaagtttgttcattttctgagagaagagcttctaggcttatttttgtcttgggaggaagtgacttggccagtggatgttcatggatactgatggtggaggatcctgcattgtactgttaaaattatgggaggccattgttttggactgagctcctgctcaaatccccagcagaccagattaaattgatatagtcactcctgcaaaatgccacataatcaaattgaaactttattaaggaagcagacggattccaaaacagaccggtttttcctgaaagcaggagattccagtctacctgaatcagctcagtaagtctactctgctttaacccttgccaaaaaaacaaccccccccgcaaagcctgatgtaacctgttaaccaattagttttttttcctcttgtcctgttttcttgtttctaccttactttaaaacccactgttctgccattgcctcatgggaacttttattctattttgtagaatggaggctgccctgcctcatgaatcacaaataaaaggcaattggatctataactcaatttgttagatttttgtctttgacagtacttacgggcctgcttcctatacagaccctccagtaattaaatgccttggcagtggtgtactggggcctgctcacactgactccaggtgattgttaaattttcaggaatttttttttgtttgttttaaaaaaaagatagggtcccactctgttgctcaggctggagtgcagtggcacgatctcggctcactgcagcctccacctcttgcgttcaagtaattcttccaccacagcctcttgagtagttagaactacaagcgtgagccaccacgccggctattttgtattttttggtagagacagggtttcgccatgttggccaggctggtcttgaactcctggcctcaagtgatacccccaccttggcctcctaaagtgctgggattacaggcatgagccatgactcccagcctaatgttcagaaattttgtgagctggctgttgaaccataggcatctttaaattgtggcagtattagtactgatacaaatcagggttcacccttgtctgttgggtaccattttcccctcttgcctcctgttatattcacattttctacaactggagaattgatgggatctgaaaggcaaatgtattttctctttggcaaccgtgatttcctgtactctgtgtgtttttaatgaaagagagtttataagcaacttacagacatgacttatttgaaagctcttctgttttattaaaatagagatcagaaagcagttctgtatttcattcagagtcactaaatttactttattgttcctagtatcttagaaagtctgttcttaaacagtaaaatcctagaataaaattgagttcttttgttctttaaaaaaaaaaaaaagtcatgtgactatttttgagatgtttcattcaaaggaaatggtgaatttttagatttctaaaatgttaatcattgttacaagtccccttccctcttgaagtttaggttgcctggattagaagcagtaaactgattattttgaaatattaggcatcagcaaggctacacagcaatgaaattatcaggatctattaacagctgttgtttcttaccattccttctagggcttcctggtgtgcaccttccttccagtagttcgtggtggcagtgttgacatcactattgggacccatattgtgcacattagcagtatagaatatggggagtggacatgttaattacctcactgagggccattcttgcccttagtaacatttaaattagatgatatttcaagatgagatagaaaacatttttagaattctctaagtggaaactctaaagggatagacctagttctctcaagttgagacatcaaagaattgttacctaatgataaagaaatatttaaaataggttttcattagaattttagattacagaatttagtgtgaggcaatcatgtttttgtaaatgatcttccacagtaatcctttaaaatgccagcattcataacttctttttctttctctgatgaaataaaattgcaaaagctttaatttagcagtgtaaatgcaaagctgaattgaaatacaggtaattatgttaaaagggacagctgacaaaattcatgtatttaacaatttttttcttaacatttataaggttttatagaaagaaataatttaattttggaaattttcagtctctggatctgttcttcatgtgattgaaaatctactgtccatattcatttttctatgaaaaaagctctctctttgaaatacaaagaatatctttgtataactgaatgaaaaaattctgtgtgaaaaatctgatgtaagttttatggtataaacctcttttcaagcagtgcttctcattttatttttgttagcatgtctttcagtttgagaattgggatacatttgaattttattattgaaaggctcaaagtaatgcaaaacaagtcactaataattaacagacccactacagtataatagatgcacatacatatcaaactttcatcttggcctctcttctgcagaggtttgatattggaatcaaactcttctgtcctagcctaactatctttgtataaatgagtgttctttaatgttttggtaaccacatgatctatctttctgtcatctttatcctaagcttgaagttccattatatttcagcatgtaatgatactcttaggaggtcacaagatctgctcagtttaacattttctcaaagataatgccataggatggtttattttgttatagacagtttagattttatacattgttaaaatgtgatgaactcttgaattattttggtgtaagtttattgatcttgatctcttgatgtggaatcagaaaatgtggattctctctaccatctggtactttccatatctccccattgcaagaaccatgagttggctttttcttcacttatacctagtgtctagtaatgagcacatggtaggtacctgattgagagggcaaattggcttatatcttattggtgtaaacatgttagccatactgtaattatttcatcttatcttcaggctgaaccttctcttgcaatccctttcctgtctgcctctacctaaaattccaagaatgctgctcaacttgcctgagtttgatcctctgtcttttctacccaagctcctgctgctcttaggacatgactgagaatgatagaatgaacatgagtggagcagttgttggaatgtctattgtggtaaattaggactgatcctttgctagattgggatggaaggtctcgctcaggagtcccaagtttgatatgtgaaggtagtgatgcttagtggacatccaagtgcagatgaattcggagttgaggcaggttgacccaggtgaacttgggagtcatcagaatgttaatgctatgtgaagccatgaccactggatgagacacctagggggttactgtagagataaaaaaaagtctgaggactgtgaggcattatgatatttagaggctggaatgaaagcggtagattgagaaaggccacccagggtaggaaggtgggaagaaaacaatattcttaattgtttgtgcttattttatgttagatccggggatacatgtgcaggtttgttacatgcatgtattgtgtaatggtgagtttgggctcctagtgaacccatcacccaaatagtgaatgttgtatgcaatcagtaatttttcacctctcaccctcttcaccactgtcctcccctgtggagtccccagtgtctgttatttccatctttatgttcatgtatacccattgttttgcttccacttataagtgagaacatggcagtatttgattttctatttccgagttatttcactaaggataatgacctccagctccatggggcagcaaaagacgtggtttcattcttttattatggctgcatagtattccatggtgtatatataccacattaggaagaaaacagtattccaaaagccaagtgaagaaaatgtttcaagaaggagagtgtgattaaatgctgttgacaggccaagtaagatgaacagtaagaactgactactgggtctttgagacagtttgtgtatttggcaccacccaaatctcatgttgaattgtaatccccagtgttggaggtggggcctggtgggaggtgttggagtcatgggagtggatccctcatgggttggtgctcctgacctcaggttattctttcataactgtaatatcctaaacatatcgtctgatctttattttacaccctgatcccatctccctacacttgctcttgatatacacaccaccctgtgtgacattcgtctccctctaaccacttcacaccccattcgcaacgtacacttaccactgcaaccttgctgctgatactgagtgaccttacctcacttaatagcatgcttctctccccttcccattcagactactaaagctgaggtgctctggcgcatcataaaacctttcaactctcttaatgcagttggcttgctacttagcctgacttacgcttcgttcctcacttccttcactctcatccccttgccgcctccgactaacctcttctttcttctctatcacctctatactctccattacccaggcatcttcctctaactctatgacgctccattactccttctatcccgctctactccgttctcgccgctcnnnnnnnnnnnnnnnnnnnntccgtcgagggtgggtgggccgagctgaggatcgacccaggtggtggctccaaagggctggattacagcatgagccaccacgcctggccagcaattcttgacataatgcgttgaagataaaagttaagagccaggcgccgtggctcacgcctgtaatcccagcactttgggaggtcgaggctggtggatcacctgaggtcaggagttcgagaccagcctggccaacagggtgaaaccccatcgctgctaaaagtacaaaaaattagccgggcatgatggtaggcacctgtaatgccagctatttggaaggctgaggcaggagaatcgcttgaacctgggaggcggaggttgcagtgagccaagattgtggcattgcacttcagcctgggtaacaatagcgaaactgcgtctcaaaaaaaaaaaaaaaagaattgcttaataaggaacattttcaaagtttgcagaatttttttgtcaatccaccaagttgacctgaattgtttatttatgttcactgtgtcttttttgtttgcttgagggtcaaagagatttctaaaaatatgtaatgtagcttattagattgaatccagcatatattttactttttattttcctaatttgatgtaattattagaaatttgaagtgccgaattatggtgtgtgaaagattaattggtagaacactttactgtctttgttttctgcatggtgacttacagatcttagttttagttttctttatcctctcatcaagaatggtggagaatgaaaacaaacatctgggagtcagttcttttatgagttattaacatccctctccttttgaatcatagttcagtatgtagttttcttgtttttagagacagtgtctcgctctcttgcccaggctgaagtgcagtggcacagtcatagctcactgtagccttgaactcctgggctcaaatgatcctcctgccccagtctcctgagtagctaggactactcagtccaccatgcctggctaatctttttcttagtggatggatacagcttctttaaatatattgatgtgtttggtattaggcctgtcgttatgcttttctttgtcttctgattttggcaattttacattttaaaaataatcttaactatgttaggtgcttctctggtttgttctgtgtgtgggtttattctaataatgttaagcgttgtattttggtactaccttatcatcattattacacttacgtagtgtatttgatccactgtttctttagaaagttctattgaacaatgacagaatttgtgtatttcctgttttaaattattccttcccacctttctcttctcccacccttttttcttagtgttttctttatgcaatagttgaccccttattattaggggatgcactccaagacccctagtggatgtctgaaaccacagatgataccaaaccctgtatatactgttttttcctgtacatacacacctatgatgaagtttaatttgtaaattaggcatagtaagatattagcaacaataactaggaataaaacggaacaatttgcaacaatattctgtaataaaagtcatatgaatatagtctgttctcaaaatattttactgcattatactcacccttattgtgttgaagaagggatggagcaggatggtgcgagattttgtcatgctactcagaatggtgtgtcatttaaaacttatatgttgtttatttttggacttttccgtgtaatattttttaactgcggttgaccatgggtaactgaaacctcaaaaagtgaaaccgcacgtaaggggagactactataattttagatttacttacacctctgttacttggtgtacaaattttaaattatatctctgcatcagcccttgttcatgaaagctcaagaaaccagtgtactttcttttgttgactttatgattttcagatcaattagatcatataattctttaaaatagctttattgaggtgtaatgacataaaataaattgcccatattaaagtgtacaatttggtaacttttgacttgtgaaaacagcaccacaatcaagataatgaatatgtccatcacctccagaaatttcctcatggccgtttgctgtctctttcttttgcccctccctgctaccctcaacttatcctcaggcaattactgaacttgtatcactataatttccatatttttgaatttcatgaaaatgcaacagtatgtattaatttttgtatgtattcgcttttttttgatcaatagttcttttttattgatgagtagtattccattgcccagatgtactacgtgaaagacatttgggttgtgttcagttttgggctgttacacataaagctgctacagacatttgtgtgtaaagccttcactacccttacgtttatggatcaagttatggccgttgcttcctcagtagcattttcaatgtagtggatcagcatattatcctatggatggtgagactgtcaagttccctgtggattagcttaagtatccagagctcctcaaactgtattgtgtgtataaatcacctgggttaaaaatgtgcattgtgaaaaatgtagatcctgcttcagatgggtctgcgataggacctgggagtctacatttataaaaagcttacaggtgatgctaatcctgctgttctacaaaccatactctaaataacaaggttacagagcctgagagtttatgaagcaaggcaataatggtgaggttttttcctgccaagtgaaagtaaactacttatggtatgttatctttttatcagaaatagaagtgactgcatttaccatgttaagcagcattttaaatgccaagagtttggttaaatgtggaccagcaatcaacagaagtcatcactcagttctactagtaagtgtaaccttccagataagattgctgaatgggcatggacttccctgccagcctgtcatctgtgcatttcccttagggagggttttttgatttggaattttggtaggaaggaaatattctggggttggccctttttattttaatagcctatagagtcgtgtactggggggcactgccacactgtgggttttgggggtttccagagaaaactcaagtcagaactcgattacagtcagctgactggtgctttgcatccagttcccaaggtttccccagttgaacccagtgaactgtggtgttgccgtaggtctcaaggaattagtggcgcacagagccagtgtgctgtcgggcttcctattgagtttcagcatttcccttttctcgggtacgtggtcacaagtccttaggggaaggatggaaggatggcttacggtgttggggatctggggtgtgagaactagtgataggcagtaatggttaagagcaaaaccctgaaaccagacagcctgtgctcagactgtaccaggcaagtaacagcaactcctttgtgcctcagtgtgtcatctataaattgaaagtcatgagttcttacagcataaggctgatagaagtttaagtaatctttgtaaggttcttaggacagtggccacacatagtaaaaactttttaagtatttgctagatacataagcgtatatatagaaaggtaggaaggcaggtggggaaatgataggcttagaaaaattaagcaacttttctcagggctcacagtggtaacagtggtggcattgagccaggatttgacatttgaactccccacagttgcattctgtagcttcacttaaatcattcaacatggtatgtggcatatatttgatggaagcagtgactgaatttaggacttcaccagtttactaatttgttgagacgtgaagtgtcagcataagcatagtataccaatttaacatccctgaactcagactagactatgtctgtgatgttctggcttgggtcgtgttagtaataaagtagagaataagctcatgtgtagttatattgttgacccttagttatattaaagaatacgtcctttctaataactgaatttttttttaacttttcctggacataggtatatatgaattgctttttaaagaaattataggtgttctcttctaattgactaaggaagtcatctgatttatatcagatcagattgttttataaacattctatcatgttgttttaaagatgctaaaggaaataatatcctagtatggtattaaaataatatattgctgagtttttccaaatgaataatgtattgctgaaattttccaaatttttccatgtaatattttcaaactgcagttgaccatgggtaactgaaacctcaaaaagtgaaactgcacgtaagtggagactactataattttagatttactcacacctctgttacttggtgcacaagttttaaattatatctctccaccagtacttgcttatgaaagctcaagaaaccagtgtactttgtttttttggcttttttacttcattaagctgttttacttaattctttagttagaaacattttgtagacggctttctacaatgctaatttgttaattaataatttaaagtaccagtgcttaacctatttaatgatttgagaatattagtatcccatttttcttgttctttttgtatgtggaacccaaatttcttgtcattttgtgttatatatttcctataagctttaggtacaaggtgctgttaagagttaaggaaggtactttctgccttcatcattgagtataaaatctgcagcactgcagtgaggctgtcctcatgctgttgccactcatggtcttactctgcatcactcgcagtattagggaggagttggaccctattccatgttgcccacatgcctttggttttagctaaatcgaggattgattacttattttatgctgtttctaggcagtttttctctttttttcctagtaaaaaagtaaatttagtcctcttttctgtgtgaatccatacagcctgaaattactatgacaggcttgtataaaaaagcatgtgagagggaatgctagcttccagcaatttgttcttggtataatgaccctttctgtaaggaatgttgctgctcttcatctgttagtttttcttcacaacaacttgtagaatttttccatttcatttagattttaacctagtgctagaatcgaagtgtcatatttaaatactgttacttttggcttttggatatgtgttccttttaaggtctgtggtgcctgagacttctcactttgaactcccatctctcacctgtggtattatgtttgcagcaatgaccctggtgtgggcctccagggagcaacagcccagccagcctgcaggcctcactcagggcttgttttgttattgtgattttttttaaacctcagtgatgggaatgggagaatatacattaggatgaaggtaaagttttagccaaaatgaaagataattaggtatttattgtaattttcagttaacttagattttatttctattcttcttgaaagattttagtattcagacttccagcataatgctacatagggcctttcccttgaaatgcttgatttcactgctttctgtaggaacactattcttcaagcaaaaccaaatttaaaaatcctgtggggctgggcgcagtggcttacgcctgtaatcccagcactttgggaggccgaggcgggtggatcacgaggtcagattgagaccatcctggctaacacggtgaaaccctgtctctactaaaaacacaaaaaattagctgggcgtagtggcgggcaccagtagtcccagctactcgggagactgaggcaggagaatggtgtgaacccgggaggaggagcttgcagtgagccgagattgcgccactgcactctagcctgggcgacagagcaagagactccgtttcaaaaaaaaaaatcatgcgtctgacactaacattttcctttaataatcaaattgttcatatttttctagaagcatcaaataacctacattatgtgttgtatttatctgagaatcgaaagtagatactttaattttccccactttcatagtcccttgagtctaattatcgtaggctgcaggtcctacagactactgaagtgaaccaggggcctgccttacagttgcttttttccctcttaaaatagcaaactgtttaattgtttgctttaattatatttttaggagcatttcaaaggattattatcttctttgtcatacctggctcatttcctggtacgaaactgaaaatagtatctgatcctattggttgcataacatactgagtcataatttcttcctcttgctgttgggaatagccattgctcgttggattcgcagttcctgtttcatttatttgtgcttatatacaactgtcattttgctattcctttagatctttgaaattcataatctacctttctaaaggtgtattttattgagttcctgctatgattattaacattttttttccttttttttgagacagagtctcactttgttgcccaggctggaatgcagtggcacgatctcagctcactgcaacctctgcctccagggttcaagcaattcccctgcctcaccttcccagtagctgggattacaggcacgcaccaccatgtctggctaatttttttgtttgtttgttcgtttgtttttttgagatggagtttcactcttgttgcccaggctggagtgcaatggcgcgatctcagctcactgcaacttccacttcctgggttcaagcgattctcctgcctcagcctcttgagtagctgggattacagtcatgtaccaccacgcccagctaattttgtatttttagtagagatggggtttctctatgttggtcaggctggtctcaaactcctggcctcaggtgatctgtctgcctcagcctcccaaagtgctgggattacaggcgtgagccaatttttgtatttttagtagagatggggtttcaccatgttggccaggctggtcgccaactcctgaccttaaatgatccacctgccttggactcccaaagtgctgggattacaggcatgagccacactgcacccggccccctctttgattattaagtgctcccaagtagaagaaatactagatgtaaagaaaccacatatatcagactggcatgtgctttgagatgatgcatactttcctggataaaatttactacgacagacatcttttagggaataattaggatgatgtatagccttagaatttataatattgtaaaatgactaatatttaattacccattgaatacgaattaagctgttttacttaattctttagttagaaacattttatagacagctttctacaaggctaatttatgttaattaataatttaaagttccagtgcttaacctatttaataatatgagaattagtatcccatttttcttgttctttttgtatgtggaacccaaatttctcatcattttgtgttacgtatttcttacaaattgtaaggcatatggtgcctgagacttgctcttggagctcctgtcttccatctgcaggccctggtcctcacctctggtatgtctcttggcacctaggctggctctttttgcagtgaccctggtgtgggcctgcacaaaaggaaacaagccctggaattgttaagcttctcaagggcacacaattttcatcctctttagaaacataatttctcaaattctttcttaaaaaatcaagacgaggtctcaccatgtttcccaggctggtcttgaattcctgggcacaggcaatcgttcgtccttggcctcccagaatgctgggattacaggcatgagtcactgtacctggctcaaattcctattagacttaaaaatagtttttattaattccaaaaagtataaacttattggagaaataagaaagatgcatttatcactccagagattccaagggttttaagagctgtgtgtctggaaacagggatgaagaccaaatatgtatttcataatatcacggcctccagcagctacttgctgagtgacttcagcacttacgtagcagggagggagcacccactctttctctgcttctgctctctccatcttagaactcttggcaatttttcttttctttagctccataggactgcatatgtttatttctttattaaacaaaagaagttaataaaaaaaagaaaagtaggcaaaataccaggattaatataataaaggaggaagaggcagtgaaaaaccgtgaggtttgtcccagattagtaagaacgttattgagtagcattgatgtgatgttaatttttgtttcatatgggctgtatggtaatgaatgttctgatagaaaaggttatgcacagagtgccatgtaagcatagaggaagggacatttgagcctcgacagacaagtaggggctagctaggcattctaggcagagctgcaccttgtatacagatattgagtcttgaatggagacttttggagctgttttaagtagtttggggctggaacagaatatctgaggttttggaagagattaggcaggtgtgcagaacttagttccaggtgccttcctgtgccatgctaaatgtttacaccatttctatcctgaaggtagaataaatcattgaacagttttaaataggggaatagcatgactgtgtttacattttagaaagattaccctacaggaaaggtagaagatgcatagaagggtggcagattgcaggtgaaggagattaattaggtacttcctgctggtgagaaatgatgggacccagaacttgggtggtagaaaagggcattggcaaggaggacatctgggatgacttctgagtgtcttgagtaacttgatgaatggaggtgctactaactgaaatacagcctagaagaaggattgagaagaaatggtttggacacatgaagtatttaagtgggtatgtccaacaggcagggggctgtttgggtttgaggtagagatctggaaatcattggtggtagtataggtggtaaaagttgtggatgagaatgagatctcctgggaagagcttttattgagaggggaagaaggctgagaaattaccagaggtagatggaaaggcaggaaaaatgagggacccagcaggcagtgaagggaggaatacaaggagggagtgtccaggatggatgtctctgatcttttgaggcagtacatttaataggtactgaatattgtccactggctataggacaatcttataatgtcattggtaactggaacaagaatggtcttgcttgtttggaggtgaatgggtatggtggcatgggtttactctactcctcttagaagctggtctgtaaaggaggtgagctggagggccttagcaaggcctaaggaaggcttctgacgggtgagacttgaggttggagagatagtaggttgaggaggtctagaaataaatgatctctagacaggtttttaggaaggaagaggagttgagagtcggtaaccaaagtcattacattctacttgtagtagctcaggatgaccttgggaaggactcagtttaacttgctgttttatatttttattgatttttcttttcttttttccagataaaattcactagatattgtttgcacattaaactcatttccagactgcaaaccctgacatagctgttatttttttcactaagtgttctggaaagcacattttgaatttgtcctgtcctttcaagtccctccccacccccaacccctaaatgttcagacaggtacagatagtgaaatactgcctgtgcaaaagccccttccacgcctgctcttctgggagtgcttcaggcggcagctgtgtatatgtgctccttcctggccttttcagacttgatcttcaataagtgatgaattcctttatttatgaataaaactcagtgtacttcagcaaatttgtatattttaaaaggagtcaaggagtgagcctctgggggattttacatatcagaatggaagagagagattttgggggatagtacctttttattgtttttgtttgtttgtttgttttttgagacagtctcactctgtcacccaggctggagtgcaatggcacgatcttggctcactgcaatctctgcctcctgggtttacgcgattctcctgcctcagcctctttgagtagcttggattacaggcacccgccatcatgcctggctaatttttgtatttttgtagagatgaggtttcaccatgttggccaggctggtcttgaactcctgacctcaggtgatcctcccacctcggcctcccaaagtgctgggattacaggcgtgagccacagcgcccggccgatattacctttttaaaatccactttctgttatatattaacattggccagccttgcttcacattcccatagtcagaaataaaattaatagagttctgcttttcagaataactaataaaaccagtcactttttgaactggttatgaaaatgaaatctgtatgtcataatttacaaaagttgtattaaaataatactcaatttctggattcaagcaagttgagcttttagttctgtgactggctgacccctttccaggcatgcttgtgagcaggttctcagggcatcttgcctctgaagtggaagagcctgattgttttccagctcccattcataatgttagggctcctcactaaatgacagctcacgggccaatgccacagcaactacttggacagtttctttcttgtttgagcagatgtctttctttgaatgagactctgtcattccaagcactgaagtagcccataaaggatcataaatttcacaattatgtataagtcatttcaatttgaactttgtatgaaccaaacatcttgtgaaagacttctggctctaagattaagaaatcgtagaactgtgattctgttaattcaacaaaaaatgtttatgaaagtaattcaataatatgggaagatttaaagatattgcacatacatgtgatggaacactatacagtaattatataatgttttgaagaataatgatggaaatgcttatattttgttaaaggtaaaagggatacaaaagtctgtatatgatctcccatttaaagcataaattcacagaaaaaaattaaaaatgaattacacagtgagataataatcttattaaggaagcataaaattttctttccatttcagctaatcttccagtaccaacaattgcagcaatagatggactcgctttaggtggtggtcttgaactggctttagcctgtgatatacgagtagcaggtaagaattaatcctgttaaaaacataatttaaaaaagtgaaggttgtgtttactcttcaggtaattttaaatattttattctgcttcctgttgttgagtagaatattttcaaaaagtcacttgttggtcctaatggtgttttcgaaattcccacctgaaaaaagtcttgtgttgtttcttgccaggatttgggtcaggtagaactgagtttgaatcttaggtcctggaccaggcgcgtggcttgcacctctaatcccagcactttgggaggctgaggtgggaggatcacttgagcctgggagtttgaggctgcagtgagccatgatcgtgccattacactccagctcaggtgacagagggagaccctgtttaaaaaaaaaaaaattaaaaaggaaagaaaaaaaggaaaagaatctgaggtcctcccttttttaggccaatatcttcctctttagaggaaatgggggaaatgactgttgctgttgtgaagattaagcaattaatctgtggatgttaatctaagtactaaatcaccatttgctacagtaatgataactgaatctccttgaagtccactttcttcctgaatggttttctgaggatcttatgaggtgaatagaaaaagagtgaaaagaattagtgcccactgcttactgtgtgcagtccaggcacccagtgttattctagcacttgacatgtattcactcactccatctgcataacaaccctcagagcaggtactttggggcactggaggaaactggagaagggagagaagccccaaagaagtgactgaactgagatttgaacccagactgtttggccacagcccacacacctgttacctcatgagagcaacgtagactgatctcccatattcatcgttgtggacactatatccatagagactcagctctgcctgtgtcctcgggctctgagactgagaactgggcacagcagacggcacagagttgtcactgttcttctcttgctttccattatcgtttctgatgtggctgcatgttaaaagcagagctgccaaggcagaaggattgattgaggccaggagttcaagactagcctgggcagcataaggagacctcatctttataaaagattttttaaatttttagaacaatgtagcgtcaacatgattcagtttcttgggatttctggttgctagtccatgtgtcctttttcctccttttcacttcattttaggaacctattttcttgtaatgaaatcattggattttaaattgaaaagctaaggtacatgtaatccatttctgaaagaatacaggttttggaaattagaatatgggaagtagtctaagtatatttggatatgcaaataaagaagttattaagatgttttaaagtagccatgaaaacagacatgaaaagaggaaccctgtccacctgtcagaatagtaaaactatttgtcagaaggtaactaaagacttggtcttgaaaagttgccatatctgatatgacctattaagctctttggtctgggggactatattcaggcaactgaagaatttgggcttgtcagatactgacaagtctgctgatcctgaataattaatagatctatgcctccaaatatgtcttggcaatattgggtctaataatggagttacagtcctggtcttgtgaatcaaaaattaattcactgccaagcagtttttaacagaaaatgttgtgggactctcctaatacatgtcatttagagtgcttacttatttccataacaatgccttttaagtgattttttttaagaatttgtgatatcaatttaattagtaaacaatattttagtatatctcataactttttcaagttgtcatatttgaatgtgatgatatggatgatacttaattttctttctttcgttttagcttcctctgcaaaaatgggcctggttgaaacaaaattggcgattattcctggtggaggtatgagtagttcacgcccattcctcaaatccttgatttggtcctagaaacagggcataaggcaaaatcatgttaattggaaaggcaacattttgcgtaaagagacaatggcatattgtttgcatccctagcaaagtccccattcaagttacaggcatacctaacagattttccccaccgcaatgaaacaaatactgcgatagagcaagccacacaaattttttggtttcccagtgcatataaaagttatgtttacactatctgcagtctgttaagcatgcagtaccattatgtctaaaaacacaatgtacatatcttaatttaaaaatactttattgctaaattttctaatggtcacctgagccttcaaagaatcataatctttttgctggtagagggttttgccttgatgttgaggctgctgactgattagagtggcggttgctggagtgtggaggtgctgtgccaatttccaaggacagcagtgcagtttgccacatcagttgactcttcctttcacaagagatttctctgtagcatgcgctgctgtttgatagcattttactcataattctttcaaaattggaatcaatcctcaaaccctgccactgctttatcaactaagtttatgtaatactctaaatcctttgttgtcatttctgcagtgttcacagcatctttatcaggagtagattccatctcaagaaactgttttctttatttgtccatgtattagtctgttctcatgcagctaataaagacatatgcgagactgggtaatttataaaggaaagaggtttaatggactcacagttctacatggctggggagtcctcacagtcatgacagaaggcaaaggaagagcaaaggcatgtcttacgtagaggcagtccagagagaatgaaagccaagggaaaagggaaaccccttattaaaaaaagcatgagatttcctgagacttattcaccacgacgagaatagtatgggggaaacccgcctccatggttcagtgatctctcaccatatccctcccacaacatgtgggaattatgggagctacaattcaggatgagatttgggtggggacacagccaaaccagatcaatccacaagaagcaactccccatccattccagttttataatgagacttcagaaattcagtcacgtcttcaggttactcttctaattctatttctcttgctctttccaccacatctgtagtgacttcctccactgaagtcttgaatccctccaagtcatccatgaagattggaatcatcatcttccaaactcctgttaatattgatattctggcctcttcccatgaatcatgaatgttcttaaagggatctagaatggcagatcctttccagaaggttttcaatttaatttgcccagatccataagaggaatcactgtctatggcagctatagccttatgaaatgtggtttttgttttgttttgtttttttgagacggagtctcgctctgttgccaggttggagtgcagtggtgtgatctcggctcactgcaacccctgcctccccggttcaagggattctcctgcctcagcctcctgagtagctgggactacaggtgcacaccaccgtgcccagctaatttttgtattttttgtagagacggagtttcaccatgttggccaggatggtcttgatctcttgacctcatgatctgcctgcctcaagctcccaaagtgctgggattacaggcgtgagccaccacgcccagcctgaaatgtgtgtcttaaataataagacttgaaagtagactgatccatgggctgtggaatggctgttatgttatcaggcatgaaaacaacattcatctccttgtctgtctctgtcagagctcttgggtaaccaggacattgtcactgaacagtaatattttgaaagaactcttttttttgagcagtaggtctcagcagtgggctttagtattcagtaaactatgctggaaaccagatgcactgtcatccaggttttatttgttccatttataaagcataagcagagttaacttagcatagttcttaagggctctagaagtttgggaatgataagtgagcagtggctttaactaaaagccaccagctgcattagtccctaacaagggagtcagtctgtcctttgaagctttgaagccaggcattgacttctcttctgtagctatgaaagtcctggataacatcttcttctaatagtaggctgttttgtctacactgaagatgtgttattcagtgtaggcaccttcatcagtgatcttagctagatcttctggataatttgctgcagcttctacatcagcacgtgctgcttcaccttgtacttctgtgttacggtagatggcttctttccttaaccatgaagtagcctctgctagcttccaacttttcttctgcagcttcttcacttgtctcagacttaactctagaattaaagagagttaagagttatagttaaagagagttagggctttgctctggattaggctttggcttaggggaatgttgtggctagtttgatcttctttacggaccactaaaactttctgcatatcagcaataaggctattctgctttcttcttattcctgtgttcactggagtagcacttctaattaccttcaagaaacgttgctttgcattggcaactaagcctaagtggtgcaagaggcctagcttttggctgatctcagcttttgacatgccttcctcactaagcttaatcatttctagtttttgatttccagtgagagacgtgtggatctttgctctacttgaacactgcagaagtcactggaaggttattcattggcctaatttcaatactgttttgtctcagggaatagagagacccaaggaaagggagagagatgggggaacagcccgttggttgagccgtcagaatacatgcatttattggttaagtttgccatcctatgtgggcgtggttcatggtgccccaaaataattacagtagtaacaacaaagattaatgatcacaggttaccataagagatacaataatgaaaaggtttgaaatattgtgaaaattaccaaaatatggcacagagacatgaagtaagcacatactgttggaaaaatggtgccaatagacttgcttgatgcagggttaccattaatttgtaaaaatgtagtatctgtgaagtacaataaagggaagcacgacaaaatgaggtatgcctgtatgccctatttttagcttacgtagacagtgaagatggtagttcttaagttttaagttactgtgctaattacatttttgtcactgtttggatctattttcctaaaggattacacaaatattttaaagcttttatgcgtgcatttaaatgtgtgtgtcctcaccaacagcttcatgcagacagtgaaaccccaagtggaagaagaagagaggtgcctgggtgcggtgtcttatgcctgtaatcctagcactttgggaggccgaggcgggtggatcacttgaggtcaggagtttgagaccagcctggccaacctggtgaaaccccgtctctactaaaaatagaagaattagccagtcatggtggtgcgtgcttgtaatcacagctacctgggaggctgaggcaggagaattgcttgaacccagatggtggaaattgcagtgagccgagatcacaccaccgcactccagcagcctgggtgacagagcgagactccgtctcaaaaaaaaaaaaaaaaaaaagagggttcccaggctttgtaccacctttcttgtgtttctctgcagtgggacaaaagttgcggttagtgggtagcctgaacttagagctgaagaggtgttgtttcttctattcctatgaaaaaaatagatgagcttctgttcttgaaagagccgtttaagaaaacatctttccaaaattgataatgaaatcttgcatcacccaataaatctgaaatttttggtcttttgattcagagaatttggaggcattcccattttgtgaagtcattctttcaaaaagtagacttcatttaaggatatgcatgttatagtaaccttccttggaacttttttttttttttttttttttgacacggagtctcactctgtcgccagactggagtgcaatggcacaatcttggctcatggtaccttttatgtatgctaaatgatgcttagagtatgaatgaaacaacagtaacaatgtaaatattaaactcagtgttgaacatggaagacatacttgcatatgaattggttaaaattgtgtggttaaccttatcattaaaagagtatttattctgataggtagaaatttaaaacataggttacagtgaaattgaagactgcccagatgaatgtgtaagactccccatgttttctactttggtaattgatgaaaatgttattcttgtaggccaaaacatttaatatatacttactctattatgcctgcctttttcactgtgactaataaaaaacaccagaaggatttataagacagtggatcaatttaaaaagaattcccagataactaatatgtgaaataaagcaaaatttagcaaaagggtgatgtgacatatttctgaaattcttttgagaagtaagcatttgttggtaatgaggatgtgattaatcctagaagatagaaagatagtggctgtagtgggttggatggcatgccgcctccacccccacccccccaacagacaccaagagatgtcagcctggaaggaaaagcatcttgcacgtgtaattaaggatctcaagatgagatcatcctgaattatctgagagaggcttaaatccaaagacaaggggtccttataagaaagaggaaggcacagaagaagagaaggtgatgcgaagacagaaacagagtgcagtaatacatctacatgccaaggaatgccaagggttgtcggcagccacgggaagccatgggtgagaggcatggaacagattttctcacagagcctctcgaaggaaccacactacaaacaccttgattttggatttctggcctccaaaactgagagagaataaatttcagttgttcagaggtaccaggtttatggcaatttgttatagcaatgaatacagcgactttttggtgatgtttacatgatttttggggacagatgggggttagtaggtggcagaaatttggggagggagcaagatgaacttggtaatttggatatttactgtgacttgattatgaaaagttttgtgttacaactaccagaagatagagagcagtgtttggtttgattagatgagaaaagatagattatgctataacaacctcttctgtcttgtcttgtgaactcactgtgccataccatatgaggtctagaaactagaattttttcccaatatacttaagttctttagagtcctctgcaatagtggctgcattaattagaacctactttttgtaggtttgattgaatttggactacatattctgacaaatagaattatttttctagtttctattaaataaatttgtcataaaagtcagaatgctttgacatattcccatgtacttacaaaggatggttgtctttttcttttctttcttttttttgtttggagacagggtcttgcttggtcacccaggctaaaggacagcgatgtaatgatagctcactgcagcctcaaactcttgggttcgagatcttcccacctcggcctctggagtagctgggactataggcacacagcactgcactcggctaattttcttctctttttgtagaggcagggtctcactatgttgcccaagctggtcttgaacttctggcctcaagcaatcctcctgccttggcttcccaaagtgctgggattacaggcatgagccactgcctctgacctcttttgtcctaagtgagtttgaggaatgtattttagttcctcttttaataccatgaagctttcaagttcatagctcataaaatgttatgtagctttgaattttttaatgtaaatgaaaatcagattcattttcgttattaataaaaatttcaatagtattcacatttagataagagatgcacagaatttttggtctacttttaaattaatattacagttcttaaagtaccctaggtgatgcctgttcttttgaaacagcagagattttattttaaaaatacgtttttgtgtttattacctaaaggagctattctgaaatttttatgtagaaaaatcttcttctgctccatccacagaagattttttatccatagatatttttgccatctcctttctcctctttcctttgttgtagatgatatgaaaagactgcttttttcaaaaattgtgtttttaaattggtgaattttgccatgcctaaagtgatctctgagatatcctccttttgggtataaacatttctgttaaatgttgtaaagagctttctataatagacacagtagactgtatttaatttttttctcccttcttggtagatctcttttggttaaaagaaaatgcgtcacttgcctcctattatagaagcttgtatgagcagccaggggtgcactctgcagggaaggcttggccattgccagtgagccttgctccactgtagctgccttagctcttcctcttttccagatgagcaggtgctgacagccaaaaaaatagaaaataagtggggagaattcaaatatggggaaaatattgtggaaaaaatagatgcttaatttttcttcttaatattatgtagaaagtaaatatctttgggtaaaatacatgaattgtagccactctagaaaacagatgtttaaaatctggcaaataatcttctgctaagttattacaggtccatgatttcatactggccagcatttgtaagttaatccaaatgaaattgtatctccttatttgaatttactgtacatttgataaagacaagagaattaatgtgatgctattgattgtcatatcatcacttctggccttttctgatagcagttcacagcaaaacaatttgtcaaaaaatagtgttttgttttgttttgttttctttacctgagctttgacctgcgtagcaatatgttgatttttaaggtatgttttgtaaattaaaaaaatgctattataaaataatgactttgaagagatggtaatatttctattgaacatattaatggaccactgctatcatgtagtttttaatttagaaggctcaattttagtttttattagaaagaatattgtttagtatcaaatgactattaaaagtatatagtgcaataaaaagaaagacgtgaaggaatgtggaaacattaaaacaaaatcgaacctccttaagtagtagttatatcagatgtaattaaaagatgggatgtaatttgactatcaaatacttgaaccaatgcttttatttgtaatatatatatgtgtatatatgtttttgattaccaatattaaacacaaagtgaaacactattgatttgaagcactggcccatttaaaaataatttaaatggttaccccagaaccttgtcgtaattttattggggatttttgtacaatatatagccctagtttcgtctccaacgttctcacctttaagaaagcatttacatttcctatcctctcccaactgggagaatatgcaaatattataaaataaaattctcttttagaaatagttcctaaaacagtactttcctttaatacatttgcaaggatgaaatacaagttcagaggattaagatccttttatttgacagtatctctttaaatttacagagaaaatagtggcagattttctaattcccgctctttgttcttacctcttctactggaggttttggggtctgtgtcaggaaaccttattattactaaggtaatttgttaaggctttttgcttgggtgtacaccactgggattgagatgctttgtatttccactgctctgtgaattccttttttattccccccagcttctggggggaggcatattcaaactaggaagtttgaatagcagtaaaacacacatttttataccctttacaaagatctattccttccattttctttctccttccattccccaaatccttctttctcatagaaacatttcaaaatatagatgagtctttcaatatttcagcatacgttttctaagaatcaagaatggtctcttacataatcaacactattatcacacccaagaatattaacaggaatttagtaatattatttaatatatgattcataattggatttctccagttgtctgtagccgtctttttgtattttgtttttccagttcaggattaatttttcatttggttaaatctgtagttttttcaaatttgaaagagtacctcattcatgttttttgttttctataacactaatttaacttttcatgttgcagtaatttcagatttacagaatagttacaaagatagtataaatcactcttatgtacgctttacccagcttcctcaaatattaacatgttatagaactgtaccacagttaacaaaagtagacagttaatactggtatgttattactaactaatctgtagaccttactcaaatgctgtcacttttctcacaagtgtcctttttctggttcaagacagttgaggcctccacgttgcatttagttggtgtgtctcctttgtctcttgtatttaatcagtgtataaatttgtatttaatcatcttgacaatttagaagagtgccagtctgtaattatgtggaatgtcttttatttttgagtttgcctaatgtttcctcatgaataaattaagattattcatttttggcaagaatttgtgttcttctcagggcatcctattggggttgcatgatgtccctgtgtctcatgtttggtgatggtaacttttcttttaacctgaaacatgatacttacccattttttttaaaggattaagtattttatttttctaattgacaagtaaaaattctatgtagagtgtttttatatatatctacacacacacattgtgaagtgattaaattaagctaattagcatgtattgcctcatatactcattagtgtgtgtgtatatatggggtgagaacatataagatctactcttagcaattttcaggtatataatatgttatcattacctgtggtcaccatgacatacagtagatcttttgaacttattcctcatgtctaaagtttgtgtactttggctaacatctcctcagtgtccccatacaaacacgataggtagttaggtaggtaggtagataggtagatagatagattttttttttttttttttagagaattcaggcgattgtctgagtcttgctcattctagatttaacttaatatttcctcatggttaggtttagggtaagacattttgccaacaacattaaaatgtcaatgctgcatgtttcattttgtgtttattatgtgattcctaatgttaggtcatcccactttgggtgataatatctttgatcatttggttggggtagtgacaaatgtgggcatatttttaggattatcttagaaacttttcaggaaaagaagctatagtaattaccattggctgactatttccaaatttaaaaagaaaggaagaaggaaaattagagcacagaggtttcatggaaccagaaaaagagaccaactccagttttgtctttttttcccctccctgggtgagggatctgggggcattactgtacatcattgttggctgtgttcagcagtagggcagtcttttggcatgttttcctggaactcgattttaaatcctgtgagtgtgtgtagtcctgaacacagtagtcattttgaaaggctttgtttataacctttgttgagatccttttagaagttccgtcagaatctgagcttattcttttaaatatcctcagcagtgactcatttttatcctgtgagggtaaatttgattttcataaatatcaaaagatcattctgtgccaaatatgattaataaggtcatactattccaggaagaaaaaaaagcataacaaaacgattttttttaaaaaagaggcttacataatgttgacattttaccgatgtgaagaaagaacagagtagttgggtttagtgtagcacttccccaggtgacttccttaaagctggcactgattcagccttctgaagtccagtgtatttattaacatattaacattattaacataccttgcgtatacacgagcacacactatgaagtctcatctttttatacattaaagtgtaattcagtgactagttctttttgtgtaattagggtggtttgggagttatttgctgactttgtactgtgtacagaccattttgttagtagctgtggaataaacaggtttatgtaggacttagtaatgctcccttggaattgatcacctaaaatctgttaggagagatgaaacgtgagcaaacatcataactgccctttataatactgttgttgtagtcaaacagggataaggcaatataaagctgggagtcaatgagttcagaaaaacagtgtggcttctgtcagccatcaccaagattttttttttttaatactttaagttctagggtacatgtgcacaatgtgcagatttgttacatatgtatacatgtgccatgttggtgtgctgcacccattaacttgtcatttacattaggtgtgtctcctaatgctatccctccccccttcccccaccccatgacaggccccagtgtgtgatgttccccttcctatgtccaagtgttctcattgttcagttcccacctatgagtgagaacatgtggtgtttggttttttgtccttgcaatagtttgctgagaatgatgatttccagcttcatccatgtccctacaaaggacatgaactcatcatttcttatggctgcatagtattccatggtgtgtatatgccacattttcttaatccagtctatcattgatggacatttgggttggttccaagtctttgctattgtgaatagtgccgcaataaacatacgtgtgcatgtgtcttcatagcagcatgatttataatcctttgggtgtatacccagtaacgggatggctgggtcaaatggtgtttctagttctagatccctgaggaattgccacactgtcttccacagtggttgaactagtttagagtcccaccaacagtgtaaaagtgttcctatttctccacatcctctccagcacctgttgtttcccgactttttaataatcaccatgttaactggtgtgagatggtatctcattgtggttttgatttgcatttctctgatagccagtgatacagcattttttcatgtgtctgttggctgcatgaatgtcttttgagaagtgtctgttcatatccttcgcctactttgtgatgaggttgtttgttttttttctcgtaagtttatttgagttcattgtagattctggatattagccctttgtcagatgagtagattgcaaaaattttctcccattctgtaggttgcctgttcacgctgatggcagtttcttttgctgtgcagaagctctttagtttaattagatcccatttgtctattttggcttttgtcgccattgcttttggtgttttagacatgacatcctttcccatgcctgtatcctgaatggtattgcctaggttttcttctagggtttttatggttttgggtctaacatttaagtctttaatccgtcttgaattaatttttgtataagttataaggaagggatccagtttcagccttctacatatggctagccagttttcccagcaccatttattaaatagggaattctttccctatttcttgtttttgtcaggtttgtcaaagatcagatggttgtagatgtgtggtattatttctgagggctctgttcgattccattggtctgtatctctgttttggtaccagtaccatgctgttttggttactgtggcctcatagtatagtttgaagtcaggtagcatgatgcctccagctttgttcttttggcttaggattgtcttggcaatgcgggccctttttttttttccatatgaactttaaagtagttttttctaattctgtggagaaagtcattggtagcttgatggggatggcattgaatctataaattaccttgggcagtatggccattttcacaatattgattcttcctatctatgagcatggaatgttcttccatttgtttgtgtcctcttttattcattgagcagtggtttgtagttctccttgaagaggtcgttcacatcccttgtaagttggattcctaggtattttattctctttgaaggaattgtgaatgggagttcactcatgatttggctctctgtttgtctgttattggtgtataggaatgcttgtgatttttgcacattgattttgtatcctgagactttgctgaagttgcttatcagcttaaggagattttgggctgagacaatggggttttctaaatatgcaatcatatcatctgcaaacagggacaatttgacttcctcttttcctaattgaataccgtttatttctttctcctgcctgattgccctggccagaacttccaacactatgttgaataggagtggtgagagagggcatccctgtcttgtgccagttttcaaagggaatgcttccagtttttgcctattcagtatgatattggctgtgggtttgtcataaatagctcttattattttgagatacgtcccatcaatacctaatttattgagagtttttagcatgaaggttgttgaatttagtcaaaggccttttctgcatctattgagataatcatgtggtttttgtctttggttctgtttatatgctggattacgtttattgatttgcatatgttgaaccagccttgcatcccagggatgaagcccacttgatcatggtggataagctttttgatgtgctgctggattcgttttgccagtattttattgaggatttttgcaccgatgttcatcagggatattggtgtaaaattctctttctttgtggtgtctctgccaggctttggtatcaggatgatgctggcctcataaaatgagttagggaagattccctctttttctgttgattggaatagtttcagaaggaatggtacccgctcctccttgtacctttggtagaatttggctgtgaatccgtctggtcctggactttttttggttggtaggctattaattattgcctcaatttcagagcctgttattggtctattcagggattcagcttcttcctggtttcgtcttgggagggtgtatgtgtccaggaatttatcccatttcttctagattttctagtttatttgcatagaggtgtttatagtattctctgatggtagtttgtatttccgtgggatcggagccatcaccaagatttaatagatgacatgtcctgcaaggtgggtccctggctacttctctgacctcagctcctaccactgctcctcctgctcacatactgttttccaggcatgtttactcacttgccttagcagacatttgttgagtcatgtgctgatgtggacactggggatacagccgtgaacaagcagaggaagatcctgccaccaagcagttaccttctagcacaggaacagtagacctagcacatgataaattgtgtattatggcagaagtggaaggtgctatagaaaaaaaaaataggggaaggggtccaaggagagtgtgggtttgtagtttaaaaccaagaggtcagagcaaaccccatttaaaaggtaacattgaaataaagacttaagggagttgaggaaattaatcatacagatctgaggaaaagcatgtcagtcaaaagtatcaactagtaaagaggccttagatgggagtgtgcttggaacattcaccacatcaccacaaccagagcagagaggaggaggaggagagcaataggagatactgtcagagaagcaataggggagtcagatctagaggtcttatagccactgtcaggacttttaacttttaccctgagtgagaagggggctcaccgtaggtttttcagcagaggtgtgacgtgctgtgacatgctcttagatatttgaaggttcattgtcatcactgtgttaggagcagacaatagtagggccaggttagaaggaagaagcctattcctgccacgagcctgttgctgtagttgaagtggaatgtgataggggcctctactgggatgggaatggtgaaagtagtggggtatggtttagattctcggtatcttttgaagatggagccaaaagaatctcttgatagactagatgggtaacataaaagaaaccgatgtaaagaatgactccaaggattctggctgcagtaactgaaaagagaggttgccttgtactgagatgtggaaagctattcaaaaagcaagttgggaagtgacaatcaagaatattgttttggacgtgttggcttcaaaatggtcattaaatatcaagtacacttttaagtagactgttacacagatgtggagttttcgagagcagcctgggtggaaaataaaaaaccgtgggattcatttttttcctgccttccagaggcctgttctaaaggcatcctgaaacacagaaatggacattggtacagacagagagaactccaggagagtaactccaacaaataaaaatcttaggattaaaaaataaaattgccaaaataaaaaacaaactggatggactgaattgcagaatgaagatgaacaaaagagagagtgagtgaatctgaagatagagcaatagaaattattattcagtctgaacaacagagaaaaaatcattgtgtaaaataaatgaactgaaccgtaggaacctgtgggataatactgaaaggttaaacatttgtgtctcaagtgttccagaaggagaggagaaagtgtatttcaggggggaaaaaatcaaagaaataatggttgaaaactttcctaatttggtgaaagatataaggatttaagaagctgagtaaacctaaacaagcccagagaaatccgcgatcagacacatcataaataaactccctaaaattcaagacttttaaaaaaatcctgaaagaggaaaatgcacaggcaattcaatggagaaagtgtgttgtaggaaaaattggacttccatgtgcagaaaataataaaaaagaaccttgatgtaaacctcataatttgtgccaaaattagctcaaaatagatcataaatgtaaaactaagtttttgaagctcatctcttgttctctcgagtgtaagaccaaggggcctagcccactggtaagtcctcagtgtgtatatttgaatgcgtaaattactgctcctggagaaaagagaatgagattaacttcaaaggatagttatacagaaaagattggagaattaataatatgagtatgttatttactttaactgcccttttttcattaaaattagctttatttatgtgttcaaattatgtaagtaatggaatctaattaattggtgattttggttatgagtattttaatttcctccttataacctcaaatttatgtcagtgtttattgctctcatttttaaaaattgctagtaacttgctctcttagaaaaaacaggttattcattttatgagtggcaggttactttcttattatccagcagtaatcaaggtggtcttatttacattttaatattctatagtgtttatttttgtatcaagttaaataaatggtctcaagaatcactttaagcagtctagaaagcagatgttgaaagacctacctttttctcagagtcattaaatagaatatgtagaaagttaatcaaggaagttaaattagttctgcctataaattaagaagagcggcagttcatttcccttatcttttaaaaataaaactgaattcactttttacaaaccttccagtttggtgactgcttttttgaacctctagtgcctgtaatgtgaaaaacagggtgtgaattgtttggacttaccatcagagagatatttcagtgtgtacctgtcagcatgccatccgacagacgtaaatgtcaagtctaatgataacaagaactctgatttggaataatagagttaagcttacattcctttaagaaaactgaacacactagctcagcagtaacatttatggttaaacatctgatgactagccatgtctacctgtggagtcgaataagtagctcatggcatgtgctttggagtgaggtccctcttggcttgtgatagagtttagatatttgtttccaccaaatgtcatgttaattgtgacccgcagtgttggaggaggggcctggtgggaagtgactggatcgttggggcagatttcccatgaacagctttgcaccgtccccttggtgatgagcgagttcacaggtgatctggttgtttaaaactgtgtggcacttccccctccttgctctcttgctcctgctctcaccatatgagatgtctgctccccctttgccttctgccatgattgtaagcttcttgaggccctcaccagaagcagatgctgatacagcacttcctgtacagcctgcagaactgggaggcaattaaacctcttttctttataaattactctcaggtatctctttatagcaacacaaatagcctaatactgttggaaatcccatctctatcactgaactgtatttctttagacaagttatttctctgtattatttatctcagtttcttttgtacaataaagataataataatgcctatatcataggttgttgtgagaattgactaggataatacatgtaaagtgcctatgtcattacctggcacgttgtaaggactaacactttatttttgttgttacttaatggttgtttgcgataatttttcttcatttttaatatctttaacagctttattaagttataattgatgtacaataaactacacatattttagcatataatttgataagttttggcatatatacacccatgaaatcataaccaagataatgaagaagagaaaaaactcttaaaagttttttcatgccaccactgaactgctttctgtcactgaagattagcttttgtttccagaatttgacataaatgttattatcccttacggaatcttttctttgcctgggttcttttcctgagcataattattttgatattcatccaagttaggttgggcagtctaagggctcatgtcgcttgtttcaacagttactgtcctttgttgccttatccagtgtcttgaaaactgttttttgagtttttcaggtaggaaggtaaatccagtctttgctaccctatcttggctggaagaggaagggctatgattcattaaattaataaatgcactattcttcagttgcattatttttgtgaaatgaccaaccacttaatcagaaaagttatcttactgtatatccagactttctatttttccattcgttgaaatcgcgccaaactacttccaagatttgttacccacaaaggtgaaatcagacttaacagtgacgatcttaaaaggcatttggtatgagtagtttaaaggaccacttttcctttgaaatagacttactggtttttatagttacttgtcactcagagtgagcaccatctgtcaagattgtggaagagatggaaaaaaaatcctcagtgttcaggtttcttttctttactacgtatgtaaaattgacttttataaaataatctttttgctacgcgtaagattacactgtgaaactagaatgtttttatatttgtgtgtcttgctttccccgttattttttcattttaaagtaggactttgtgactatattgctggatcctgtggtcgctaggcatggcacccttgtgtggcagtgctattgtgtgatcttacttcatgcagcatgttgccagccctccgttgttttcttttcctacaatttcttccccttggtcttctaccttctgctgtttctttcctgacacctcatcattaaaactcacctgctgcctctacgatgcctcctccagtggggaaaccttgagcaccctaccctcagagcctgtgtccccttggtggggaatcttgcataccaaactgttttaatctcagttaataagaaaggaatagcattacttccaaatttaactcccagagcattcaaagacaaaagtaatattgctaccttttttaaaaaaaggaaaatatataaacactaataatgtctgattaggaaatcagaatcatagttggaaataattttgaggaatttcaaaatttcatcttttagtaattgaggatttcttaaaagtagttgtctcatgtcacttgattttgattcaaacaatagggaaaacagccccaataagtaattattgttaatgatttgatgcctgccatttagaaatttttaaatgcatacactgatatattcatacatacatacatacatagattttttccctaaaattattatattatacattctcttctgcagcttgctattttgatttaatgttaggttttagatacctttccttttcacttacaactcttacaaaaaacttctgttttaccataaaaccttctcctggcttttagtttgagatatacttccttaatcatgttaaggaactctcttgaaatgttgataatactacattttttgatactggaattatttagatagattttccattgttgacagagtctagcttttctggaatgaactgtacatggtagtggtatattattctttcatgctaaattgtaattctggattctgtatatgcttaaattggaatggtattttatgcatccatttttatagatgagattattagcccttaacattttaaaaggtatgtggaaatcttagtattaatttttagagatagggtcttaccctgtaacctggaactcctgggctcaactgatcttcccatctcggcattccaagtagctgggattacaggtatgccctaccacacctggctggttttttaaaaaaatttttgtggagatgagtgtcttgctatattgcccaggctggtcttgagctcctgggctcaaacgattttcccacctcagcttcccaaagtgctggcattacaggtgttgtataatacatttcttttaagaggtgattttatcccattttcacattctttacttggggaagaaaaccacatggcaaacatattttataaacccattgtcttccagacttgtttcttgtcctctatgttctataagctattgttcttgagtcttgccagtgtataaggtgacaggttttgtttccatggtgctatgttgtaagttcagtgtttatgtttttctgtgcatatcacataaagatccttttttaaaaaaagtttagtgtttcattacttgcatttttctttagatgtggcgctgcaaagtgagtcagtaacctttgttgagtttcgaaaaaataatgacctgttacagtgttttgttctcgtttgttattgtttggaaaaagagtccaaaataattttattaaagtcacattactctgtagatagacataggccatatttttgagaattcacattaataacaattttgtatatgcaatactcttttttttttttttttgggagacagggtcttactctgtcatctgcagtctcagctcactgcaacctctgcctctggggttcagtggattcttgtgcttcgctttctcaagtagctgggattacaggcgtccgccaccacacccggctaatgtttttgcaattttagtagagatagggtttcaccatgttggccaggctggtttcaaactcctggtctcaagtgatccgcctgccttggccttccaaaatgctgagattataggcatgagccaccgcgctcgacctgttcctaatttttttttcaaattttgaaatgcagataatattatgtaccccattagcttatggggtacgtaaaggaaatttgtatttgatattggctctggttattacttttgtccttccatggacaatcacttaaaacctttaatgcatgaagctgtattttagaaagctattttggtactagtctcaaaggatagattgctctatctttcccaccctaatgaaactaggtcactggcatttggcacatctccatgatgtgagatttgatgttcagatgtgctgtctagaaatgataatgcattgtcagcaagaccacttttcatttcatcaacataatttccactgccctggaatcaatttattccttgacctgttaataattacacttgatcactagcatttcagtggcagagaaagcctctggaaatggccatagtcatccttttgggtgataagttatgggatttctgttcggcttggagatttggcctgttgaagtggttgacattttatgaaaacaaaggagcaaacttttacctgatgccgtgttaagattcactctgtcaagtggttgagaacacttatttaattatctaactgtacttttgcattacctttttttatggccaactttaaacatgcctagggaagttcccgttctattcccagccagaagcaagtgtttgaaaaatgagaaatcaccatagagctcctctaagattaatttttcacaggtccaagaatgcctaatatttaaaatgagctactttgaaatcagtcatgtatcacatcagtgtttcaaaaagagattgagaaaatatgggctgttacaaaaccactaacctcacctgttgctccgtggtgatttggagccctggagcagggctgcctggatctgaaactttgctctgtggccttttgggaaagtgacttgcctctctgtgtttctgtcctaatccttaagtgcaagagtggtcatgcatattttatagtggcattgggaggatgacaggaatgaatacatgtagaaggctttgaaagggttctggtagatcaccacccagtgtgtgttgtactagtcatcattgttactgtaacttaatgtgttttagtgttaatggatgtccttttttctcttttgctatcccagccccttccttgcctaattgttactctcttctgtgtggttaggagcaactagttcagtttaatttcccttagagagcaagtttcagatatagcatcattttgaactactaaggaagtttaattctcctaggattggtcatatagccttctttagcaaaattgaacaggaaccttaggtgaagcttggttagccaggtttatggatctggggccttttctatgctttaattttatatatttgactgtttagtagatgtttatcttccttatctgaagttcactttcatcttgttgttgttaacctacataaagatttatttaatgtggattaagtcctctgttatttagaaatataaattgagttgccaatctgatatttactttctcaatttttatacacttgactttgcagttatacattttttgctaattattcataaggcttacaactactactagtaattcaacagaaaataagtactgtattgtaaaatcctaaaggatttgagtttttaattcaagtatattaagaacacatccttaggtattgaaataagaaccttataacatcctgtcatcttccagtttgcagtttcacctctttgctagtgctgatgaggtcattgatgtgtcatcataacactctgagtgccagtagggaaggaactgtttcatttgattgactactgtattaacagtatctagcccattgctcattacatgataggtgcttagtaaatatttgttaaatgaaataaaatgattttctctatattttgtattttctaggatttttaggaggcatacccagaaaataggcttatatattttttttggatttgtttctgctaataatcagtatgctttgcacgtttgtattctgtttccatttcttttgttgctgtagtttgcttttcaataggcacagtttcagtacctgtttccctgccctacataacaccttgagagagaccttctcttgtgtgcccgttatttttaatccttagactcaaaagaacagattgtctttcttaaattcaaatatacctggtcagcccttttccacctctgagaagagagaaaagaaagtatattaagattctggaattatttgtgttttatggctgtgcagaattaaagtggcaaaaattgttcgtcaaagagctcagatccttttaagatgcaaaccactgaatttgtttgtcagtgattgctctggaactggaggtatccccctgccaatgcctggtttgggggccactgtgtaattattttttactgatttgcctcatgaatgtacacatatgcatgttatttttgatgccttaaaaacatctgttataaagacagagggttttaaatacttcaatttggtacctttattttgagcgaccttaaataaatgtaacattttcaatgccagttgatattgcagaaatctaaattgctgttcaaatatgtgaaatttatcatagtttttcaactattttcacttacagtgctaattaatagccactgaaccttaacactttcatactagtcagttatagtggaatcctgtcatcaccaatagctcctatagcagctattaggagataactgtgttacaaggaatacctggaagagttttctctttgatgtttatactaagtactcaagtgaagggtgttgtacaccatgactatagtgaacctttttgtgtgcatgtgtgtgtttttaaccttgccggcatcttaatccccctttccaaatctctgggtccctgctgagtttcagcagctttgtctctgcccagggcagcagggtccttatcagaagtgggcctctcgggtgtggcttggggcttcagtcctgcttcatggtgtcttactggtttttgccctttttgaacataattcttcagcattcctggtagtttcgggggccacccaaaaacctttcagcaaattcttcttcagctaaagttggtatccattgctagctgccaagaaacttgactgatacagctgtgtattgttctgttctcctaaatcccagtcagtgatgtatattgatgctaaagtacaaatgttatgtagtcagtattttgctctcctatttctttagagtatgttctatgcctactaggtcttacttgattttacagtgaagttttttttggtttgtaagtttgtgaaatatattcagctataattattttattgagtactgcttatgcaccagatacttgttagtaatggctggaaatacagtagtaaacagagacaaacccccagccttcatagagcttacattcgaggaggcagacggatacataaaatatatactatgttagaccatagtaaatgtggtgatggaaaaattaagcagaagatgggagaaagaatgtgaatgagaaggttattagaatgggtatcgggtgttttcagatgaatcctgatggtcttaagacagaggtgggagggtgctgggcactgctcccatttctgctgggccgaatggaggcccagggaggagcaaggcagacgcacagtgctctcggcttcaggatttcccttgactcctaagatgtgctgattggcccaggacactgacgggatgtgtagaaagcaacattttaaaagagtagcaagctgggggagcatgagagcaccttaagtgtacttcagcaggcacaggtgtagtgggattaaataggcaattattgtgggatgaagtttaaaagtacatttggatacaagaattgacattttaaatactttactataaaaattgaagcacatggcctattaaatctggaccatatgttcgttatcctaatgtctattttagttgtgacaccacataaagaatgtgtaggagcaccagcttttagaataacacaatttccagggggagctgctgttgtgtttccttatttaacatacaaaagcatttgatgcctgatactcacatgcttgtgcaatatatatagaaaagtcttggaattatagaaaattagaagcatatttaggccgggtacggtagctcatgcctgtaatcccagcactttgggaggccgaggcgggtggatcacctgaggtcaagagttccagaccagtctggccaacatgttgaaactccgtctatactaaaaatacaaagaattagccgggcgtggtggcgggcgcctgtaataccagctgctcaggaggctgaggcaggagaatcgcttgaacctgggaggcggaggctgcagtgagctgagattgcgccattgcactccagcctgggcaacaaaagcgaaacttctcaaaaacaacaacaacaaagcatattgaagattttgtattgcattatagaaggactaatataatatcttattatgcagaaaggctacatatatttgaagtaattgtcataggacaagccctactaaacgtagtcttctttcctcacttacattttttactaaatgccttagactgaatatttatttttgtcactgtgaatattaaagaaaactaagcagaagcagtcttaatatcttgttgattacatttcagaaaaaaaagaaatggcagaacattaagcctgaatgccatttgctataattactctgtgtgaaatataactggtagctgtcaagctttgattgaaatttacggaaggttgacaccagctgcatgtattaattgtctctgcaagcaaatgcacataccaccattaccatttggaagcatgctcttttctattgaatttgttgtaaagcattttttgattgtgttttgatgaatgctgctctaagttcagatttatcttttgcttcgtttctagcaaacaaacaaatgtccttttagctaactcctgagtacatctatatgagggatatttccaaatttgtaacactgaccatttggagaagggaaacttaaaaattattattttaaagaagtgttttgaaacatgtttctaataaaaatttatatatcttccctatttggactattaatatttgactcattctacatgaaattcaattcatgcattagtatttttataaggtagtttgatcatattaggacagttattttttcatcctttttaattgggcagtagcaacctccaactgaaatttttctatgcatactattcataaaatatatttttaaaagcattgaaacaaacttattctttatatcaaagtgataaatacaggtgtgcaaacttatttggattgtgtacaagtgtattttggtgggtgcattgctaccttgtttggtttgataggtaccacatatggcaccgggtaggtcaaatactgattctttattcattttgatcacagtcagaattgaacaaagattctaggtgcagcacaagcagaaggtgtttattccctttttgctctacaaggggtgtctactttgagtcttacagaagccaaaacagtgtgaatataacctaaattcatctgaagacttatactgagaagtatattggtatcattggcttattgagaatctacagtagacgtttgttgctttttagctgtccaggatctattctccttcctgagaacaccccagtttctatgaggaaagcacagggctgttcccactagggaagcgaaccagggccccctccacctcctttctctttgggtgtggaactttgagtttctgcagcctggggctcttccacagggctttacagtgggaggtggagcccagcagccctggaagtctccatggagatgtgctgaccctttccctgcatgttgccagttggtctctctggtctctgtatgttatcttttggagcctccctttgatggtctctgagagtcttccaaaaatcccctttccttatgctaaccagagtcaattttagttgcttacaaccttcacaggaactttaattggcttaagaagcatatccttttaaaatctaaaatggaattttaattttagtaaaagtgttcttctggctcacttgatagagtttgatgccagtttaaactccattgctgggagacagttcttacactagctctgtagacccagccaggtaaacactttgtttctctttgtagttaggttttgaagataaggtttgtacagatctgggtatcatgtcataaagggatttggcaatgtttttttgttttgtggaatagtatttaaaattttaggaacgtttcccagagcacgagtgtttaaagccatcattggtgactggatgctgtgtgtcataaaggggtagctgaactcaaacatttcttcaactgcattttgtatcatgtagttttattaaaatgaacaaaatatatccctcttttccttctcgtaattttaaagtgacacggttagaagtataacatgactaaacttgaaacattacatttggaaattcattaatacagaataaaatgtacttttctcattaaaggcacttggtttctattgaaattagaatattactagcagaatcatatattgaaaataatttaaatgtttatctttcaatctaagtatgaactaatgaaatggaaaatttaaacgtttatatttagatctgtcactacatagtttttgtattagactactgtctgtctctatcatattttcactgtaggccttccagacacgtaagtgtttctgtgaattaatctatgttttatgagggagttcatgaagactggtttcttagatgcttagaaaatattaattatctggcttggcgtggtggctcacgcctataatgccagcactttgggaggctgaggcaggcggatcacgaggtcaggagttcgagaccagcctggccaatatggtgaaaccccatctctactaaaaatacaaaaattagctgggcatggtggcgcacgcctgtagtccgagctcctcaggaggctgaggcagaagaatcgtttgaacccaggaggtgaaggttgcagttagccaagatcgcaccactgtgctccagcctgggtgacagagcgagactccatctcaaaaaaaaaaagaaagtgttaattatctgaatcataccacctcagtaggataaaccttgatataatagtagtcatgccagcatcttgttttatattcttgtctattaaatacatgcttagatattgtattatgcatatccttgaatatatttagaagcatcacaattgaatatgtatggatttacctcaaagaagactgggaaatagttacaactggcatattgtcataaaaactagaagtattatgggttttaaaaaataggtctatgggccgggcgtggtggctcacgcctgtaatcttagcactttcggaggctgagggaggtagattgcctgagctcaggagtttgagaccagcctgggcaacacggtgaaaccccatctgtactaaaatacaaaaattagctggatgtggcagcgtgcgcctgtagtcccagctactcaggaggctgaggcaggagaatcgcttgaacctggaaggccgaggttgcagtgagccgagatggcgccactgcacttcagcctgggcagcagagtgagactccgtctcttaaaaaaaaaaaaatgtctaggaagtgttatgtttttctcagtgtgtgtgtggtccttgcactttcatatggctgcaaacactttaaattttgtgccctcccaacatagatatgagttatgttggaatgagtttattttaaaccagagtatgttctcattatagaaatgttacataggatgagaagacctatggaatactgctgaagcctaatttaacccaaagtttaggtggagcactttgtgctttcatgtataaaagaaaactgtttctgcgtgaataaagttttaatggtaaaaagctactgaatttggaatgatgatgtttattacgattgttggtccttgagtggaggttgactctgtggggttttagtctggtcttcattttttctgcttgagaacatcctcctggtcatctggagttaatgtatgaagaccagagcagcccgtagctgaaactggaagttaggaggatagatctgtgagtccagaattaggggctctgggcaaaagtgcaatatctgtgggtggaggggctggaaccagcaaatccgcgttgtcatcttccaacaactcatatggaaaaggtggtagtagtgttaggtgaaggaatgcatttacagagtagagaaaaggggctaggaaaggggaaatgagctccctacatcacctttctgccctgcctgcctggagtactcagtacctgagagaagaagcaaccaaatgtttctgaatcatagaccgaggctcccttaaaccactaacagcaaggatgcagcatttcagtggaatgcttttacctcttcagttgcaaccactaccaagggagaatgctgtgtactccctgtggtagcttcatacttgctttccacttgcggaagactctgaggggcaagcagatgcggcccaaaggaataaaagtgcaggcaactgaagacatacattggaaaaccttgagttaacctactcggctgttagagccattaaacaagagcaagacaccgtaagaagggagcaggtgaatggtgaaaatgaaaaacatgggcctcatcctacattgtaaaggtttagagttaaggagacagggtttaaaccattaactaattgtgtgacaggctgctaattatggcaaggtacttgggtctctgatcttttctttctctgtaaaatgaaggtgatgatagtatctgtattgcaaagtttttttttaaagacattatatttgttaccttttaaagactgctttgtaaactggaaagtgccatacacatgttagttatcccatggctttttacattagtagctggggcacctttctagggcatgcattgctagttctaagtttcaatgatgcatctgtaggctaagctgacacttccctttctgccatctggactgataatcaagagacctggattatagtactggagatctggttttgctcctgagtagctttgtgcttctcagacttctcaccaaaatataacatacacacacggagtgcactagcagtctgtcacatgggcatactttgtctaaaatgtcagtttaataattttttataaagtttgctatctaacccttaaaatatatgtttatgttcaactatacatacctctaagttacctgtgattaagattgcctgagcctgttcctttatgtgccccagtcataggggcatacacacccaactcttgaatttttattacttgttaaagaagagtactggactctgtgaggcctggtgtacctttctggaccattattctgtgaacctgtgtagcagatattgcaaagaactcttgacctggttacaaaatcaaattatatgacactcatttttatcaactggtttctagatattgtgtaatccttacccatatgagccagttatagagggctttgctcagggtttattattgtagaggccacaaattaaccaatgttattggcttacagatatttttgaaggttggccatcaagtacatgacctttcattgtggtctttaccctacttttgtgtgtgattgtaactttcctttattttttatttttatttatttatttatttatttatttattttgagatggagtctcacactgttacccaggctggagtgcagtggcgtgatcttggctcactgcaacctctgcctcccaggttcaagcgattctcctgcctcagcctcccaagtagctgggattacaggcgtctgccaccacgcccagctaattttttgtatttttagtagaggcggcttttcaccatgttggccaggctggtctcaaacttctgaccttgtgattcacccgcctcagcctcccaaagtgctgggattacacgcatgagccaccgtgcccggccgtaactttcctttataagcttaaaaatcattaaggctctgggtcaagaaagcagactagttactgagcattgtcatctgccttctcattttaaggcttcaccaaaatgaaaacataaactataaaagagaaaaaaaaaggtataattacaaacatgaataccaaagaaaacgggaaaggaggcatcaacaaatgagatatataactctttaggaagaggggattgattttacagatgagacgggttgaaaagccctagcctaaatgtactgcaaagaggtttctgaagatatgcaagttttcagaaaaactgacttctttagacatgagacgaaattcagaaaactaagactcctgatgatatggattttgatgttgcacaataaaatccttctcattctgtggagtctactgctcgatagtcagactgttttctgttcatatcaagtaaagcctgcctattggggcaaatagagttcagaattcccccttaagggaggaggccctcccccaaaatatgccaactgacacgagtggaggagaacagttcccactctcctggtgttactatcttaaagaacacataaccaagaggtcatggagtacatgaggagaattgacagtgtgaaagaaaaacaactgagccttaaggaaacagctaatacagaaacaatgatattacaaaaaagagctattaggttttttttaaaggattgctgaaatgaaaatttaagtagaaatgtgagaaaatgaagttgaagtaaccttctaaaatgtagagcaaagaccaaaaaaaaaaaaaaatgcaagagcaaatatgtggggaattaacctctgaggtttgacatttgacttaatgaagctagagaaaaggaaagagaggagaggaaattatcaaaatagtggaggaagataattcccagagatggaaaagacacacatctttatattaaaaagacccactgaaagccagaacagttaatgaaaaagagtcactgtgggtgtgtatttgtgaaatttcagtgctcggaggattaagagaagatcataaaagatttcagagaggaagaaaaacaagttgcctgtgtgtgaagaagtattaagctggcatcagttgtttcatcagcaacatggatgctataagcattgcctacaaaacccaaaggtaaatacacttttaaacctagaattctgtacctgaggtgtatatagatatatatgagatagcaaagatatgtctagatataagatagcaaagttaagacattttcagatgtgcaaggcctagaaaagttagcttcccaaatacctctttttgctttttagagataggatcccactattttgtccaagctgttctcagtctcaaactcctgggctcaagcagtcttcctgccgtgggctcccaaagtgctgggattatagttgtgagccaccatgcccagcctcccaaatacatttatcagaaagatagttgagtatgtactccaggaaaacaaagtaataaccaagaaagagagacttggccttcaggaattagaggaaccaacctaattgcacagtcaaagcaggtctttgaggtaataatggctatacaatagtccagaaaacagccattccaaattggaacaggagtacaaaagactcttgaagcaaaacaatggttgacaacttggggataacatctatctccacttcaaccttatgctcccagaaaaaaagcaattagaaatcctaggagaacctccactcatgcctcagtttgtaggggaaggtcaggcttttaagcaatcagcaagaaaagtgggtccatttaatcttaaaactagatttttaaaatttattgtagtggtcagattatgacattagatttgtaaagaatgaaatgtaattttagtatacctcttggcctggtattaaattgtgtatatacacacacacatataacacatatatgtgtgtgtatatataatattgcagatactgattactgattttcaacacagctagtctgtgataaagtcttgatagtggttataatcttgatgttataggaaaagtgaagcttacctaaggtgggttgtggaagctcagaggaaaagtgtgttgtggctccagtatcagtgagaaattgatatacatggtggacttggtgaaacagagaatgtaatcatattctgtatacttacaatcacaactagtagaagagctaaaaattgggagaggcagttgaagattagtgtagatgagctaaattctaatttttaaatttaggagaatcagtagacattatgtaaaattattaaatccagaaacctagatacaagtttactatttagggatatagagatgactaccagaagaatgaaatacaagaatagtcagaaaatttattctgaggaatgggtcatggtatagggagggaatgtggaaacagaaattctctagtgttattggatttattctacatttacatattttgagaaaacaaaacacttaaaatatttcctaatttggcgtttcactaatctagacctataatgaagttttgttaaagagttagtttaaataattgtctgaactctttgatactagccttaaataaaataatatgaaaactttttcttcacacttggcttttaaaactgagttattttggataacgacaacaaaaagtcacatgaacaattatttttcccattattaaacctaacactttttcctgaaaacatttgtgcttttttactattagttgtatagatatagaaacaagtgaatacagctcacttttaataagtgtgaaattcagccctgaatctggtagactaagtcattgatgacacaaatcatatcctgtggtaaaccatggtatagaagtgaggatggggcttcagaatcctttccaacagtgtattccaagcatcaaatagacatttggtcatttgcagttgactcaaaagcaaagacctagtttgcgttcttggcactgttctgcttctactctaaagataacccatagtagagtgacctggggagaacatgtggagtaccatcttaaaacacagcaacactgcagtaactgcagcagaacaaaagtgcctgcaacactcaagaaacatacctgttgccatggccacttgcaacttttgtggcctgtaagtgagatcgataattcctatttatccctccccaagcaaatttctactatatgactatatctgaaagttctgtgattttttcatcctggcagaaacaacttattcacaaaacaggcagctggttcactgaccatagtttgccagcccttgatggagtagttacggagttttgaactagatcacctaggcatgaatgttgtccccaccccacgcccccaccccactccaattgtgggacttcgttttctaatctttagtgttaccgtaatggatgtgtcagtgccatagagttttgtgaggattaaatggagtgtataaagtgcttgagaatggtgcctggctcatagcaactgctttttaagttttataatagctgttattgaaatagggtacaagtggctaagtttactctcatatgctggctcagcctggtcacagtgtttggggccatgttcatgttcagtggaaataatgctgtctgattagctgtgttggaggggcgagggaagaccgtaatagctggtctaggtctttggtacctcttgcagatgatcctgtcatcctcagataacctcttcatgattaggaatgcaatactacattaaaatatttctattagaaagcagatttaattcaaaattatctcaggtacactgggttttacagaaacataactgatgtaaatttaaggttggcgagtaatggatgtataaactactctttaatgatgttagttaactcgaatttatcttgatgacattttgcaaaaataatatttaaagaacaaagcagtttgttgaacagtatgaactaagtggagtataaacatgaaatgcttttatttttctctagttattgccttcaactgaacttttaaaaatctttttttcccattggtttatgtgttgttgactgactcagtaactttctagtcatttttggttattcaagagaaaggtgcctgcttaatttggctcagttcaaaacttcattctcaagtctaattcaaaagtaccctttttctatttccagagaaatagaaagtaacagagtaacagagaccaaatgtgtctttctactttaaattactagagaattgggcaaatatatggaacagctgttttcatacactggattacaggtagcacagttctgtgatcctgagagaaaataatctactaagggaagtcctaaaatcactgctgctttctgcctagaggcattttccagactacagtgaaagaaagaggaacctaggaattctgaggaggctgaagtggattaatatgtgagatacaacacaggataggaagtagctacacagaagaacagaaatttgcacgagggtgaccttgagttggttggtgattgccaagatgtgctttcatttgataaaactcaacaaagccacaaaggaactaccagagaaagagaactgtaagcagactaattcccagagttcacacagaagtgaactgggaacatttaaaattctgaatagcagattaaagaggctttgtaggacaccctgaagaaagtagaaacccagaaggattatgctttggtagggccatactatccttaaaataaagaattctctaggcctgtcttaacaaagcttagaaacaagtcccaaaaggatccacctgcttggcaaagaatttaactgcctttggtacatcattcaatatgctttgaagaaatacagcataatccagcacagaacaaaattacataatatctagcaaccaataaaaaagtagtagagatgatgaagcaggaaaatacgacccaggagcagaagcagtcagtagaaacagagatgatggaattggcagaaaaggatctcaaagccacgactacgtttatactcaaggatttaaaagaaaaaaactaataagagaaatggaagatataaaacaactatttgagatgtctaggggtaaaatgtacaatctctgaagtgaaaattttgctgcatttatttacttcagaaattgtaaattttggaagtaacagcagattaggtactgtagaagaaaagtttagtgaatctgaagacacagaaatagacaccgtggaaaccagagtacacaaagaaaaaagacctaaaaactataacgaacagagcctcagtgacctgggtctattgtatatacatattatcaagtggtccagtggatataacagtagaagtggggaaagaaagaatattttaaaaagtaatggccaaaacttccccaaattgagtgaaaattaatttttacttctgcaagacttctattgtacataatgaattaacttctgtcctgtgcatctaagaggtatatgtaccatcattgggatattttaaagtattcatattatttcctgttagctgtattctctcataaagccctagctgagaaaggccactgttgatcaaccactaaaaatggagagaaatacagctagtaagccagtagtgaggatagaatggaatactaaaaacactcattccaaagaagacaggaaaagaaagaagagcaagtaacaacaggtgataaaaatggaaaacaacaagatggtaagtttaaactcatgtggatagttacattaaatgtaaattttgtatacaatacagttagaaggaagagattgtcagattaaaccagtagattcaatggcatgctgtttataaaagacacactttaaccataaacatacagtataggtttaaaactaaaaggatagaaggagatatgccatgctaacaatagaaaagaaagctggagcagctatgttaacaccagacaaactaggcttcaagacaagaaatattacctaagataaagaagggatgtttcataacaatagaacttcaatatacatagaatgaaaatttccagaaataaaaggaaaaataaataaatcaactgttttggttggagattacataattgatagagcaagtaaaaagaaaatcagtgagaatatagaaaactttaggtgtattaggaaacaatttgacctaacattttcggagaactcaacagaagaacagaattcacgttcaaaatgcacgtggaatatttatcagaataaaatgatggaccatgaaacctcaaatttaaaaaactgacataagaatatattctctgacaccagtggaattaaattagaaataaaaaaccgaaagacatatttaaaatctccagataattggaaaataaaagaatatacttctaagtagtctgtgggtcaagtaagaaatcacaagagcaatttgaatgtatttttgaatttagtgaaaatgaaaacattaaattttgtgggatgtagataaaacaatgcttgaaggaaattataactttaaaatcttaggaaaaaaggtctagaatcagtgatctaaacttttaccttaaaagaggaaactagtgaaataggttatgcacaaatagagaacaatcagtaaaaccaaagctgattctttgaaaatgtttaaaaaaaaaaagccaacctgatcaaggaaatgaaaggtggtaggtcagaggtgaggtcagagggagacaggacacaaatgaccaaaatcaggattgaaagatcattcaccactacaaatcctacgacatttaaacagtagaaagagaatattatgagaaacattataggagcaaattcaccaacttgcaagacacaattaccaaaacatgacatgagaatagggaatctgaatacttctgtacttttttaagaaattgaatttgtaattaagaatttttccacaaagaaagctctgagcagatagcttcactagtgagttcagtcagccatttaaggaagaaatattatcatttctactccaactgtttcagaaaatagagagcatacttccagactcatggtttgaggccaggccagcattaccttcctaccaaatacaaaaatagttaatgaaagatatatacagacaagcatccctcatgaaaacaggtgtaaaagtcctaacaaaattttagcatatcaaatccaataattcataaaaagataatacatcataaccaagcaggatttatctcatttataaatcaatacaattcacaattttaacagaaacaagaattgtgtggtcatctcaatgttcacagaaaaagcattggacagaatttaatattgactcatgatttcttaaaaatttcataaaatagaaacaaaaggatacttcctcaaactgacagaaggcctttacaaaacatttacagttagcatatttagtgatgaaaaactatatgcttttctgctaaaaggggaagtaaacaagcctgtccactctcgtcactcttatccaacattgtcccataggtttttgccagtgcaataagtgagcaaaagaaataaaagacatacagaggctgggcacggtggcccacacctgtaatctcagcactttgggaggccatggcgggtggatcacctgaagtcaggagtttgagaccagcctgaccaacatggtgaaaccccatctctaacaaaatacaaaaattagccaggtgtggtggtgcatgcctgtagtcccagctacttgggaggttggggcaggagaatcccttaacccaggaggtggaggtttgcagtgagccgagatcacacgattgcactccatcctgggctacaagagtataagagtgaaactccatctcaaaaagaaaaaagaaaaatacagaatggaaagaagaatttaaacactgtcttcacacatgtcatgatatgttcagataaaattttaaagagtctaccaaaacacttttggaactaataagtgaattaagcagggtcattggatacaagttcaaaatataaaatgaattgtggttctatgtactagcaatgaccattgcaaagtaaatttttaaaaatcactaaaatttacaatagcattaaaaaccatgaaatactttaaatttaacacaatatttgcaagatctgtagactcaaaactaccaaacatgactgagcaaaaatgaaagaagacttaaatggagacataatgtgttcgtggatcagaagatgaagtattttgaagatgtcctttctctttgaactaatctgtagatgcagtgcaatcctggataatatacttacagcgatttttgtgtacaatggcaaggtggttctaaaattttgatggaaatgcaaagagcaaagttggtagattaaacactacctgatttcaagacttactataaaggtacagaaatcaagacaccaggatactagtgtgagaacagacataacagagccatggaacaaaatagaaattccagaaatagacctgcacatacatatatgatgagggacccattggtggcaaggggctgtgatctgtttgttattctcctccactttcaagggagtggcagtcctctccaggacccccttcaccccattctagatcttgattccttctctctgttggggtgggaggaggctggatcaagaggctcctcgcactgctgctgctcctgttctctgggtggcatgtgtccattgctggctctcctatggtttctgttggtgccaccgctccctgaggtaggaggtctgactacagatccccatcttgcactgccactcgtctctggcagtgcccagtagtctctgtggcagagtctctagtagtctctgtggcagagactactagctgtttccaaataatggctggatctttcttccttttagtaataatactgctaccctggttcagatccagctagatcaacgtaaccattttagctctacataaccattttagcctcccatatagcttggagatggccttatggcaaagtttctgcccacatagatggctgcaatgtgaactggagaacattctcatcaacctcagagacaagagcaacacccagcgggtggcagaacaacacgagagataacccaagaatacctacaagtttgggatattttaaaaggagagagaagctttgatgttttttaagcctatgttatttttgtccgctgaataatcgtaactcatgtctttgcctcataggctgtctctctgtgtaagggtctggcaaggtagctgcagcccaggtaccttccatgatgttgaggagagactctcctatcctcaccacaccagagagtaggtatgcaggttgccaccagtgttctcctccctacccactccctcacttttcttttcattggttcagtagaaggaggggctgtgcagtaagtctgccgcttgagcacagggacagctgtcactgcagtgctggtctcctgttcttggaggcacctcagtctccttgacctcttagacaccctcctacccccaaggtggggaaggagcaagcagaggcaaaatcccagccctccttgttaagactacagtgactttcctcctctcccttctccgtgtccgtaatgcatagctggaaggaagtgtctgggtggtgatgccagtagctgtgctggtgccatgccaggtgctcttcatgagcaccaaaggagggcaggctcaggtttgttgctgtctttagaatctggggttctcgatagtctttgccctcaggttggatctcagtctccagattgtgggtagcaggtcagtcccacttcctgtctcattacaagatgtcatatttcagaataatcttgttaatggttttattaacaaatgttattttaggacagatttcatgaagtgttattttatgccactaaataaatcataagcttaattgctacagtctgggtagaagcatatttgttttacagtataagcctcactaactgatttaatggagtagccaaaagcaatttcaagtacttccatatattacaaatgatcaatctttgttgtttctaagataagatataactgaaataaaatgtttacatgacattatttaaatttaattatatttaattcctataaaatggaagataaaatgccagaacttagagcttatgtatttttaaaatagagctgcgtaacttatagagcctcaattcatgagcaactagcttgctttttgaaaatgaaaaagagaaaaaagatgacagtttccaagttaattcacattatacttttgattataaataataaatgtcatttctaaatgatcactttgctgtgtaccaagttagcacttgatagttgaaaataaaaattattttatgactactaacttgtaaggaggcagtataaatagcttttatatgaaaaaatagatatatatgcccaggcatatttaatcactaaaaattgcttatcaggacagtcatggaaatatccttctgtaacagtttctctcagatctatttcagacttatgcatctgttactatatttatctttatcttaatcagcccttgctgtgaggtttggttattttattacaagcagctgggcaaagctttttcttttaaaaactacattcttttgtagtgctgccatcactcacattacacacttggacagcaaaagcacgtaaacagtagaactagatgaaatacttgatgtcactatatttcatgatactgtaacagaaaccactccttcgggacgatataacatgaaagcattacaatttttaaaaatcttaacaaaagatacagtcagtgtatggatgatcgctcttagagtttttgaacatgaaacttcttttcttatgctgggtttaactgtgactatatttactcatctgagggttaatatcatgccaacatttaactagtttgctctgatactaatatatacatactagtgtttagtgactttataagattattagaagtctacaattccaaacctctggccgagatgagaactttttaaatatataaacccttttataaatctaaccttacactttattccaactttggtatgacagtttgaaatgttttcaattccaggctataaattccagattcagttttcctttgagtttatgctgtataccaggtcctggggtaggaattattccattgtctcttagttttatgtcaagtctaaaaggtaggttactcccatatcaaaaatatggaaactgagtcttagaaccttttccaaggtcacataggtaattaaggatatattgattgtcccattctgccatttaggatttttgttagttaagagatgtgctgtgatattaggaaaatgatgttcagtgtaaacatattgttgcattgatgtcatacgaatggttgccaatataggcagttcttgacatgttttattaactgaagagatatggacagcttgctattttagattacccatctcttatgtttagaattcgtttttgtttctactatcacacttttaatttagtcttctgttacctgccctcagagctaatccagcatcttacagttaaactctggaattctatcctccatacatttatatccatgattgctaaatgaactttacatcaaaaccagtggttcacattgcttactaaagaaagcataagctcatcctggcattgaacactttattttcattgctcagttttgcccttcccatcctgtctgcaccccgtctcagccatttgaggcccctgctgttgttgggagaggccttcttgttcccagtgcccctgctcagggaagactttccgcagcttcctcccatagtgctttgtttaatcctcttacattacctttattttagccccaagttataaaatctgggaaattcaagtcaaccagtaagtttgtgcacaccatccagagatattcttcacagatgtgcagtcttcctgtgtctgctttccgggagaggcctgtgcactgaagacaattcagatttactttattaacgttctttctgtgaatttgtttatggatcaatctttaagtatgccagaaaggacattagttttatttccatcgtaattagttggaaatgtaattagttggaaatgtaattattttcactctgtacttagcttatttatttgacttaacgttaattttttcacaacatatttatagcttgtctccttaaattgtgctttatttcataccattaaaatacaattttgtatgcagaagaattacttgtattaacactttaaagtatacaaagattatccaccacatagtgatatatttagataaccttgatagactaatctgaaaggaggtgctgagtgttaattcacatggagccccacaagggggtacagaaactgcttcagtgagcagcttgcaaggctcctgatgactgcagtccttagctctctagataccaagataagggatcagagaagagccacaaacccgtgaaagtcagctcctcattacacttgacaaaaaatttggttcaatgtaaatagaaaggtgtttgttctgggctaggaggtttactgtgatgagcatgcagtacatacagccttaggcccatgaaataatactgtaggtttacctcttcttgggtgttttattataccccataatttattttctgctttcacagagtttggtgggatgtgtttataaatttaacatcataacaaaaatattatttacaagtttagtttttaggctgtaagtcatgattttctgataaatatgaatctctcaaatcagagtatctgataaatttccagagttctagttagttgctcactttacattataccatgtagaaagccctaatctgtgcatctattaaacattagaatggtaactagtaaattaattttttcaaatttcccttgagaaagaagtaatttgtcatgtagtccgaggttgcaatgtttattaggtacgagcttacttttcattctgtatttatgaaagattattgtagaatcttggtaaacttaatcatttcaaatagtgaaagggctttgtttaagaaattgtatgatgaattattctctgaagagtaatggaccctagcatactttcaaaaattttaaaccatatgttggatgtatagaaaaagacaaccaaaaaaatcactggtattaacaactactacagaagcaaaaagtttgcgtattctcattacatatacagctatatcatatgtgattatggtccagtagtaaaaatgtaaaaattaaaagattgttttggtacctccatgtcaaaaggtcaatgctactggctttgtttctttgccttaaggcttttatgatagcttttattctaatgtagtcaaaatatgtattatatccacatccactgataccttagtagtgttgcacttcaagtattcttttgctgtctatttctaatatcttgcctctttggtaatccaggtgccatcctgccctttatgctactctagctgggtggggttgggagtcagtgaagatggccacacacagtctttgttgtcatgagagagaggtagcgtagtgatggatgtggtcacactgccaatgacagcctcttgggggttctgcaaaatgagggtgatggcaccacctcagagaatttatgtgaaaattaaaagttgataaagttcttaggacagggcctggcacataataagaactagatatgtgtcacctgctgctgttttatgctttttttccaaggcatcatactaacgtgtagctcttccttgaccatatgtacaagttttgtttttaaatgcctactacttttttcctaaaaaaaaaaattcggccggctgcggtggctcaagtccgtattcccagcactttgggaggccgaggcaggcagatcacgaggtcaggagatctagaccatcctggccaagatggtgaaaccctgtctctacaaaaaatacgaaaattagctgggcatggtggcgggctcctgtagtcccagctactgaggaggcggaggcagaagaatcacttgaaccggggaggtggaggttgcagtgagccgagatcgtgccactgcactccagcctgggcaacagagcaagactccgtctcaaaaaaaagaaaatcctgaaaagtaaaaagagattaaaaaaaataaaaaggttgaccgaagattgatagattttgtcaacagcatctggagctcagttagacttgaaccgtttaacagtaaggaggcctttgaaggtactggaatgcaggaaatatttatcaaccccttaccacattataattacataatcacagcacttaaaggggcagcgtgaattattctttgcttgatcagtataagaatttatccgaagagttgctagaatagatgagggctgttgggttatgagggaatgaaagagaatgctcaggagcagcaggagtaaatggaaagtttactctatcctggcattcactcgacatttggctccctttccctttttcttttacaggctctttgggagcttatatcaatggaaaccacagcttctggcttttataatgaatacatgatcagccagtgattgacttgtatttaccattctccagtgactcctctcagaaatccagctactttgtaaatagtaaagacccatcatgagtaaatctcctatgagtattcacactctgaaaacacacagcaaaggcataaatttcaccttggcagcctctgcattatagaaagacctgtgagaggaggtgaaacttctttactggagaaagattagtttcagcttaggagagaagagctcattttcatgtcttgataagagctcagcacctcaaccatgtcattgcactccaaatgttggagcactgctgctgcacctagaggggactggcaaggagaggacatggcgacctcccggaatgttcataatggcaagcccatcctgtctaccttacctaggaggtgatagaaataagattcccaaaggtaaaatgcatctttgtggtacgtcggtaacccctggtctggaccctaggctggtgccctatctcttctgctgcagccgtgtgtggtgggctcacagctcacccatgtgctgaaggaagctgccactccacccacgagtggtttcttctctttatcaaatacttacttgcctttacaacacccaggggatgtgctgatgtgtaatattagaagtcctctagagcagaaatctgtatccctctctaagttgaaggaaacagggagctcacacttggtcatccgcagtctgacagaggcttgtcttgagggcgactctctgccgtcaaaagacggaggacatcagtgattcattaaatattggaaactagaagtttctgtttactgagctttaaatgatgggtgctgtactccagagagaagaaaacataatgagtatgtcctcaacattttcttagggttttagttgcctgagcaataaaatacgggtatgcagattacatagttgctgcaaatatgtagcagtggcaaaaaatactctgtagtgatttagaatcacatactagcaaaaatactgcttaagctaataggtcacacatctggcagctccctgggaatataagagactcacctgtctccgtgtgtggaaaaggcaaggggcaagttctcctgctgtaactgatcctcagtcaggacatgcagtgaacaagaaaatgtaataaatagacactgtgtttgctgagtgatacagtggcctttagggccctttacagaatgctttggtatgagtgtggtatcaagagaatttttcagaggagtgagaaaaacttgcacaccatggcaagctgggatgggtgagtcgtgaggagtgggtgaggtgggtgtgcactgggagggctgccatgtgctgggcagcaggtgcggtctcagacctccgggactccaggctcgccctggcaggtggaggccaggttcttgacagctcctctgtccttctgcctggagacaattttttaagtttttcattttttttccttctttctaaaagaagaatttagtggagaatacaactggaacccctgattttttttttttttcttgagacggagtctcactctgtctccaggctggagtgcaggggcactatctcagctcactgcagcctccacctcccaggttcaagcaattctcctgcctcagcctcctgaatagctgggactacaggcacgcaccaccgtgcccagctaatttttttgtatttgtagtagagatggggtttcaccatgttggcaaggatggtcttgatctcttgaccttgtgatctgcctgcctcagcttctgcaagttctgggattataggtgtgagccactgcacccggccaaaacccctgatttaaaacaattgcaaagcctttttgtttaaaatgaacacaaacagtagttgatgaatacctttttggaccaccaataaacattggttaggttcaggtgagttgaattgtctctggaatcactgtttactgctttcctttttgtttgaaccaggacataaatatatggcctgcaatcttgtctttggaaaagacataacttacacagttggaggttctcagatatcagtcattagtcaaatttattggtgatataaaagatataaggaggtagtttagcccggcctaactctcaatcatatgctttgtcaagccaccagagaagtttggtgcttgacaacgttttaaaatgaaggaggataatgttaagtcatcttatgcctgaaggtacttctggagtgaaagagcattgcagttcttgtgtgtgctttatatttcaaaatgtattttgtagctctccccaccaaaaaagttttaaaatggatttcagcttcaactnnnnnnnnnnnnnnnnnnnnagtgaagatgcaaagaattaggatgacaggtaggtcgattctaaaagataccttagtggagaatacaactggaacccctgattttttttttttttcttgagacggagtctcactctgtctccaggctggagtgcaggggcactatctcagctcactgcagcctccacctcccaggttcaagcaattctcctgcctcagcctcctgaatagctgggactacaggcacgcaccaccgtgcccagctaatttttttgtatttgtagtagagatggggtttcaccatgttggcaaggatggtcttgatctcttgaccttgtgatctgcctgcctcagcttctgcaagtactgggattataggtgtgagccactgcacccggccagaacccctgatttaaaaacaattgcaaagcctttttgtttaaaatgaacacaaacagtagttgatgaatacctttttgaacatggtctttaagtgtacttttacctgctgtattcatagtcatgagcaaaggtacagaagatatttgagtattaagtatgctttgaaagtatctcttatattgctgatcttatgtcggtgttaccaaaaaaaaactaccgaacaaacaacttttgtgtaattagctcaaagaatagccacaagggtgaggttacaggaaaagagggctttataagatgatgtgtgagatattgtttctttggtatgtcacagagccatgtgggtccagtgttccccaaaccccctcttacagaactccaggtcagtgttcagaaatattgtgttctttttttttttttttttttttttttttttttgagacaggttctctgtcgcccaggcaagagtgcagtggtgcaatcatggctcactgcagcctcaatctcccaggctcaggtgatccccccaccttagccccccaagtagctgggactacaagtgtgcatcaccaggcctggctaatttttgtattttttgtggagacagggttgtgccatgtttcctaggcttgtctcgaactcctgggctcaagtgatctgcccaccttggcctcccagagtgctggcattacaggtgtaagccaccgtgcctggcccagaaatgttgtattctttactcatttctgtttttcataatttacatggaggtatccactgcaaacatagaagcctagtcacagtatcacagtgttgaccgtgagccaaaaatgccattgtgctagcctgctaataataacagtaagtcctcgcttaacatcatcattggttcttggaaactgcaactttaaacaaaatgatgtacagcggctcctgaaatcacatccttttgttcatccttgttcctttataatgttgttgtgaggggaaatggttttgttacatgttgtttcgcttgaagtcccagtttccaggaaccaacaatgttatgtgaggacttactgtacatatataagtgcattttgatatgaaacagtgaggacaaaaactggtattataagcttaagatttacgtactagttatttaaatttccgtgtcccaccccagagctcatatatgtaatctagaccatattcccactacccctgggggcactcccgcttcccacaggcttcctttgtatcactccttttaggttgtgctttctttgtctaaaatccaatattgttaggaacttatgcccatatttttcttccttatatttctaatagttgtaggcatttttaggaaaaagttatgtcctttatcttgagatgtttttggtagactccttagagacaaaaataacacataatacagagttgaacattgaaaaataaagcctcatgcaaaggcagttaatcaaggaaagaacaggcttttcaactattggttgtccgtatgcaaaagaatgaacttcaatccatagttctcacaatatgtaaaaattgataaaaatggatcacagacttaaaatgtaaaacctaaaaacagaagtgcttagaacaaagttcagggaaaaatatctttctcattttgggttagaaatctaaggtttcttagatgagacaccaagaacatgatccacatgagaaaaaaatagaaatactggacttactgaagttaagaatgtcttttgtcaggacactgttaagagaatggaagtacgagctccagaatagaagaagatatgtgtaaatcatatttttgataaaggacttgtatccaaaatttgtagagaattctctaaactcaatagtaagaaaacaaagcaacttagttaaaacatggtcaagatatttaagcagacacttcactaaagaaaatgtaagtatggcaaatatgcacataaaaagatgctctacatcagtagtctttagggaaatacaaattaaaaccacgatgagacaatactgaacacctatagaatgactaaaattaaagactagtaaatgttggcaaggatgtagaacactgggaactttcaccaatgctagcattattggtcactaattcagagagaatactaacagtttggtggctgaaggattttggccctggaggacacaatgggatttgttttaaattggagaatagattccttgtgccagagccccatgtgtcagggaggagggagggggcaggacaagatgtgatccaaggagatggagaggctgggaattgaggtactgtaggcgtgcagctgtgagagtgagaaaaatggaccagtgggagtgggagagacaggagagatgatctgcataagagtgtgactgactgaggggcgaggcagggaaggggaatggtgctgtggcaaccacctttatggggagtgagagttagctgccccccttaccctcttgcagagtagcactatcggttgaagttgatgggtctctgcagcagtgtttctctgtccggatgtagactcagaaaaggttaaaagggtgatgcagtgtacggaggagagtttgccagccatgtgcagtgagagaggaaagaaggcttcactgcaaagaatgtggctgagctgttgcagcagtgggaggaggctgtatggaagggaattgagtgtgagtaggctgaaggattgtcggggaaaggaggcaggtaacagaagactcagctgactgtggcttaacaaggccttgggtatctttttataagaagtctgggaaggcattgctggcatggctccgctgctggcatggctccgctgcttaggcatgatggggactaccagactttccagcctgctgttttgccatcctcatcatgtggcttttcagccatagacttgtcttctattcctaactcttggattttgtgctttagaaacagcagttttccttgttaaatagtcatttatcctttatgcctattctcttaacgtttatttgcttagcttctaacttcattgtgtgcatataccacctttaaacaagtgttttgcctttggcgtgatttctgactttagccttattccttctagcatgctatttctaattcatttattagttctgtatttatgttattttggtcctcagtgtttcagttgctctgcaatcttgtttttcatttcagcgtgttcatttgccatcgcctctttgagtctcatatattgattttatgtcatctctaaattatttcatagtaagcacttctgggaacttttcttcagttattagttaggctttcttaaataaaagacggtgtctttaggatgccatgtgtgtgcctttgctgtcctcagtagggggcttgtttggtttggtttgctttgaggagtggggaggctggcctgtcttgtccagtaactatgccatgtcttttgttaatcttccacgtggttttttgtttgtttgtttttttagcatgaacctctgtcagtattcttcttcttttacacagcgagtgagctttgggttgattctggttgagggctcagaattgttgtggtgtttcttttgcttttcctctttgtctgagagaatgggaggagaggaggcaggaatcacccagcagggcgggaggccatgattcagctttgtaaatatcttttcccaggctgcctccaccgaatctgctcatatctgtttcctgtgagacacaccctttgcttaatatggtttcccagctcaggacaggggtctggcattttaggacagtaggtctctggtgtttatgggccctgctcctgtccccatccccgtcacatcttgccagctttagacaagaaggatgggcacagtccatgagtgtttttagggacagcgcaggggtcaaaggtgcactccctctagaacacaggggaggagagggccagagcaggctccccaggcttgcatcctggctccaggccctaccttaggcctccgttttctcatctgtgtggaggaagatgatagtccctacatcctggggtaggtggaaggattgaatgagataatgcccataagtcacttggcacccgtttgcttctatcagcagatgtcagctccagtcattgatgcttcatagacttctcactcaggcacttcctactcagtcatcttggtcccactgatcttgtttcatttattttcacttttgctttactttttactcaacccttgcttaattgttgggggtgattagtgattaggtgattttgatatttttcttctttctccagctttcctcttatcagataaaaaccaaaatggctgtcttctgtgggactccctgctgagaagtggggccttgtttctcaaaaagcgttctgattttaaaacttttcattggctgccattgcacccctttgtcttctcatgggaagagggtgtaatagtctcatacttttcacagttctgcccatttgccaactctgtgcctggggtaggccatgcttccccacggggctcctggggtgggccgtggttccagttcccacctgctgggcccacacttgaaatctcttgtgtgtgctcccagccctgctcttcatgcttgtgccatgcaactgtgtcacttcctctctcgttgcttttttcctccccacctctcatcccttccctctctggttattcaactaattgttgttgctctgattgagttcaaagagggtgtctaggaattagttgtgagctagctaaatagagaaatctgcaatatacattttaaatttgtaatcaatgcatattttgttttcagtgtttaaagaatttttcatttaaaatactgacagtatggcttacttttaacctttaacctctgcatctcaaataatttttcagaggtgcaccttggtaaatccattgttgccataaaccatattttgtacagtgacaatactttgatggttcttgctaggagagcagtaattaatactcgtcatgtctagaacttcccttcacacattctcctggaacaggatacaggacagggattgccccctctggaacctgccattgtgggtttagaaccctcaggacactggtaagcggagtgaaaggaagtcactgaccttccttaccaacatacttaacagtgcctgtaggaagctagttgggagatgtggatgggaaggaaaaagtgtcaacatttatatgaatttcaaatgtatcttacctctagctgtgccttaaaatgttttgaaatatgaaaactaaaaaatttgttaaaacatgtttattaaacttgcagcttaagtttatattcagtttaatataactgactacattaagtttatgtgcaaattcagtaactaggaagtctacaggtggccaattttgtgaagttatcccccaacattttattatgacagctttggccaatgttattttaactgatattctattaatactatacagtgaaccttttacaaatattggatgatttttataaattacccaactgaacctaaagaagcaatagttgttggtgaatacattcattttatatgttgtgggtagtttttcttgctggtttagatagagattttagttgttttatggtatgccttgattttacttttgtttgggatgggagggaaagatcgtttggttttgttttgtttttcttgagatatgtcttagagttttgaaaaactgactggatgttggatatgttttataatataatttgtttccagtaagttagagtttctttgctatgctaagaagaatggctcattccactttcttaatatgaaacagttgttgactagttcgttaaataacaaaatcttctaatgctgtccttttacagagtgtttgatgattttcccgatgaagagtaaagctatctagttcacctttatagctttagttatagtcaaatatcctgcttgttttaatttgctcattttgctgctcgttttctgttaaaggttacaaagaaaaaaaaaagtgggctgctccacccgggctgatctccagcaggagaccccagaaggtgcagggtgggacacatgacacatcggctcaggcccctctgcacaggttctgtgctttgtggtcagttccacatctttcacgtctcaggccttttcttgtagcactagccctaaaaactgcaagataagattgaggtgggccagcacagagaatagaaagcgaggaggaagatctgcagcgaagtgaggaggcagagtgttgtgcacccttccatcacacgggccttgccgtgtaattcatttctctccagcaacacctgcccaaccggagctgactgctgtgtgattttgttttgaagctttctgccattgtcactgcctctgataacagatgagataggtaataattcatttttccttttgttctgattacccagttatattcgtatgcttattaagtctcgctgaggcttagccctggcaaagatagctaaggagctatgggtctcaggtttctggtctctgttagtggtaggtagctgactgttaggaaaagcaggtgacttgcagaatgagacatagctaatccaccactgatttactagtgcatatggatctggtggccaccttactgctctgagccttcagttttcagatttgtcaaatgaagataattatgatagtgacctcataggattctttgaaacattataagagtaatgtattccattacatagtacctagtaagttctcaatacgtggtagttatttacctgttaataatggtgttgctatgcccagaatctttaaattttcatcatgtgccctacttttgataaagaatatcagaaacattcttgtcttcatgtccactccattctttggtcatttctaggtaacatgaaatattttcacatattatttcttttattcctgatattttactatctgataacacctggtaaacttagccagatgttttgtgtttctaacatgcagttagtaaggatttctcacttacatcttaagtcttttattagaaccctcatttaatgaaaacatgaaagttcagtttttatgaaatggagtgttcactctttattgttacagttattacagttaattcagaaacacaagaaaaacggttgatgtgagggtgtcacttccttcacttctgactgtggttggcaagtacggtgtgtttttcatgtgttgagctttccaaaaggattgttttccatagtattctctccacacttttcctcctctattattttttcaagataagtggttcacatattcttttttacttcctccttgatttggaaagaatgagggatgattttgaactttgggaaatactctctgaatgttgtcttgaaaaatactggggttttttggtaaaagaaagatgagtggaagaaaagatgctccttacagtgtgtgctgcttgatcaatctttgtcctcatggtaggcagcctctaacctgactgcctggtgttcacacagtgtaatgctgcctgtggagtgaggctggccatgttgacttagaagcaatgggacgtcacctctcagataggttgtaaaaagactatggcttccttgactcactcgccctggcaatgccttgtcaagaggcagccctgcaatgtagcttatgtgtgcaggaccgagaaggcctgccagccgtggggaagggagcctggaagcaggagagccagccaagctcttcctggattcctgaccccttagaatctatcaaagagtaagtgtttgttttaaaccactgagttttagagtaacttgtagtgcacaataaataactattatttaaatcattagacatgatgacatagtttctttcttaaacagactacatggtttatgctttaccatattcagtgtccagttgggctaggaaatattacatagttgatttgttttcaccatttaagagagtttgatttttttttaaagtataaaatgttaaatacaactcttaaggggtggaatctgtagatatcaaggtattaagtttgacattttgctttagtagttacatgatttgtctagtaaggtaaacatgaaacattatatctctggcaaatgttactgcattaaaataatgtaatcaagacttttctttagggctggcttatgtattcatgttcatttgacacaagtatatatgtattacacatacataatacatattatgtacttaccacaaaacctaataaaggaaaacctaacacaaaatctcaaaaaggaaaaaatatccagcctagccataatccttataatacatttgtagatactaatatgactttaaatcaatcacatatacttatatataatatataacatattgtctatataaataactagggattagaatgaaaaagtgcaacacatgtaagacatagttggttaggcatgttatggcatgatatttttactgtaggtaggtagatgtcttactgcagccctagtaattgatctgatacatgtatgctgctacagaagagtccattggatcccctctttctattagttttgtttctctggacagtttccatgtacctgggataggtgttatgttcagaagtctgttgggaagatctcagtttagatcaggctggccgataccacttctcttgtgtatgttgagcaactgtattgtaagattatcatttagattctgaatgtcttccttcttaggtcacttttgtgtgacccaggttgtctagaccacagaacgcacttatcgctaggcatcagctggctgttttcccactttgtgctgtgcagcatcctcctaccctggccatgaactgtagagatgttgtgtagaccttctccctcagctgcatcattgactaagacattgggcatgttgaaatgaactgtaggtcatgtcaagtttctttggttttgaacagaaaccagtgttaccaccaaaagggagctcatgggaggctaaagggcccccagagactctctcagtggcaggagactctagacctgtgccatctagtattgtagccactaaccacatgcaatgatttaaatttaaattgatcagaatgaactaaaaattaaaacttgagccatactagtcacatttcaagtgttcagtagccacatgtggctagtgacttctgtattacatagtgcaaacacaaaccctttccaccatcacagaaacttctccctggaagtacagctccagatagccttacctggaggccttcactccaatttactagcccagccattccttccattgctctgttcaagatccacgctgaaggagagagagttgattggtctgacttgagtcatgtgctcacgtcttggtcatatgggtgtgagtgagggttgggcaggagaagcctccagagacctctcagagccaccagggcaagcatctgagttcacagcctcaagacagcactcaaaggcggaggggtgcacagtgctattggtgggagctggccaagaatggacagatgcacaccatggcagtctttaaataaaagattttgaaaggaagattttgtgttcctctggtaggtaacaatacatcttcaaaattttttttaaaaagatatcacaatgtatcagcaaatatttgtttttaaaggtgcatgtaaacattgaaaaataagcgtaattttgtttttaatgattaagacttgggtgtgtatgtttctctaacagtgtgtggcataatagttgaaaaagctttctataataaatattaatgaaagctgtatcacaaaagtgtttaattgtggccagtttgcttaatttgctctggaaaaacgtttttgctgtccagccttccttccccattccagtcctgattgctaaaggcttctctaccataatccacaaagagctcaaactaatatgcttcaggcaggttctgctggggttgagccagttaggtttttctccttacatagccctctgtcttgtgcgtgcgtgtgtgcatgtgtgtgtgtgcgtgtgtgttttcattgctttacaacaggcctcagtgaataggaagcattacaacactttaaacattggtcacaaatggaaggataaatatttttatggtttttgtatgattgtgacacaatttaagactagtaaacatgccatgtttgttcacatagctcactcctctttaaccctgatgctttcattgtaaagtgagaggaagttagttttgtaagcatcaagccctgatgcatgaagaaagctcttgcctaggccatctgacacagagtcccacaggaatcagcttgcagtgggctttataatccaaagttagcattatactgcagtgtttcctcccatggttcaaggaaaaaacaacctgaagtggggcttttctatttatgagagaagatttataagtaattcaaaagtggtatttactatcagaagtcagagatcacttctaagcatatcagtaaatgccctcaatttggtatccacatacttttaacttggaagatttgttatgagcatccccctttatcagtatgacttctttctttgtgctctcttgagaagggaaaagatgaaggataaaaaaaaaaaacagaacaaaaagcttgggttttccaccgttaaatgttactaaaacatactttataatccaaagtcataaggtatggtcagttctttacacattacattgtaattgaatgtgaaatgtcaaagcttgctttagattattttaatacatgtaaatataaaaagggggaagtaacatctatatttcacattattctgtactttgaatttaggtcttttggtcttggaggaaaggggagagtagtctcagattgctgccaacatctccccatggcattgaaggttctcatggctcccaagaggcagcagggaatacaggagataaccagatattttaaacattttacttcttgccttctctggcaaaagcttgctgtgctttaagcctctgctaagacaggttgctacctcaaagtaagttgtgttttaagtagtataatcgcaggagattattacctagggagaaaaattcttgatgtcttctcaaaaagattaaatgaaggaaaaataataaacagtaatattacatttcaagtatatctttattctatccaagtgatacatgaacatgaagacattttgttgcatgatgaaaacagttttgccacttgtggtagtgtctgctaattgcctacccattttcattttcccttagtgagagagtcccagttttattctctatgctatggcaaaacactcagcaaggaaactacatttcccagcctcctccagctacacatggccaagttctaggcagtgagatgcaaacagatactgttgtccagtacttagtcagtggctttgaaaatggagcactcccttcccattcccccttttcccttcctgctatttggtttgcagacctgattgcaaggcttcagcagcctttttggaccatgagataatctgaaaggacagaagatgcagcctgagaatgacaaatgagaaacattgagggaacctggtttctaacagtggtcatttgtgatatttatgcaaccctgaaaaaactggtcccaaaattttgtttctgacttttaagctttcaagaaagtggttaaatcaaagcaataaaattagtataaaacggacactgaaaatgttggcaatccagtagcccatgtagtgaagtactgactagcaaaaaactcattccccatactcccttggtaatgctcatcctcagtgctcgtcatttgttagaaaagagaagctttgaatctcaatgcaaaatctttaaaagaattcagaacataccatatgaaatcattgctattgtaaataaacttgatcatgatgtgagcaaaagcgttacatttaaaaatgtagctccactaaaaggaatcaaggtctgaggaggaaaggtacaagatgagcttggaacattttgtgataccaggtaacaggaagttattgatgactattttggtcatgtcaaaaggacttcacagccaatctaactaagtcctcactggtcaaagatggggtagtttgagcatcaataaagattttaactgcagtgggttgtcatacatcaaataggctaaaatctataagttaattatgatttccaaagattaaaaacttaactgttcagcgttagaggatactagggaaccaccttgtaattttgaaaactagtgaataaatgaaaagagtcaaccgcttataaactagaaactcattttaatattatttacagatcacaagcaaaagaaacaaagatatccattttgagtgtttttatcctcttactttgtctgtggcttcagacagtgagtcaaagccattcactcccaggatcttgagtaccaacgaaagaaattcatttgagtgtgaacagttctcactcctgccccggcacacagctttaccgcatcaccagggagcagcagtgactcttgcctctctctctccctcctgtaccaccagacttttcatttgataagtaaacagttttgaaattctttgttaattttgctaagcattattggcattcatcttttacctataacatagcttattgtttattttcatcacattatctgtttaatgccacataggaggaaacataatctgtagctgatagattcattttctgcacatacacgtatcccctaaataattcattaagaattcaataagtaggtaattggtgtttaaaatgctaaatattatgtagaaattgtggtagactgttacatagcagtttatggggttttttttcctgccattttatcgatttgtggggaaattgattggagcttttgggtgggctaagaataaattactatttttcctatttaaaaatgatgggttctcagtattcaaatatttgcttttcagtggcttttaaaacacagaaaatttattccagaaaccatgatgagcattatctatacattgtctcatactgtccatgagctgaattttagcagtctgtgactgcacctgcagggatctcttcctccttcccattcagcccagtcaccccacaacctccagttatgcacacctgctctgttctgaatctcgatttcctgcctctcactctgcagcatcctaaccttccagttctgttcagacctcactaagtcctcaggtctggggccactcactctcaatcatttccctcttttcctctcttctctcctcacacagcctagatttcatggttctttgtgataatcactttcttacaaatgaccttagctaccttcccactaacctcataggggaattgtaaggattaaatgagtgaatactcttggagtacttgggaggatttacgtagtgttatgtagtatctgctcagtaatgtcaacggttggtattactgagctctctcctctcttcttgtacttgtctggcaaagttccagacccccaccccgatccccccaacccctgccaccagttagctagaaattgctagggatggaaaaaataatcatgctaactcatctcctgatcacacatctcaagtgtgtagttaattttgcccagcaacactgccatacttccctagtatgtttgcttttccactttctgaaatgcatgttcaaatctctttcctccatccatctgtacttcctgatgttcttggtacaaattacaggaaaccctatttcagctggcttaaacaataagaaaatactctgtagcatcacaagcagtcacagagtaaggcgtcttcaggattgataaggtcagcagcctagtgctgtctttctgctgtgccatcttcagtttggagactttgcccttgccaccttccatcatggtcacaaggtggctgccatagctctaagtatcacatttagaggtgacagcatcctggaagaagacctgtgtattcctgaatgtctttatttcagtgaagaatatctttcctagaagacccctgcagacatagctttattgaaggaagggtagggtgaatagtggtagaacaggaacaggtgacttataaaatgtggttggctgcacctgagcagctgaacagcctcagtgagcacctgtccaggtcttgctgacatttgtctaaacagtctccctaagtgatcttattcaggaccttggttttgaatgctacctgtatgatactaatcattggtaaaccttattctctgtgtccagtctcacacatgactgctccactcttatgtgtaaaagataccttatacttaccttggccagagcacagcttccccctcctccattcttgtcagtgttcataatatcggacactcacacactcaggctaaaaatctagccattagattgattttcctttctcccagcatccatttaactagcatttcagacaacacttattccaagtcctccacatctctctccctaccttgcgctgtctcggtccaagctgccatcctgttgtacttgggtgacagcagtagctgcctactgggcaccctgttctgattttgcccctatcatctcttctcccccaatcttacaaatgatctttttaaagtgcagatcaaattatgtcacttgctgctcaaaatcctccagtgcctttgtgtcactttgcctagggtaaaatgtaaacttctactccgcttacccaagctcctgtcctgctcctcctcacatcctttcctatgagccacagtggtctccttcaatgggccatactctgcctcatctttacatctttgtaccagctgagctcatcactgggtgttcttcctgatcttcatttggatgtctggttatatttcagacattggcctcacctttatcaagcaggccttctccaaccacccaatctaaattagtcatctagtgtgctgtctcagaactctcttccctgcctgaaattctctgtgtaacactcctcacagtctcttctctctggcccattgcttcttgccatttgtctttgctctccttctgcagaatggtaaggaatggtctatcttactcagcactgtgggttcagcacctaggacagtgcctggcacttgttaggttaatcaataaattatttattgaacttaaataagctttatttggaaaaagtaaaacggataaactcccattcagtttcatctgacttttttaaagagaaagaaaactaatagctctattattgtatgattcgtctttttggagagtaagcaatagaaattgactctggctaccctaaatgaaaaggaaatttattgtaagtctcctgaaatcaatagatggatagagattgaagcttagagcacaaactggaacccaggagccccagaactagacagtctataccatggcaggtctgcacgtcactgccctgtgctctttgtgagcttggcaaatctccatgccatgaggttgcccattcagactgtcagtcctggaagcagcatccagcaggccagacctgatgtagacgcctgtccagctgtgtcagggcagaggaggcagctctggctcttgggcttcagttgcagggatcctctactgtccaaggctgatacagtggagagaggggtggccaaaggggtctccaaaagcaagaccgggattttaatgggggcagtggatgttgagcagccaaaacatggccaacattcaaatcatttggggaacttgtttagaagtctctctctgagcttgttggagctccaccacaaatagtacaaacatctgcctacccccgtcttcttagttcatgaccataattctccctcaaatctctgaggaatcaaaatggaatcactggtgttaaaaataaccctgacaaatagaattgagaagcccatgaaaagagggttcttatgcttgtatgcctgataactaaaaccatcacaaaacactctgcaaaaaccacaaccttacatgaaggccattgtaaccttatacagaagacacttctgcaaggatgtctgttcaactgcctgtccagcctcaggctggcgttacttgttattgatctttgtagccaaggataattattttgaaacagttacgtaatcttcattttttcctctaaaaacctttgtcttcctttatctccctgaatatacacattgtttatggcatacgcattcctgttgcaatgctttattcccagattccttttagaggccctctccctgttttttatttaggttgacaagctcaaatcttcattagagaatgacagtcccataccactgtttctcagaagatgctctcagatgttcagtggcttcttgtccccctcagagtaaaccccaggtccttttgggcccatgggacccacaggatctgcccctgctgtgcacttcagccacactggacctccttgtgctccacaagtgaatcagttgcaattcccacaaaacctgtgcccttcgtgttcctcctggagatgcattccccagacctgtgtgggaatccttgctacctcctgcctcagctccagtgtcacctgctcagagcccttccctggccatcctgtcttaactgtgcccatccccactccatctccccccgctttcttactctctgtgtgtatttctttctttattgcgaggcttcccatgacagtgttgaacgccaggggccaggggctttgttttgttcatggatgtatccatgtaccaaaacagggtccctccatagtgatgcttcaatgagtgaaaaaatgggttgtcatctgtgaaattagttttaaaggaggaattccaaaatggtcctaaacaacaagtagacagcatgtgaggtgatgattgcaattacttacttggttatgtaaattctgttgctttaatttaagagaattatctctccacctcctgttttagagcagtgggttagtagattctgctgcctcttcagctgaatgttggagcctattagaaatgcagaaccttaggttcacctcatactcactgaatcagaacctccaagttgacacagccaaggcaaaaagccttagaaatccccttgtatattctaagcattcacacattagaaagggaagggcagtggccaaggcgctttctttcttcatagcatagtaatgcagctttggaactcagtttctgcttgctgatctggacatagcgtcatgtaggtacacgaaacttcacatagtacctttggctggtggggtgttgaaatggcagaaatattatagttgcttttctgtggaaggaaaagtgctataaatttactacccctaggaaggtttgaggcacttgttttttaaaatttatttttaactgacaaataattgtatatttatggggcacaatgtgataattttgttttcatttttatatttttagagacagatctcgctctgtcacccaggctggactgcagtggcataatcatagctcactgtagcatccacttcctaggctcaaataatcctcctgcctcagcctccgtagtcagcatgcgatgcctggctgattttgtatctctatgtgtggtagagacagagtcttgttacgttggccaggctggtctcaaactcctgggctcaagctatccccctgccccagcctcctaaagtgctgggattacaggtgtgagccaccaccatgcctggccatagtgtattgatctatgtaaacattgtagaaagagtcaatcaagctaattaacatatccacgacttcaccaacttatctttttttgtgtggtaagaacattcaaaatcatataagtacatactattattaactgtggtcgctgtgagatctttgttttttagtggaagccttgtgagctatcctgtaattttcagcttatcttcacatttctcctcatactctgtagtactatggagtatctgcaggagtgtcctgggaatgtgttacttgctgatgtcgtaatccctgagtatatagctccagcccagggagcctcagagcagatcctgaccaggagtcaggctctgcattggaagctgttgggatggacagtgtgagtttgaatagttttgtagacctctgtcaccttgaatgcattagggctgcttgtgagactgaaacaattataatttcaccaaggacaatcctatttttttaattccactgcttaatgtcatcagtcaccaagactgtttagaagtggcactttagatgaccgaataggaacagctccggtctacagctcccagcctgagctacgcagaagacgggtgatttctgcatttccatctgtggtaccaggttcatctcactagggagtgccagacagtgggcgcaggtcagtgggtgcgcgcaccgtgtgtgagccgaagcagggcgaggcattgcctcacttgggaagtgcaagaggtcagggagttgcctttcctaatcaaagaaaggggtgaccgacggcacctggaaaatcgggtcactcccacccgacccgaatactgcgcttttccgacgggcttaaaaaacggcgcaccacgagattatatcccgcacctggctcggagggtcctaccccatggagtctcgctgattgctagcacagcagtctgagatcaaactgcaaggcagcaccgaggctgggggaggggcacccaccattgcccaggcttgcttaggtaaacaaagcagccgggaagcttgaactgggtagagcccaccacagctcaaggaggcctgcgtgcctctgtaggctccacctctgggggcagggcacagacaaaaagacagcagtaacctctgcagacttaaatgtccctgtctgacagctttgaagagagcagtggttctcccagtaggcagctggagatcggagaacgggcagactgcctcctcaagtgggtccgtgacccctgagccccgagcagcctaactgggaggcaccctccagcaggggcacactgatacctcacactgcagggttctccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaactgaacagaaaaactggaaactctaaaaatcagagtgcctctcctcctccaaaggaacgcagctcctcaccagcaacggaacaaagctggacggagaatgactttgacgagctgagagaagaaggcttcagacgatcagattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgctgcgatcaactggaagaaaaggtatcagcaatggaagatgaaatgaatgaaatgaagcgagaaggaaagtttagagaaaaaagaaaaagaaacgagcaaagcctccaagaaatatgggactatgtgaaaagaccaaatctacgtctgattggtgtacctgaaagtgatggggagaatggaaccaagttggaaaacactctgcaggatattatccaggagaatttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagacttaacagcgaatctcttggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagtgctaaacatggaaaggaacaactggtaccagccgcttgcaaaatcatgccaaaatgtaaagaccatcgagactaggaagaaactgcatcaaccaacgagcaaaataaccagctaacatcataatgacaggatcaaattcacacataacactattaactttaaatgtaaatggactaaatgctccaattaaaagacacagactggcaaattggataaagagtcaagacccatcagtgtgctgtattcaggaagcccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaataagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagaggacctaatagacatctacagaactctccaccccaaatcaacagaatatacatttttttcagcaccacaccacacctattccaaaattgaccacattcttggaagtaaagctctcctcagcaaatgtaaaataacagaaattaaaacaaactgtctctcagaccacagtgcaatcaaactagaactcaggattaagaatctcactcaaaactgctcaactacatggaaactgaacaacctgctcctaaatgactactgggtacataacgaaatgaaggcagatataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttgaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattccttgacacatacactcttccaagactaaaccacgaagaagttgaatctctgaatagaccaataacaggatgtgaaattgtggcaataatcaatagcttaccaaccaaaaagagtccaggaccagatggattcacagccgaattctaccagaggtacaaggaggaactggtaccattccttctgaaactatgccaatcaatagaaaaagagggaatcctccctaactcattttctgaggccagcatcattctgataccaaagccgggcagacacacaaccaaaaaagagaattttagaccaatatccttgatgaacatggatgcaaaaatcctcaataaaatactggcaaaccaaatccagcagcacatcaaaaagcttatccaccatgatcaagtgggcttcatccctgggatgcaaggctggttcaatatacgcaaatcaataaatgtaatccagcacataaacagagccaaagacaaaaaccacatgattatctcaatagatgcagaaaaggcctttgacaaaattcaacaatgcttcatgctaaaagctctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcctatacaccaacaacagacaaacagagagccaaatcatgagtgaactcccattcacaattgcttcaaagagaataaaatacctaggaatccaacttacaagggatgtgaacgacctcttcaaggagaactacaaaccgctgctcaaggaaataaacgaggacacaaacaaatggaagaacattccatgctcatgggtaggaagaatcaatatcgtgaaaatggccatactgcccaaggtaatttacagattcaatgccatccccatcaagctaccaatgcctttctttacagaattgggagaaactactttaaagttcatatggaaccaaaaaagagcccgcattgccaagtcattcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatgtttgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccgtcagagaaatgcaaatcagaaccacaatgagataccatcttacaccagttagaatggcgatcattaaaaagtcaggaaacaacaggtgctggagaggatgtggagaaatgggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttagggacatggatgaaattggaaatcgtcattctcagtaaactatcccaagaacaaaaaaccaaacaccgcatattctcactcataggtgggaattgaacaatgagaccacgtggacacaggaaggggaacaatcacactctggggactgtggtgtggtggggggaggggggagggatagcagtgggagatatacctaatgctagatgacgagttagtgggtgcagcacaccagcatggcacatgtatacatacatatgtaactaacctgcacaatgtgcacatgtaccctaaaacttaaagtataataataataataataaaaaaaaagaactggcactttaggaatcctgaattcagatgcctaagggaactagcagattatatcatctaatctaatgaagcaagcctggtgtaaaatagtcaactgacagaaataggatacgctatcttcacttttacccctaactctaagttaatattggagtttgatattcagaattaagaaaaggtgaactgaagtaatttttttctagttctcctctttacatttggagcttacagtctgatgccaggcatggcatgctaactagggaggctgaggcagaaggatcatttgagcctaggaggtggatgctacagtgagctatgattgcaccaagattttggcacatctcatcttttggattgggatgtttttctgcactatttgacttccttaaccagcaagaatactgagtttcatttagtttaattatagaaaatgcgtgttcataaatttaagtactttcaagctggaaaagaatgttggcataaaaagttttgccatttggggtaactattccggagatatttgtaaaaatcttagattccatatcaatcatgtttagttgtccaatattgcattgtaacttccatttgtaaagttctttgctcatagtatcattagtaattgagaaaggcagactgaacagattatatcatttttataaaccttgaaatcatgaattttgtatgcctgaggggtggaggggacagtttactttcagtttcacacatgtaaaaatatatataattcaggccatcagtcttagatttctgcaaactgggataatttcttgccaaacaaatgttctaaaagttaaaatttcagtgggaatgagtgaatgaaatcatgtatttgtgtaatcatttaagaatgtccctttcaggaaatagtgttaggaatactttataccctatgcaaaaattaacacaaaactgatcaaagaccatagcataagaactaaaagtatacaactcttagaagaaagcataaagaaaaagctttataacattggatttggcaataatttcttggatatgacaccagtaacacaggcaacaagagaaaaaagaggtaaattggaccaaaattaaagacttttatgcatcaggcactatcaacagagtgaaaaggcaacccatgggatgggagaaaatatttgcaagtctatatctgataaaggattaatatccagaatatataaagaactcctgtaactcaacaaatgaaacaactcaagacgcaaattaaaaataggcaaataactttaaatagacatttctccaaagacaatatatggatggccaataagcacatgaaaacttaggcgctcagcatgactactcacaatgaaattgctaccaaaacaccaggggttttgtctaggtcctcctgttcactgcacagaaagcccatcactgtcacgacaagtattgccaaggaagaaggctttaatcggctgctgctgctgagatgggagctcagcctcaaattcatctccctaacccactaaaactaggggtttatatagcagggaagaaatgtaacaatgtgtaagaaaacaagaactagggaggggcaaggagtcatctggtctggtgatcagctgagttttggttctttgatactttttttgaaaggcctgaaggtccttttctggggaagaaactcaaaacagatgcaagtttcaaactttaacagcagaagggtcaatttctttgtttatccaaaaagaactgtctatgggactattgggtgggtttcaaaatgctactgcacacccattaggatggctactataaaaaaaaatagtaagtgttggtgagggtgtagagaaattggaattcttgttctctgttggtaggaatgtaaaatggtttggtgactatggaaaacattatggtgatttctcaaaaaattaaactggaattactgtatgatccagcagtcccacgctgtatatattgaaagcagaattgaaagcagggtcttgaagagatatttgtatatccatgttcatagcagcattattcacaatagccaaaaggtagagcaacccaggtatccttccaggggtgaatggataagcaaaatgtggtatatacgtacaatggaatgttattcagccttaaaaaggaatggatttctgacacatgctacaacagaggtgaatcttgaggacattacgctaagtgaaacaggtgaatcacagaaagacaaatactgaacgattccatttatatgaggcaataaagtagatggcttgtgatgtcatccaaaaagatcaagtcctggatgcagtgttagtgggtgagccacgccaagggttttcccctggttcctgtgatgcattgttttcaatgggtcagaaagttagctctcttctgcaccatacctctagcctccaccgcaggcccgccagccatctgttgtgttatgcatccagcttaagaaacaaagcatccagctgtctacccctcagcttaagggactgggtctttttcctagtgttagttaccacctacatgaccattactttgttaagtttctgcaaaaatcctcatacctcaggatcatgctataagtggaacaatatgatgaacgagtttgagcttccgggacttggaaaatgttgtttctgttgaataaaaagtgtgacattaacaatgtgggtcacatttgttaattgtgaccagtctacattaaacttttcatagaacatgagaaagaaccatttcctaatatgcttatcatgaataatatatattcattaagttcttcagtctcatcaaaattctcatcagctccatgagtaaatatagttatctgagttatatttatatctgtgttctaatcagctgccattggaagcaccataaatagcttgtcttttccatgcagcttatcccgtaagttctcagacctatctttactacactgagcaacatcattgtcgaaagttaaatttaaatttgtcaataattcattgtcttcagacacatattttctgccgtatcgagtaaacacttatataaactcaccatctctaacggcttgggcagcttaaacacgtaataactgcattttgcggtagcattattgtatttgtttgaaaacagtctgtattgaaaatattagtccttttacaattcattcagggtttctttttctaagtgttacctgtgttctaaatattaattacggttcttaacatggtttgcttaataatggcatcttaagctctgttcttccaactgaggcatactttgttaaacatgtgccttcttgtggtctttaatttttttccacttttcatagaggtgtgaacaaaaaatgattttgctttcctttaaaggaaaaatactggaggtaaattggttttttttttaagataaaatcactcatctagttttaaatgttgctaactaatgcagaaagaaaagttttaaattttgtaggtcaagtaaaacccagtgaacttgtgtagatggtgggcgtcagtttgcttttcctgctctgcaagggggcagtctgctgctcctctgcctcttggcacagccattgatagggtgagatttaggtgaatgctgatgttgaagctgttttcatttcttcttggtagacattgaggctagacctgtgttacctgcttttgcccaactttgtatttaatgagatcccgtcctcatcactggaagatactgaagtgaatacatagatggatctagtgagttaggctatcttcaacaaaataagcatcttttgctgtagaactattctgacctacatttaccctaaatcatgctaatatacccactgttttcccttggagttgaagagttaatgaactcccgaagtccctaaagtagtaagtgacaacgtcaaaaccaaatgcatggcttctgactccacacacagtggattttcctcaccagctggaaaaggggtgtgtttgtgtgagagagcgtctccgagagaagagctaacggagatgaccaggacttgcactgagaaaataccaccaggacaaagcctgttttcatgagtcattgtctggttttatttctagattaaaatgtgtttacaatgtattcgccataaaggattctttaaaagaacaggagttgaatgtctcacaatgtgttaagatttatttaagctgaaagaagaatgccaagcttggtggaactctgcctttctagtcagtggacttactggctggtactgcctatccactgctgttcacctgatggttactgatggggtgatgactgtggattggactcagtgtataccagagaggttgcaggtgatactcagtgccaaaatcacttaataaggatgtaaggttctcaagtccttttttggtgttattagttttataggggaattaagaaattagattctgttctgaagtagttttccagctactaattttaacatataaacttctggccctggtttatttttataaatgaagatatgaaacactgaagtgttaaaactaacaggtgtcaaatcattgccttttctctctctttcacccctcaggggggacacagcgattgccacgcgccattggaatgtccctggccaaggagctcatattctctgcgcgagtcctcgatggcaaagaagccaaagcagtgggcttaatcagccacgttctggaacagaaccaggagggagacgcggcctacaggaaggccttggacctggcgagagagtttttacctcaggtatttctcattaaatgagtttattttttctcattttaggaaacattataacactttgactaaaacagcagtcatcttgcctatggaagaagtccctggcttgcttccaagtaaagggatgcgtgggctctgtaaaactagagcagttacacaaaataaacactatgatcctgtggaattctgatgacgctttgaagatgctccaagggtcttattgtagccacactttgataaaatatcccttgacaatgcttgtcacatgtgcacaacttcctagcaaggtgttttaatttgctcaccagctgagcactctaatggaagccatagccatggaaagaaagagtgatagggctggctgtcacactgggccaccccaagtcaaaatacattgaaatatgctgttttctagtaagggactgtagtctgttgtgccagagtggacttccattgcagtggcttcacttgaaaagtgaaaagcctgcttgaaaagcagcagttgtttgtctttctgtgtgtttgcctatggtggtgtaggcgttgttttgactccattgtgcttcctcacaactacactttcaaatctagaacatgatgcgtatggctgactcaggagtgatatcagtggccgtgcactgacagtcctgctttaagcaattctttttgtcacccgttcagatatatttttcaaatatgcctttggtctgaaatcacaagattaaagggctttaaattgagagaaagagtcttcttttgctgtgtaagcagtagtgatcttctttattcctagtggagtttgaagttttataaccccctaaccatttctagagtcaaaataatttttctctctaactcagggttgcttaactcaaacaggtttcataaccttttttgtgggctgtggatctttttgggaatgccatgagattccaaattcatgcatttgattctttttaaaaatgcatgaatgctcacatttgttcagagtcttgcatccagtttcagaaagtgttcttggcactcagcacaggagcctttgctgacaaaccagtccccactctgctggtatgcacctgctgaatcggtttttaaaaccacactgcctggcattgatgcttctggtccttcttaattaacttaggagctgttagctcttttagggaaggaccattatataatttattccccacataaggtagtgcagagccatacattcagtagatgctcaataagtatttgttggattgatggaaacagagcaaataaaaaaagatttttgccttaaaaagataagattctcactacaaacttatttattcttcccaaatatgagagaagtctctacctaaagacaaattaaaggtacaagtatcaggagagtataatctgactgaatattggtgttataacttaccttggcttaaaactttatgaccagaatatacctcagttgaaagaaaggggtgtgtttaagaaaggttatgacacagttccaattctgatgatctgcagagcccgctcctggcctcctgacatggatgttcagctctctacttcagagctccctataggcagcttattagccccttagggcctgacttgctctctctcccatgatgcttctgtggccaccatgcagcaaatgccaccaccgtccacacaccgccccgcctgagaacgtgagcactgtcctctcctctgctccctccttccactgccagtgtgtcgagccgcatcccattgtgtggttacccagccgtcatcacagtccctgtgcatgtgcctttgtcacctttcattggaaggacactccttcagaatgttgattgttaaaattaattttcctccaggtcaaacaaataagaagatgttgatgtataagaagatgttgagttacttcagaaaatatgtgactgcaaaattacatgcacgagtcaccaaatgaagtttgagtggaatcacctttatttttatgtttgttactttgttgccaaatgattagtcctccagataactgaaagcttttgtaaaatcagtatttctaggtgatatctgtattatatattacttccatttatctgagaaaaaaaggcttgtaaagaagaaaaggcactggaaatgttttaaggaggaaacaaattaaatcaagcactatttctaatagcattttgaattttcctgtttttctcatggctttctaaactttacttcccaaagtgtggtctgtggaccagcagcctgggcatttcctggcagcttgttagacgtgcagaatctcaggcccatctcagacccactgagtccacatctgcattttaacaaggaggatggggatttgtgtgcatctaggagtttgacaagcaccttttcttggtcagttgacaatgaaaatggaaaaattagaggagcacaccatttaataaaatggattgattatcatgaaaaaaatggtggtggtgtctatgatatatacaaatcacagtgggaagaattatcaataagatatttgtctaacaactatagccttggaaattgtggcctttgaaaaagatttgtaaacatgatttggaagaaaatttagataggtcaaatttaataatagaaactccttgataggaaaacatgtcttttcatgcatttatccatgtcaccatccaagagtcctttgctgtgcctgttgtttagagcctaccttgtgttttaattcaaaagagcattcagttcaaaatatagcattgaattcacatttattacccataaatggtattttaggactttaaaatgtgatccaataatgaaattccatctgagggattctggtttttctgcttggtaagagtttggcttctgcaagacacaggtaacattctccttctcacaacagatatccagttcattccttgtgactcttctgcatcctgaaagacttatgtagacttcatatttatgtgtgctgtgggagcactgcttagaggacactgttgattaatccaccatcattgctgttagttgtcaaggcgaatggaggaaatatagccagtgtctgaaggagatgatatcagaaccctaccttaatcaatagcaacagcctcatccccagcccaagcttctttcaaaacccctaattggtgtggtactgaggcaaagactacctccttttccttcctctacttaacttctaggaagtgttgctgaagaacagcaagctcacagctggacatgcactacctgctcacctttaaggatccggagtttgcagcataacaaaacatgtggaatctaaataatgtgctgatgtggttgttgcagttgctctttaattacagccttgcaaggctcagaaaattttccatctagtatctgacagccattgctggctgtgcaatggatccagtggtgggaattctgaattttactgagatatacgacataatttgcataaaaaataattgaagtctgtttctttaatttgaattttagggacctgttgcaatgagagtggcaaaattagcaattaatcaagggatggaggtaggttccttaatgcttgagtttgttttgggaatggagagtggagatttaatttaaatgaaccatgtttagacttctacattttttttaaagttctaaaatatggttgtttaaatgctactattactgaaagctactgaagttccttgcaagtacgtcatttatttcattcttacagttattgctaattcagtatcacaagcacagaattcagtaattttaccagtgccctgaagcttatgacatgctcattattcttgccatccagttaacagacagatttattggctagtagttcatagaaaaccaaaataacagggcattctgtgcatttttagcatcagtattatattatacaaaacattccaagaacagctagctctttccacctttagcttctcagtgtgccttctacaaggaggcacacgcaatgcaggtataaggtgaatccattgtgtgtcctgggggtaccccagggagatgactccaaaagagtgaaggccccaggcctgggaggagggggtggtgcacatacccatttattggacttttcatggcagttattatattttgggtaacttatgggtattttgaagaaaagtgcttccttcttggtagactaaggaacctccgcatcttcctgggctgtatagcagtaaaaagagattgactttatacagtcaatactgtataacagtaaatacagtttcataaatttgcaaaagtatttgattggtttatttaaatatttacataatggtaacaataccaatagcaaataccttatatagcccttactatgtattaagcatcgtgtgtgtgtgtgtgtgtgtgtgtcgcgacataaaggcctcacctagattaactcatttaatcctcacaatactcccatttggtgagcattataattagccccttgttcagacatgcctctttgaagcacagagaggttaaataacttccccaaggtaactcagctcccaagtgagggagtcaggacgaacccaggaagcctggttctgtgtctcatgttggtcacactctgatctgctgtactatatcaaaggattgggtgctttggggataaggttattcaatttgaatttctgttgaatataccacatttcgcaaagttatttctgctgaaatggattatgtttttattctcaggtcgatttagtaacagggttagccatagaagaagcttgttatgctcaggtatgtaatgcaatcacaaattcaatgaggatgacccttacaaattatatttaccttctgtataattcaaatgaatttcactgagcaagattacccttgcgcccattccaaaatcatacaaatgggttgaaattagttgtttctgctatttgttaccagctcttatgactgattctgttccacaggaatgcctcttgtctatataatctagaaaactcttagagtaactgagtcagtcctgggtgtgcaggagctgtctctctaggcttatgctttcttttgtgggattggtcctggcctcccactgcaatgtagagaggtagaggagagtggtgatgagcgtgtgcctgccatgcaacctggggtgagactgcttggcttttcctgaacctctgatctgtctctcctgaccactgaaagttcactaatgaaattatagttttattttttacacagtcggcccttttcatctgtaagttttgcatttgtggattcaaccaagtgtaaattgaaaatattcaggaaaaaaaaagatggttgcatctgtactgaacatgtactgacttttttccttattattccctgaacaatatagtataagaactgtgtacatgccatttacattatattaggtattataaataatctagagatgatttaaagtatacaggaggatgtgcgtaggtaatatgatatgcaattttattaatatataagggacttgagcatctgcagattttggcatctgcaggaggtcctgtaaccaatcccctgcagataactgagggatgactgcatacaaattattaggtcttcctggagaggaaaaaaaaaatgttttcccttttttgtctttctctgaaagatagaactttgttttagggcatctgaaatagcaaaaaagttttgttctacctttcctgggagttggaaactgcatgagcactcgtttaaaggagcagtatctagagtgtgactctgtgcccagcttgtatatataaatcaccacctgtcattgatgagtacgtgccatgaggaaagtgaattacaaacgtcttagaaatagcctcagagcccaaagaaaaattttaaaagcacatttggccataaattacaacttactaaatgtaaacaccagaaattattcaaggtattcttcagaccacaatggaattaaactagaaatcaataaaagaaagactgctggaaaaacccaaaatattgggtgattaaacaacatccttctaaataatgttatatgtcagagatgtcttgaggaattataaagtattttgaattaaaatgaaaatacaacttctcaaagtttgtgggatatactgaaagcagtgcttagatagaaatagcattggatgtatataatagaaaagagaaaatatctaaatcgataataaccttccaccttattaggaaactagaaaaagaagagcaaaatggggtagaggaccacttggagtaagaaggatgagtttggttacataattaggagaattgttcaggtgactgatttcaaaattttagaatgtggttctaagtagttttcttagatagtgcttgataaacttttacagttgttttaacatttttgacatatttaatattttgtttttcttagaccattccaacaaaagacagacttgaaggtcttcttgcttttaaagagaaaaggccccctcgctataaaggagaataaaaggaacagaaattcttaagatgccaatgtaataaatgtacttcctggaagtgtctttcggatccactatatgcctcagcacatggaaccttaatgaccaaagtgaagagcagattattcatacggtgtaataagcatctggaatggacccatccgtgtacttcattcaaatgtgtaaatgtcatattcattcagatttataaagctagtagtgtatagtcagaaacagaatcaaagttagatatacatttttaaatatttactgcatatgaggctttctgttaattttttaatgtgaataatttatatattgcacattctagggaataatattgattgtatgtctactgtgctgcattaagaaaataaaatttctatataccaaaaatgtgaagttataccaaataaagtttctaagtgattaatgcatacgaacagctacatatacatatatctaaacctgaaaaatgaattgatattctgagtgaaaactacctaatataaataaaattagtgaaaagaaaacatgggaatttttctcttaccccattctttttgaattgactaaatcattgcatgctggactttagaagaaacaaccctttcattgctgcttctatcaggcaacctctttacatggtcagtcctgtaatacagtattgaaggtgaagaatgaatccaaagactgaagccaaagaaccaaagcggacaggagacctagtgcagtgggacttgctgggacctcctcccagcaagtggtgtggtcgccgactggcctaggaaaggcgatgtttgcacacaaaggaggaaagaaaatggggcagccaggattggagcatggaaatggcttggggtcatggattaaagtggagactgttctctgcttccctaccctctgctatttgcctccaatttctgtaagggaaagaggtgaacttaacaaccctttgtcctaacaaacacctgccttcctacccaggccaggtcaagaagctgtaaacggcctccaggttgcatgcctgagtagccacacctggggagtaggcactggtgggagttgtgtgggacattgggaactggagaattcgctgtggaaaaaaggagaacattctgatgcctttaagtaatttgagatagctctactttacattcattttatcaaaccaccctgccttcctagtttgtgtcaggtctgagtctggtcatgccagagacaacgtccccgggagtgcccctgcagcaagcttcactgtggtacagcccagctgtgtccctaaggtgtcctcctttcacatttccatgtatcagataaacacccattttactgtggatttacatcctcattgtggcgacttcattgctatttgaaggcatgtaggcttcatttttttaattctgaaacttacattttttaacttaggaatttgaactcaacctcaattctaaaattcttataagaggcaaatgtggactggctggctgctgatgtctgtcctgacaaaggtaggcggtgtcttcactcatgtttggacactaaggtgagcgctattttctttatgacctttggtgctgaggctctgcggatttatgatgattgctcagctgatcatcatactataaagagggcttactaaaattcacatttggcactctctgtggtggtcgtatcgggtggcatgcatactaaacttgctgggctattcgttttgtgcgtgataatttgcacctaaaatgctggtggtggttttcatagccttttaaaggttgcagggccagtttgtcctatccatgacatgctaaataccactttctcttgaactgagcaggaaataattatgtcgttagggaaaaatattaagagtgtgctgtgtgagtcgtttctcttggattcatactctagtctactgtcactgatcgagcaccatttaatttcctaacaagttctgatgaagtcactggaatgtatctgaaagtaaagtcctgtagtgacttaaggtattgcagacttcatgtattatggcagagaaaagtgcctgtccaattctctgaataaatgtttgcctttctcttgattttactttcagtatcggtcttgctgctaagcagtcctgatcctcccccaagtcaagctcacagggctctggatagggccgtgctacctagggagggtcccctgcatgggctgctcctcttttctccagcacaccgcctgttggtgcacagagttggaaatgcagtagacgtatccatgtgttcagactaggttagagaaggctctcaaggaggatgagtgatcaagcacagatagaattcagaagatgaaagcaaaataaagaaaaaattttccgttatctcagagcatgaggcctactggttttgaagtaatttagtgctggttaatttctaacttgtctatgaaaggaaaggaaaagaggtctccaagtttctgaagttctgaggcaagagaaaagttctagtaatggccaaaataagagtcagattttctgagactgatttctgtaatg

SEQ ID NO: 15451 - DNA, 6760 bp, Human
ttttcttcacccaagaatctgggtgctttataagcataagcatgaaatctccctgaggatagtatttatgcatccactgagcgctcaaatatagaccatattagaagttaagcaatgggttgagtggccaaccacattttggccagtcctacaagactttctttgacctaccaaatggggtataaatgcttctcgtattctccccgccagtagggactcaaaatcttaatagctcggggtagtaaaaaggatgctaggtttgaatcttggctttaagaaaactgtgctgaggtgttttgtttgtttgagacagggtttcactctatcacccaagctggagtgcagtggcgtgatcatagctcactcccaggctgaagggatcctcccaccacagacttctgagtagctgggacgaccggtgcatgccaccatgcccggctaattttttgtacttttggtacagacagtgtttcgccatgttgtcgaggctggtctcaaactcatgagctcaaagagatccacctgcctcgacctcccaaagtgctgggattacaggcacgagccactgcgcccggccagctttttttcttttatcagaattgatattaaactatatgctgagcttccatgtccttatcttccttttggcatggctatggccatttgaaatgtgtgggatttgctaaagtgctcaacatacgttgtttccttttttagatctaagtatgtagagggctctgatttgcaatatttagaaagttcttctaagctgggaagaaaagtcaagactaagaatcattgccaacagggccgggcgcggtggctcacgcctgtactcccagcattttgggaggccgaggcaggcggatcacgaggtcaggagttcgagaccagcctggccaatatggtgaaaccccttctctaataataatacaaaaattagccgggcatggtggcgtgcgcctgtaatcccaggtactcaagaggctgaggcaggagactcacttgaacccgggaggcgaaggttgcagtgagccgacatcgtgccactgcactccatcatgggcaacacagtgagactctgtctcaaaaaaaaaaaaaaaaaaaaatcgccaataggtagggaataagttaccccctgctaaataagttacactcacctaggcaaggaaggaactcataaaccaccttctaaactgcttgccttcctccccgaagttctgtaatttagaggcggtcactaccactgcttgaacaccccttcccaagtctgtaccacaaaaggagctcttgtgtagcccagcccctccttctcaggaccccaggagcccagacacactaatggggacattagttgcttacttttccagctactgcttaagctaggcaggccatgaagaaataacggtctcagtaacctccatgctcgggatacgactcccgggaagacgtgggtgggtgcggggaatgcggactgatccctcccagcggccgttgggggctggcccacaatccctcgcgagggcgggaaaagcaatgtggtcgttgcggggggggggggtcagaaaagggggacggtcagcgggaagagccaagagactgcaactctacaaagagcacgcagattaattctaatgattgttccctgagcttttcacaccaaaataatggtaactggctagtgtgtgcccgttacgctcactactcccactcgagatcattcctattaatgactctgaggcttcacctaacaggccacggtggaggcaaggaaatgtggcgtggagaacccactgggcctggctctccgtcctatggtctccgtccatcgttttacagtcagggtgtacatttgatgaggaatctctaaatgggattttggggaatcaaaacggaatggtgcataagtgtgaaaatttacaagactgcgcaaagctgcaaggcccggagccccgtgcggccaggccgcagagccggccccttccgctttacgtctgacgtcacgccgcacgccccagcgagggcgtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaaggtaacgactcctgatggcaagctgaggcacaccggccgccgtcagcgccgcctcagtcttcgttctctcgcctcggccttcagcccagtctccgttagattctgcttcctcccacgtccatgtttacagcgtgaaagagctcctcgactccacttacaagttgtctgaatggttaggagaactgtggtcgtgaaaacatttactaattgcttttcctctggcaatgcctgctgaatgctttgaggattgtctcatttaaccctcaacccgcttacgtagattattatattcagtatatggatgagagaactgatatcttggggagcttaggtaacttttcatgctaactgggttaggaaatactggagtcagaattggttgtctaatttttgctgttccaagatccaaggggtaagggttaaatttcagaaatgcaggattttgtgtaggactagagacactaagaatgagaaagagagtagaatccccggaatcttgaggaagcatagaaagaatattctcttacgtaattaactgaaacacccaaaacctcatattccagagcattgcagatgggaaccactgcatcctgagacatacaaatatgaggctggcggtggtcacttgttgtgcacatctctctatgacatgtctggacctgtgctattcactgaagaagatggaacagaattttaagttactgcccttactgatggaaaatacagaggtttcaattcgcctctaaagaataagtctcgtggacccagccttaactgtttaagtcataccgcgcgcagactgtgtcccccaagatttgatgggctcttttttcttcaacaagttggcttttcaaagaagaaatgtgagaccctgaataataatgatcactaacaactattgactactttagatggtcttgatattctaccaagctttttacatgtatcgtctcattcccattttatagacgaaaaaaatctgagcaaaaaagaaaaagtgaagtaacttgcccaaagtcatgcagtaagtggtgccaggatttacaaacccaggcaatctaattccagcattcaggctcttgataggattttcatttcctaaatgctgtcatcaccattgtcttttattagccccatatttatggctcatattcttatcagatcaagcactgatatatcaaactgataagtgatgtcatcctcaccattatttcttcaccagcttgttttgtaattgccattttcttttctcaggccacactgtcagatgggtgaaattgtgtagtcgaggaagcataaatgtattctttaaaatgcttgtgccttgaataattgttctcattagtttggagtgatacatgaattttttacatcagttatttccatgaaaagtttttattataaataatacatgcatatgtgcttcttaaagttgtaccttgttttaggcagttaaaacatctattttcattctcatctgaaaaataatttgtataccttatgagagcgagataattatggcttcataagaccaaaagggatagtaaaaatatggtaatagtgagtacatttttatttctgcttcctgagacacttgtaggtactcagaaatgctttagttgaattgtttctgaggtaataggtaattctttatgtgatgactaagaaaacgaatacctttattaagctgaatttttttttttttttttttgagacggagtctcgcactgtcatccaggctggaatgcagtggtgcgatccaggctggagtgcagtggtgcaggttcaagtgattgtcctgcctcagcctcccaagtagctggaattataacgcgtgccaccatgcccggctaatttttgtatttttagtagagacggagtttcaccatgttggccaggctggtcttcaactcctgacctcaggtgatctggctgcctcagcctcccaaagtactgggattttaggcatgagccactgtgtccggccaaactgaaaaattaaatggttgatagaatgttgcatttttatgtttctccactcctagcatcactgttgtctacaaattaataaagacaatcgattatcatgttacacttttaaatctctaaaattagggttctttttttcttattttactttcagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatggtaaaataaagtgttctccttttaagggtgggtttaataacatattatgaaagtagtattttgtactatcgtcaggaaaccaaataagatatatatgtgctcttaattttaagtgtgtatgtgcattaaacaaaaattagcttactatttgtgttacttcattatcccttcttgataaatgtatgcaattattctgatgtgaaaaagtgtttcttttgcaaattgtactgcagtcataaggttaaacaggaagtttctgcgttattcattcctgagactatatttgaaagtcagatgtttgaaagtagatttatggctaggggtagtggctcatgcctataatcccagcactttgggaggccgaggcaggaggattgcttgagcccaggagtttgaggcctgcctgggcaacatagtgagacctcgtctctactaaaaatggaaaattagctgagtgtggtggcacatgcctgtggtcctagctacttgggaggctgaggcaggaggatagcttgagccggggaggtcaaaactgcagtgagccttaatcacatcactgggcagcagagtgagaccctatctcaaaaaaaaaagaggccggggatggtggctcacacctgtaatcccagcactttgggaggctgaggcgggtggatcacctgagatcaggagttcaagaccagcctggtcaacatggcgaaaccccatctctactaaaaataaaaaaattagccaggcatggtggttcacgcctatagtctcagctcctcgggaggctgaggcaggagaatcgcttgtacttgggaggtggaggttgcagtgagccgagatcatgccactgcactccagcttgggtgacagagcaagactctgtctcaaaagaaaaaaaaaaaaggtagatttatgtataataaggggctccattttgagaggcctggaaatgattaaaatattcttaattggctgggcgcagtggctgacgcttgtaatcccagcactttgggaggccaaggcaggcagatcatgaggtcaggagatcgagaccatcctggctaacacggtgaaaccccgtttctactaaaaaatacaaagaattagccgggcgtggtggcgggtgcttgtagtcctagctactcgggcagctgaggcaggagaatggcgtaaacctgggaggcggagcttgcagtgagcctggatcacgtcactgcactccagcctgggcgacagagcgagactccgtctcaaaacataaataaaataaaataaaatatccttaatcttggttttataggcatgccctccccgaatccagttgatttacatatagtcgattggttcacattatatctggagtcatgaagagttagacatttctgttgccttggggagtatatttacatttataaaactttagtgatacctaacttgtcattatctggagttcaaaaacactaccttagatcatcatcatgatttggttgtttgtcatctttctgttgacagtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagagggtaagttagtaaatgatcttctttttttctgtattaataaaagtaatttgcatttgtgcccatctgagacctcagcaacactccatttggaatgtgaagcctaattactggacagttaactagtgttaaactcttttactactgttacaaaatgagaaatgccacagcctggactggcttttttttgttccccttttatggccctcacttcttcctgtaggagctttgggacaaaacctatgtatgtatttcagtcatcatactccatcttatcaggtgtaagttaacggtgccggacaccttaatataagcaactgttgttaaatgctttccaatgtataaggacttccatattggttttccaaaaaccaaaggtagctttgaaaaccacgtctgaggccggatgcagtgctcatgcctgtaatcccagccctttgggaggccaaggcgggtggatcacgaggtcaggagttcaag

SEQ ID NO: 15452 - DNA, 24299 bp, Human
gattacaggcgtgccccaccacgcctggctaatttttttttggtatttttagtaaagaccgggtttcaccatgttggccaggctggtcttcaactcctgatctcaggtgatccacccgcctcagcctcccacagtgctgggattacaggtgtgagccactgcgcacagcccaaactgatcctttaaaattcaaatttaattcagctccacacatactttgtgttttggggcaaattattccagctctcttaagtctcttttatctcatctctattaacaagttgacaataatggctcctaccccagaggctgagacaaataatgttaaaactcactacaatgcttggcacacggtaggtgctccatggatgtctgctattattttttgcttttaatagtaacataatttacattactagttattattatatgctaagctctgttttaagtgcagccaagatgaagtttaactgccttgcccaaagtcaggcagctaagcagtggcactggtggactatgaacccaagcactggacttttaaccacctctcacttgcatgatcctccagttgccctcttagaaccactgtgccttctcagagacttcagctgaaatccaacttctgagaatgcttctagggttcgccagaacccgcctttgctagcctccctaggattatctcttgtgaccagcaccttcactgacagctccagtcttttttttttttttttttttttttttgagacggagtctcactctgtcacccaggctggaatgcaatggcgagatctcggctcactgcaaccttcacctcccaggtccaagtgattctcctgcctcattctcccgagtagctgaggttacaggcgcctgccactacgcctggctaatttttgtatttttagtagagacagggtttcaccatgtcggccaggctggtctcgaactcctgacctcaagtgatccgcctgcctcggccttggcccatagtgttgggattactggcgtgagcaaccgcgcccggctatcagctccagtcttaccacgattagtttttcacgtgcccagcctcaaagacttaaactctttgctcccttacggagataccctttccttcaccttgcttgctcccgttgactcctcaagaaacctttcttatgtcgggcgcagcggctcaagcctgcaatccagcactttgggaggccgaggcgggcggatcacttgagcccaggagttcgagaccagcctcgctaacatggtgaaaccccattctactaaaaatacaaaaattagccgggcttggtggcgcgggcctgcagtcccagctactcgggaggctgaggtaggagaatcgcttgaacccgggagacggaggttgcagtgagcagagatcgcgccgctgcactccagcctgggagacagagcgagacttggtctcagaaaaataaaacaaaacaaagaaaaacaaaactttacttgacaacccaacgaccactaccactacagccgccctaggactcccgctctctgaggtcctacagcacttcgcatttccctcaacgccgcactgagaactctgcattgtgtactcgtctgtcaccaatctgcgagttacaaagcagagactaacttatttggtttagcatttaataggcacataatcaacatttactgttcaattgaaacaaaattaaaattgggcgctgtctctatctttatttgtgatcggccctaactgcactggcaatcttttccgtttttttgttttctgttttccattcgcatgccccttagcgtacctggggctccggctcctttacaaatgaaacccaaagtgctccgcaagcacagccagcgaaagcgaaaaactctgaaacggacaagatggctgccacctcttcgcgcctcttagtcccacccactcagggcggaggtctgcgtcatgtgaccctccccttcttggctccgcctcctaccgcagtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtatcctttgtcggtttgaagtcgaggtcgcgttggggtgccggttgttggggcctgggactaggaggcctggatttggcttacggcgtggagcgtttgtatttaggcgtctgcgtgggtggcctggtggctgggattggacttgggaaggcttctaggaaaatggggttccgaggtcgacaggcttttgcagttgtgggtcgtgtgactctgtgactcaggaggatcttgttcggtgcgaattttggactccgggaggcggcctggacccctccgccagggacagtgtcccctagggactattcagccaccttccgttgttttggtgacgattcaacaagggacttttcttcgagtgcgataggcttattactttcatggagggttggggacagcttcacagtctgtcacccactttttctgtttttatttactttatgtgtgttttgtgtttattttttcgaattggcggtttagtaaagaaccaagttagtcaaccctggtttcgaacctttttttttttttttttcttttcggggcgggaggagaactagcttccgtgtctcacccagaggcgccttaatcttcaggaagcgttctcacagggcggagtttctgttacccaactttgtaggactaaaaagtgcctatcttattaggaaaactcttactacagtgtggtattaatgctttttctggaagcgttaatattctttacattaaaattgattttatttactgttttgtacgtaaaggcggcttgttacagtactgcgtttatgtaacagttttaaaaatagcttaaatacggttacgaattttgtaatgtgattttaggaaaatctgagtagtgaggtaagaattctgttttattgatgtaagaattctgctttattgattttattgatctgtgaatttaaatacattgcttggcaacataaattcatacggaattggaaacaactttatggattgttcattcgaaattatgtgattattgttcaccatatagttactcttagattctaaatattgctaaattcctaatccagttattgctatcgtcttcatatctagtgaagtaattgtcttgacagaaccttagggatttcttaactgaactctttcctgtcctcagtgtgcatttgtaaatgttgaaatatttataacaaaagtttcaccgacatctctgttaaacacaggaatttgacaaagtatattgctgattattgagatgtgttttttggggtggtgaagagagctggccttctaggaaattgaaaatactgaaataacatggcaagtgtagtccctaattgtgtaataaatataaaaagcagagtttctatacagtaccattttggttttagctgttcccatattgtaatgttatccatatgtttttattataggcagtgtcatcattaggctgtctttgtgccttaacagtattgatcaggtattgtaatagagattttgatgatgagaagatccttattcagcaccaaaaagcaaagcattttaaatgccatatatgtcacaagaaattgtatacaggacctggcttagctattcattgcatgcaggtaaggatttttcttctgtatttattgtccgcttgtgatttggaaacaacttgaaagaataatcttttttatttttttgagtttcggtcttgtcgcccaagctggagtgcagtggtgcaatctcggcccactgcaacctctgcctctcgggttcaagctattcttctgcctcagcctccggagtagttgggactacaggcagccgccaccatgcccggctaattttttgtatttttagtagagactggggtttcaccatgttggccaggctggtctcgaactcctgacctcaggtgatccacccacctgggcctcccagagtgctgggattacaggcgtgagccaccgcgcctggccgaaagaataatcatttatttctctgacaactgtagttttgttttttttttgttcacttacttactgcaaaagataagatagccaatcagcattaaaaaaaacaaaaaatttgttcgatagccatcaagacaataaacaaaactggctttttatgtttaaagagggtttgtatttgtatttagtttgatagtaccttactaggttagattggtaacatatcgaaatcacaaaatatttcctgagtacttggagcagagaacaaggatcagcgatttagattttgtaggtggtctggccttaagaattaatacttaattagcagtcattactcactgccattgaaggatctgttattatctgtagcttggggctaggctaatttcagcaatttatttattggacttcttttggaatggcagcattgtactttttgcttttgtttttaagagatggccttgctctgtggcccaggctggattgcagtgacatggttatggctcactgcagcctcatattcctgggttctagccgtcttcctgcctcgttctcccaaagccctgggattatgggcatgagccattgtgccagcccagaattgtatttcatttaataatttctaggtttcggctgggcgcggtggctcacgcctgtaatcccagcgctttgggaggccaaggtgggcggatcacaaggtcaggagttcaagacagcctgaccaacatggtgaaaccccatctctactaaagatacaaaaattagccgggtgtggtggcatgggcctgtaatcctggctactggggaggctgaggcaagagaatcatttgaaccctggaggcagaggttgcagtgagctgagatggtgccactgcattccagcctgggcaacagggtgagactctgtctcaataataataataatgacaataatttctaggtttttaaagttcttttaataaatagcgagagcattgtaatttatattttttaagatctagtaagtaccttcatgtctcattcaacattattctactttgcttagtcctagagctgtctgaatttttgctaaattagaccttacagaaatatgagatgagcaaataccaaatcattggaaactactatgggtgggaggtagggagacgtgatttctccaggtttaaagataaatttatatagatccttttcactccagatactttaacaataatttaatattcattttaaaatgttgaccagatgtggtggctcacgcctgtaatcccagcactttgggaggccgaggctggtggatcacctgaggtcagggtttcaagaccagcctgaccaacgtggtgaaaccccatctctacaaataccaaaaattagctgggcatggtggcaggcacatgtagtcctggctacgggggcggggggagggctgggggcggggggcgcgaggcgggtgctgagacaggagaatcacttgaacccgggaggcagagtttgcggtgagctgagtttgtgccactgcactccagcctgggtgacagagactctgtctccaaaaaaaaaaaaaaaaaaaaaaaaattgttagagaacctactacatgttagactcacagctgttcactgttgcagccattagttacatgtggctatttaaaatgatataaatatctaaatgctcagtttctctgtcaagtagctaacttatattgggtagtgtggataagaacattttgttttgattgattgacagggtctcattctgttgtccaggctggagtgcagatcatagctcaccgcaactttgaactcccttactcaaatgatccttccaccttagcctcctgagtacctgggacaacaattgtgtaccaccatacctggctatttttaaaattttatttttgtagagacagggtctcactatgttgcacaggctggtcgcccaactcccaggatcaatcgattctcccactcggcctcccaaagtgctggaattacagttgtgagccactgagcccggccattttctttaattctgaatgaaataggggtttaaatagagatgtatgctctgtcacttttttttttgttttattttgaaacggagttttgctctgtcttgtgctcactgcagcctccgcctcctgggcttaagtgattcttgtgcatcagccttccaaatagctaggattacaggcatgcaccaccgtgcctgcctgagttgtatttttagtagagatggggcttcaccacgttggccagggtggtcttgaactcctggcctcaagtgatcccatctactttggcctcccaaagtgctgggattacaggcataagtcactgcagctggcctctattagacttttttttttttcttgagacggagtctctttcgtccaggctggagtgcagtgggcgtgatctcggctcaccgcagcctctgccctccgggttcaagcaattctcctgcctcagcctctcgagtagctgggattacagacgcctgccattgtgcctagctaattgttttgtatttttagtagagatggggtttcaccatcttggccaggctggtcttgaactcctgacctcctgatccaccttccttggcctcccaaagtgttgggattacaggcgtgagccactgcgcccagcctgtaagactttttaaaaggatttttctggctgcagggttgaaagtaaagtgcagagtacggtgagaccactttagaagacttagaatattccagacaagaggagatggtgacagagaccagagtttgataggttagatatggggtataagaaaaagtgaggagttaagggtggtctcaagatgttgatctcaagatggtctggctaggtgcggtggctcacgcctgtaatcagcactttggtaggccgagatggactaatcacttgatcctaatagttcgagactagcctgggcaatataatgagaccctgtctctacaaaaaatgcaaagttgggcatggcggcacgtgcctgtgtcccagctactcaggaggctgaggcaggaggatcgcttgagctggggaggacgagactgcagtgagccgtgatagcactactcagctccaacttgggctacaagagtgaaaccctgtctcaaaaatgtttattttgagcatatgacgagatgtgaaaagctacagggataataggcttaagaatgagaataagggagtcctgtgttaattttgagtgtaggtatgtttgaggtctattaaatatccagatgaaaaggttaccgaagcagtttgatgtacaagtcaggagttcatagaaattaaaacaggagatagaaatttggacgcatacaatgtaagggtggctagtttaagccgcgctaccagatgtcctttgtaaggactgtagtgtggttggaaattaggtgctctctgctctaggccacttccaacatttgaaggtcaggagattaaaaggaatcgtctaaggagatgaaaggtaggaaaaccaagagtagtgccctggaagtcaatgacgtgtttcaaggagtgagttatttaactgagtcaaatgctggttcagtaagagtactgagactgggttaataaggtcattggtgacttgacaaagagcgatttccaagagtggtgagggtgaagtgtgattacggtgctttgaagagacagggagaggaagcgaaggcattcttagggagttgcactttatgaagagcagagaagtggagtggaagcttcaaggttagttgagaaacttagtaacattattgtctgagtgcctttatttagtcctattttcacagcaacctgtgagatagacctggcagttaaatcataccaattttatagatgataaaccctaagacattattagtaagttaggtggttccctgcagtttctcatcagtgcttgctcctgtcttttcaaccaagacgctatgactttgcttggcagggtcccaagaaatctaattctggctgtaccataatagatacacctttaattgttgcccttctcaaaaatgtagtgaagattagtgtgtatgtgaatgtaattgtttatagaatgcctgttgcatcatctctttattaagaatagcaaaatattccaaaaaaccttaggaaacggcaattaagtcacttgttaagccgctttatccataaatattttaattgcaatataaggaatagcttttaacaatcagatattaagataatttctgagtttgatttgcatgccccagtttcaaatctttaagtgagatacattgctaagaagaaaatacttagctttttgtagttacttttctgttcgtacatgaaaatgtcttaggaggaaagaaaaaatgagtattatttgggcaaatatatctaagtcattagcctaaatgagtgcttctcaaacttgagcatgcattagcatttccagaaaggcttgatagtctaggcaaaatactttgacatctacttcagcaaaatggcttgctgaagaaaccaagactggcagggatattacattattggcaaaagttacccagatctgaagattagaagcgcttatgtagcaaaacaatataatgaaaaaaaatcccagattttcagtgtgttgcaataaacatgttaaagtgcctcagggctgggcatggtggctcacctctgtaacccagcactttaggacactgaggtgggtggatcccttgagttcaggagtttgagagcagcctggggaacataacaaaactacctcgccacagaaaatacaaaaattagccaggcatggcggcacgcacctgtagtcccagttacttgggaggctgaggtgggagggtggcttgagcttgggaggcggaggttgcagtgaactgagataatggcactgtactcctgcttgggtggcagagtgagaccctgtcttaaaaaaaaaaaaaagtaaaatgcctcacgtaactcattagttacaagtgatactgattgcaaatgtaacttttctagtttgtaaccagaggcttgtctcaagatctatacttagaaaatttgctattctaattattattattattattattattattattattatttttttttttttttttttttgagacagaatctcgctctcttgcccaggctagagtgccgtggcacggtctcggctcactgtaacctctgcctcccgtgttcaagcgattcttctgcctcagcctcctgagtagctgggattacaggcacgtgccaccatgcccggctaatttttgtatttttagtagagatggggtttcaccatgttggtcaggctggtctcgaactcttgacctcgtgatccgcccgcctcggcctcccaaagtgctgggattacaggcgtgagccgccccacctgactttttattttttatttattttttttggagacagtctctcagtatctgcccaggctggagtgctcactgcaacctctgcctcccaggttcaagtgattctcatgcctcagcctgtcgagtgactgggattatgggtgtgcaccaccacgccctgctaattttttttttgttttttttgagggactctccctctcacgcaggctggattgcagtggtgtgacctctgctcacttcaagtgattctgcctcctcagcctccccagtagctgggattacaggcagaccccaccacacccgactaattttttgtatttttagtcgggacagggttttgccacgttggccaggctggtctcaaactcctgacctcaggtgatccacccgtcttggcctcccaagtgctgggattacagatgtgagccacctcgcctggctatattctaattcttaatatgaggctgtttcataatctttacttaattcacacttgaaacatccctgatttggataggactactagttactgctaataattgaagtaatcaagattatatggtaaacttgaaagaatgtttattgaatgcttactgtatgttagacatctcgccaagtgttttttatatacagtatttaatcctaaaaacaactctagaagttagctattatataggtgaagtaaactgaggcttagaagttcactgacatgcttaatgtcacagagctagtgaatggcaaaactgggaattggctctacatggcctcactatagaacatttattctttatactaagcagtctttgattaacttggaattattcttaaaaaagacttttatctaatggaaattgttgttgttaggtacataaagaaacaatagatgccgtaccaaatgcaatacctggaagaacagacatagagttggaaatatatggtatggaaggtattccagaaaaagacatggatgaaagacgacgacttcttgaacagaaaacacaaggtaaatattgggataagttttattttatttatttattttttttaatttttttttttttgagacagaggcttactctgtccagccgaggctggagtacagtggtgtgatctgggctctctgcatcttctgcctccggggtttaagtgattgtttgtttgtttttttcttttttgaggtggagtcttgctctgttgccaggctggagtgcagtagcatgatctcggctcattgcactgcaacctctgcttcccaggttcaagccattctcttgacttggcctcctgagtagctggcactacaggcatgcactaccacgcccggctagtttttgtgtttttagtagatacggggttttaccatgttggtcaggctggtctcgaactccagaccctaagtggtgatttgcccacttttgcctcgcaaagtgctgggattacaggcgcaagccaccacacccagctgatttttgtttgtttttgtttttgttttgagatggagtctcactctgttgcccaggctggagtgcagaggtgcgatctcggcttaccacaacctccgcttcccaggttcaagcaattctcctgcctcagccttcggagtagctgggattagaggtgtgtgccaccacacctggctaatttttgtgtttttagtagagacagggtttcaccatgttggtcaggctggtcttgaactcctgacctcgtgatctgcccgcctcggcctcccaaagtgctgggattacagatgtgagtcaccacacctggcctagtttttatattttttagtagaaacggggtttcaccatgttggtcaggctggtctcaaactcctgacctcaagcaatctacctgctgaggcctccctaagtgctgggattacaggtgtgagccaccatctctctccccttgtgataatattcttttttcagcctcacttaagcccagagttagtattttcaattataaatttaatggtagggtagttggagtggctcacacctgtaatcccagcactatgggcaggcagtgcaggaaaattgcttgagcccagaaattgggagaccaacctaggcaatagagaatgacaccctgtctttacaaaaaaaaaatacaaaaattagccgggtgtggtggcacatgcctatagtctaagctgaggtgggaggatctcttgagcccaaggggttgaggcttcagtgagctgtgaattctccagtctgggcaacagagtgagatcctatttagataaatcgattgattgatcacttgatagatagataaaattgaatggtagatgatagatttatttggaatttaaaatttgagctctgtttttgaagacatacttgatttgtatatatgcagtaccatttggatcattccattttcttatattattattcataattgaattccaaatagaattagcaagtgttaaggcatatgaaaatgaaggactcctataatttcagtgctttaggtagctgaggccgtaggatcacttgaggccaaaagttcaagacctcacctttaccccccccccaaaaaaaaaaaaaaaaagcccagtgtggtggcatgtgtctgcagtcccagctacttgggagactgtggcgggaggatcgcttcagcccaggagtttgagagtgcagtgagctgcagtcgtgccactgctgtacagcctgcatcgcagagcaagactttactaaaaatttaaaagaaaaaatactgatttaggataatcattttacctttcataggacagggaaagaacgttaatcttgtttaatatagggcgaaaacacatttgaagaacatagagcagtattaattgaatttttggggaagaaaaatctcatgaagtaattttacccatatatgtatttttaaatattgaatgttgtaaataaactttcttagtttttactctatggaaataattttttttttttaacagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggtagcacataggattgcttaaaatctaacatttttaggacattattgatattgtatcgaagtattactttcttccctctaactctttaatatttgttattattttgattgaaattcttgcttgtaggcatacctccattaatgccaggtgttcctcctctgatgccaggaatgccaccagttatgccaggcatgccacctgggtaagaaaattcttttaattgccctgtaggcttgtgcctagtaatgatctttttcaatttggatgttatatgaatgaaatgttactttccattttttgcttctagaaggtatgggctctatatatcttgtctaataaagggatcaaccagtaaatttaaggaatataaatttgcctctgagtaatagatttttgggttttagggtatatgtaagcaaccatctacttcaattgcatttactgtgattaaagtagttggttatttatagatttgcgtttctgagattcagaattatctgtgacactttgtagttgtgacaagaagcagagaaactctgtaaatgatttatttgtcaaagcatcaaaactaaaatgaatatgaggtgcttgtgcccatcacttttacttaaatattgttggatgtgagaggtatacaatacactttcccactgtattttgaaaatcacagttagattttgattttgtcatacattttcacagattgcatcatcagagaaaatacacccagtcattttgcggtgaaaacatgtaagcatctcattcataatgtaattcaggaggtataatcatactgtcatttttttatgtgtgtgtttaatggtatctattcagttgacttcagaaattttctaaccttcctcactaaaacttgcaagctaattaacacaggtctcttaaagaaggaaaataaaacatcttttaggaaacggtaatagacccatataaacatacttcaaatgtgcagtgattttctccaaactattgaaagtaatgggacctgttaataagggttagtatttaagaaagactatattctatgaaattacatgctttattattataggatgtaatggaattttctaatctattaatagaagttaatcttctgataaaaattttaaatcaagaactgaatttacccacaaaaatttaaaaaatttgaaagaaaattgaccaatttatcattttttaagtgaattggacactgatatttgaaggtgagctcttttaggggaaaaaataagtgggttgtgtttttaagtcatggtttagtggtaggtagttattgtaaataggccatctggttttacttttgagtgtctttaattttggtggtagtatttcctttctctaaaaaaaaaaagtgtgtgtgtgtgtgtgtgtgtgtatatgtatgtatttgacacagggtctcttactctgtcgcccagactacagtgcagtggcgcagtcacagcttactgcagccttgacctcctgggctcaagtgatcctcccacctcagccctctgagtatctgggactacaggcgcacactactgcacccagctaatgtttaaaatttttgcttttttaaaaagatatggtctcactttttgcccagcctggtttgaactcctgagttcaagcagtccttgagccttggcctctcaaaacttctgggattataggcatgagctgctgcacctagccaaataaaaaatctcatttcacagggtacattcattcaatctttttcttttcaaaatccaacacaactctgaaatagagatttcttctttttctttaatactctgtggatattttccaagtggaaaaagtggtgaatttgctttcccattacacatattttagatgaggcctcttgtacatattgagagtatatttgttctcaaatgactttaaatgttttgtcaacattttttttttattggtaaaccaaagagtttgctgggttttagacaatttattttgataggattgttacagtgtgttgtgtgttctttcagctttgattcatttcaatattagaggtcagattcaagtcttctatctagtgttgtttcaggctttagccagaatattttttaatggtttatgctgttcattaacttactgtttcttgaaatttgctttctaatagaatgatgccaatgggtggaatgatgccacctggaccaggaataccacctctgatgcctggaatgccaccaggtatatgttagataatttcattttaatatgatgtacaggctttatttctaagtttttttagacgtctgtgggcattagtataatgaaatttaaaaatttttgaaagttgcaagttcctgtgagaagtgttatatggacccttttttaaaaaatgtattttggtagatatctcggctcactgcaacctctgcctcacaggttcaggcgattcttctgcctcagcctcctgagtagctgggattacaggcgcctgctaccacacctggctaatttttgtgtatttagtagagacggggttttaccatgttgaccaggttggtcttgaacttctgacctcaggtgatccacccaccttggcctcccaaagtgctgggattacaggtgtgagccaccacgcctggctggccctttcttgaagtttgaaatagatgataggtttcaaagcagccaaagtgagtcacggcctatgtgctgaatctcacatacttagagcgcttgtatttgttaggaatgttttagacaagtaatagagaaatccaacaaactttttttttttttttttttttgagatggaatctcgctctgtcacccaggctggagcatgatctcggctcactgcaacctctgcttccggggttcaagtgattctcctgcctcagcctcccgagtagctgggagtacaggcgcccactaccacgcctggctcatttttgtatttttagtagagatggggtttcgccatgtcggccagctggtctcaaactcctgacctcaggttatccgcctgccttggcctcccgaagtgctgggattacaggcgtgagccactgtgcccagccccaacaaactgtattaaacggtgtaggcattcattgtctcagtcaacaaaaaagtggtagattcagtggctcaatgatatttattaacccatgctttttttgactttgctcaccttagctttttttcctcagaaatgtcatttggttataagacagctcagacaagaaggggtgtcggttgtagtgcactctccattttcttttcttcttttttttttttgagacagggtgttggtctgatactcgtgctgatgtgccgtggcacgatcatagctcactgcagccgcagcctcccaaagtgctgggattacaggtgtgagtgagcctcagcacctggcctcctttttcttctatttggaaccaaaataactttcccagaagctctttagctccttacgtattatgctgtgagggaacctgggaaattaagtatatagaatttggcctataaagcaggaaatacagcacaaggaaagggatttggttggccagcaagatgtgccacacgaggctattagttgtttttttttcttttttttttttttgagatggagttttgctctgttgcccaggctggagagcagtggtgtgatttcagctcaccacaacatccgcctcctgggttcaagcgattttctcctgcctcagcctcctgagtagctgggattacaggagtgtgccaccccacccgacaaattgttgtatttttaatagagatggggtttcaccatgttggtcaggctggtctcgaactcctgatctcgtgatccatctgcctcggcctcccaaagtgctgggattatagtcgtgagccactgtgcccggccctagcctgcgttttatgttggtgtgtttgcaatccatagcatatttagagtactgaaatgatagttgatgtaaatggacacaggaaaaataaagcatcaacaaactatgaataattgccaggcagttccatatacattatgttgtggtacatatttaggtatttaaaagaatacagaataataattgatgttcatttgagaatgtgaagtcattaaaagttttgtcatgttgaggaagtttaaagtatgtagtagtgatgtgtttaactttggaaaagtttttattgttcatgatatttgattcatcagtttttactgtaatttgcactagggttcagggagtatttaaatatctgtcttgtagctgattgaaataattcttttatatattgcaagaagtttgctaaatcagtaggaccagtaagcataattgccaaatgttttgcccatgcagcagggtctagtgttatcttccacttcgtaaaattctgaagcagtacaaaggaagggaaaatttaaggtaagaatgttgcatggggcaaatgcctaagttccttggatttagtcgagtcattgagcagttaattgttaataactttgtagtatagaagcgtttttttccacactaaatttttcagtgactcaatttccccaaacatttcttctctgcaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacaggtaaggtgaaaatcctgaaaaggagtgcacttatatttaaagataaagtacagttgtttacagaagtctttgaaattttcataggtcaatttttttgtttataatatttttaatattatttattaaatatactaaaaggtggcttatccacttccatgtttacacactgatttcctctacccataaaaggttgaacggagccaaagttagtatgttactttttcatagctgtgaaccctatttattcttagtttttttttttttttttttaagctaatgaaagtttagtatctggagcgtttagaagttttcctttactgactaaactgaatggaaggacaccaaagtcaaagattagcattcttaagacggtagcaaatcatttgtcaggctctgcctctagtacggaacagtgatgagctacaatgccgcacttgtgctaaaatggcgtaatttaatggcttttgacctaggcacactggtatttcttactggtcttttttcaaagcttttaaaagtcttttttccagagcataagtgaaagatgcttctgttctatatggtatacacatgatggttaacacctttgctttttttcctagtttcattgagaagcagattcagatttaatttattcagaatttagatcgggatgtatgtttattcattttcttttttagattatcccttagatttttttaaattgcttttttctgtttgtgggtgctaaattaaaagcattttctttaagtgccttttgttaagcacattaacctagcttttatggtgggtggaaattttatgtattgagagatgtaaaacttttggcaaaaatcttttgtagagaatcattgatacagaattggattgaagtgtcagtatttgtacatcgttattctcagtttcaggtatcattcttgaaataatgcaaaacagtagttttagaaaagaaactagttaactaggttttattgatttagaattaaaattttgaggctcatactttaattttgtttattgtaaatgcattaactgcctgccttttaaaataagtgacatttgattgcattaaattttgcatttacaaatatgcaatctactaaaaagtctaccacatggcttattttgacccatttgtttggagacttttcattgtttcctttcttttatgctacagatggggacacctgtcacaagctcaagtacagcttcatccaattcagaaagtctgtctgcatcttctaaagctctgtttcctagcacagcacaagtacgcaggaagttgcagtttaaaattgttaaaatggctttataacttaaccctttggaccctacttaaaaaatgaatatttttccaaaaatatactgtgtttacttttttaaagcaaaattaatgctatataagtcaaatggtatttaaaaatttgaattcatactaaacaaaactaccccgaactcctgtggttctaaagggttaaaagcatgtaagcagtaaatgcattatagtggccaatggttagcctgatgcatgattaagctattttgatttaatgctgtttaatgcatcacatttaatgtaagaaaatttaatactgctttggttctaaagttggcctagtctacatgttttagatgtgtggtattatgaaaagtaacatatttgttactgataacttgctactttaaaagatcctgctaaattaactcctttgtccatgataattatccagccattgttaatttggaggggattatatatatatatatatatatatatatatatatatatatatatataaagaatactactaaaggatgtatttttattgtgtcaccatttacactgttcatgttatagttagtaacgagtttaaactcatattctgtagttttttttttagctgtttgatagattaataactaattaatagaacattaaaaatagaacacatgctattctaagatactgtatttcagcaatctggaataaatacaaagcattgtaaatttaatttttggtgaggaggtagaagacatctaacaagttaaatatgcagtcttatttccactgctgtgttgtgggtgtgactttaacctagcatcttttgatatttttatgggttatcttgaattttgtggaatgtttatcacattaactttgtattaatttcatttaaagtttggtcctttatttaatgttgatgccttgttttaagttaaactgttgtagatatagttaatttaaggttttgaagtttcgttgatgaagtattgtattttacaggctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggtaagttgcttttagttttctacgagcagcatttgatttaaagccattatagcagttcgtccctttaaaataagtgttcatttgtactcagatggtctgtgatctggtttaatgctcactaagtggtttttgccattctgattcttaagaaatcataaaatacttaaagtggacagatattgcatgttttggtcttagatggtttctctccccttcctccagactgtttctaaaagaagacagtaagtcaggttcttaactctcttaaaaatcattttagttaaacataagtttgcatatgttaattgaataaacgttaagtgtgaagtagaatctgcagatcccttaagtcccatataaatgaatgaattttgatacaaagttaatgtttagaatgttgataatggccaggtgtggtggctcacgcctataattccagcactttgggaggccaagacaggcagatcacttgatcaggagttcaagaccagcctggccaacatggtgaaacctcatccatacaaaaattagcagtgtgtagtggcgggcacctgtaatcccagctactcgggaggctgaggcgggatcatcagttgaacttgggaggcggaggttgcgttgagccaagattgcaccactgcactccagcctgggcaacagagcaagactccatctcaaaaaaaaaaaaaagaaaaaaatggaatgttggccgggcgcgcagtggctcacaccggtaatcccagcactttgggaggccgaggcgggtggatcacctgagggtcgggagttcgagaccagcctgaccattgtggagaaaccccatctctcctaaaaatacagaattagccgggcgtggcggtgcatgcctgtaatcccagctactccggaggctgaggcaggagaatttcttgaacccgggaggcggaggttgtggtgagctgagaccaggccattgcactccagcctggacaatgagtgaaaccccgtctcaaaaaaaaaaagaatgttaataacaatacttcattagatagtttcttgttgaagcaatttgtaattcccggaaagttgttagccatgcttcaagtttacaaataggtgaagttttaaggtatctagagtttaagtagttggattggtttgtctggcaaaagtaaatagttgggatgtaagggtaaatttttgaaaattactcttaacgttgtaagattttagatgcatgcctttatgcttggtgagcctctgcattcgagtatttagccctgcgcttatttttattcccaggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtattcctctttttatgtttttcatatttagtggattttctaagttcacgcataaaatattaaatttatctgcagcatacgttgcacttaaaagtacaatgcgttaacaatctatttttttgtgtttgaaattcttgattttaggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgcagttttgatatatcattggattctgtctttgagttgtaggttatttcttagctgcatgttttaaactgaatttgcatagagttgtatgttaatgtttcagttaagagaaaaacttaagatacatgagtcattacataatgggtatgaaatctttataatcacccttccaccctctatggtgtcagtacacatcacgtgtcatagatacttaaaatgtaaatgttaacacttttccttcctgctgagatgtttagagcctagtgccagacccattcatttccttttgattatttttgagactcagtactgcatggacctcagaagcttttcaggtgcaaacttctagaagcttaggtgcatgcagtaatagcttcttgtgctgttaatgggttattatatattattctaagtgtaatgctgagaatctaaatgtgtctctgttgggatggttaacagatgaattggcaatttttattatgttcctggaagattacattattcatttgagtaccttctgttattaagcctaggtagccttactgtgcaactttttatttatccttggaaattttgaatgttgtgttcttacagagagcttttctgtagagatgactgctattcaatattttgtgttgcaacctcttaaaataatagctcttgttgacctttttgggatctgtttttctgatcttttgcagggtagttttatgattttttaggcatcaaataacctatgcaaagtattaatataatgaactcaagttgagtttttctcattataaagttaagacttctaagaaaatggtaacatttctttataactttcctgtgaaggtatagataaaacacatgaagtctgaagttgtatggaaaaaagggctttaactttgaaggaaaatatattgaaaagtgatttagccatcacaaaagagttcgtatttatgtgacagatgaaagtcatacctttaagcaaaacattgcaagtattataaagctgaatgctattttaactcacattggctgggtgcagtggctcacgcctgtaatcccagccctctggaaggctgagatgggaggattgcttgagtccaggagtttgagaccagcctggccaacatggcaaaaccccatctgtacaaaacatttaaaaattagccaggcgcgttagtgtgtgtctgtggtcccagctgctcaagaggctgaggaaggaggttcttcctccttccgaggctgcggtgagctatgttcactccagcctgggcaacagagcgagactctgtcaaaaaataaattaaaatatctgattatctggcttcaatgattttggctcctgtgcttgtggtaccatagtggtacaaaaattttcatagtttgaaaataaaacaggtattttgccagtaatgtatttctttctgccagcagccaagtcccaaaccactttcccctctgaacctctgcttacctaaatggtttcaaaattaatacatgctgctttgatttggcagcacacttaatatactgctgaaggaaaacttgtgttgaaagtctttaagataaaaatggtgtgataggccgggcgcagtggctcacgcctgtaatcccagcactttgggaggcccaggcgggtggatcatgaggtcaggagatggagaccatcctggctaacacggtgaaaccccgtttctactaaaaatacaaaaaattagctgggcgtagttgcggatgcctgtagtcccaactactctggagaccgaggcaggagaatggcgtgaacccgggaggcatagcttgcagtgagcggagatcacaccactgcactctagcctggacgacagattgagactccgtctcaaaaaaaaaaaatgctgtgattaaatttagaataattaagtaaggggtgctctcccaaattctcaggaatttcatgtatacggttattgacaaactgcaatagggttagtagacctgtttcagaaattatgtgaagctttatttgcattt

SEQ ID NO: 15453 - DNA, 40493 bp, Human
  misc_feature (1)...(40493): n = A,T,C or G
tgcacacatgccaaactcctcaagagacatgtctagttcatctcaaaactttcaccatgatgatcacacagggatgggctcataagtttccacagtcagcaagactcactagcttgggagaaagatctggcagacactcctagtcttttacagtgggggtccccaaccctgggccaaggaccactactggtcagtggcctgttaggaatcaggcctcacagcaggaggtgagcggctggggagccagcattactgcctgagctccgccccctgtcagatcagctgcagcattatattctcataggaggcaaaccctattgtgaactgagcatgccagggatttaggttgcctgctccttatgagaatctaatgcctgatgatctgaggtggaacggtttcatcccaaaaccatcccccctcctcacatccgtggaaaaattgtcttccacaaaactggtccctggtgccaaaaatgttggggtccactgttttatggtactccctctttgtagtgaggccagcactctatcctctcctatgatttcttctaaagcctcccacctcagcctcccaagtagctgagactacaggcgtgcgccaccatgcccggataatttttgtatttttagtagagtcgggggtctatgttgcccaggctagtctcaaactcctgggctcaagcgatatgcccacctcgccctcccaaagtgctgggattacaggcatgagccaccgcgccttgctagaagccatttaatccaactctccatcaaagtcatgaatcctgtttacaacaacctgatgagatgtcaactacttttcacgtgaacacacccaggaattaggaaggcattccctaaccggcagctcttatctctcccaatcacgatttgagcttcaccaaataactcaaacccctgtttcctcacatattaaaggggagtaaatatctgctttacagaacattgttgggagaataaaaggagatagaggaatataaatggcctaatccacttacagaggagggtgtgcaatgttagtcccctttttgcctccttttatgggacagcacattccatttttggatcgtcatcacctagagaaaggtcttccttaatactgaattgtctttgtatccttttagcacctttcttaagtttaaccctaagtggtctcatagaatgtcatttttccgtccacacgacgtcttcactgatatctgtgactttagttgaaggggctgaagatattgggaagaataattcaattttttccttcctccgtccctccctccctcccttccttccttcctttttttttttttttctttgagctggggagctgggtgaggcttctgtggattcccaagaggtatttgtggcgtgaatggagcaaaggtgatgtttcacttcatcacgtccagcactgtcccaaggttaaatgggcgcgtgaggacagttttctccggtcctggcgggtttgcccacctgccggccagcgttctgcgggagtcaagcctggaaagcgtgtgtgcggcgcacaggcgtcagacactggaacgcattcgaatggtgctattctttgccacatagcgagcactttataaggtcacttatcgtcccgaatgaatggttaaatcgtggaagccgcaaagaaagccacgcagctttgactcaatacctagcccagtactcaggaacccctctcaggggtgcgcgagcggggccggaatcaagaagcctcttttggggtgggcggggaccgatctagagctcccactgcggggcaccgcctcttttcctcgccggccgcccgctaggaggcgctggggagcttgcagcccacctgcgaggcggtcccgctctccccacccctcagcccgcgcccggcggagagactacaactcccggagtgctctgggaacggagccacgggagctacaggcggagggacccgagggcgggctttccgggtgtgtgtttccggcgtcggcggccgcggccggggacggtgtgagagcggtaagatggcggcggcggcggtggtggagttccagagagcccagtctctactcagcaccgaccgggaggcctccatcgacatcctccactccatcggtaaaggtcgccgcgccgcctccccggccccgccggcccagctcggcttatgtcggtcggcggcagcggagaggggcccggctagccggctctgatgctgctgactcactgtgtgaggggggccgggccgggggcgcaggccgctcggagctccccagagcctcccaggtctcactcttgtgggagggcttgaggcaatccccgggtcccctcgccggctgctgactcacggggggctcagcgtagggtgggagagtgggccgagccgggcccccggggatccctccctagccatgtccccggctctggcccgcacgagctggtctgggacccggagcagtgccggccggcgtgcttgtcacggactggtcctagagtctctacttgaaaggccttggcgaaaccagctctggacaggcatttcccgccgttgtaatcagcacagcctgctccgggtgggagcgcgagcgcttgctcttctctgggagtttccttccacgggacgctgggagctgctactcctcagccccacggcagaaagctccactaagaggagggtctctttcagaatgtgggaaattcaggggtgacacacacctcagattggcatttggtttgtggaggtggccgagacgctcatctgctctgtgtagggtgtaagagtgaggtgttggagcgggaccgcctggctagaggaggtgactaatctttccagactgcctgtaggggttggaagtgagttaagggagttagttgtcagccgcggagttcagggaattctttggaacgggtcggctgcatgttgccggaaaaattaaaatttcttaacgctgtaataacgatggtcttacacctacacacaacaggaaaactgaaatgggaatcccagccagtcgcttccggcagctttctgttgggattcaagtgtgaacagaaatttattacgacagaagaagacgttaatgttcactcataaaggattcaattagggcttggactagctcttcactgcacatgtaatggcatctttgtagtgtagtttgggaagatctgaattggctcaacaagtagtatgagaatgcacctgtatgtgggacttgcaagatgttggcatttgacttagtgtgttgaattttggtattccagacctgcacggagaaaggacaatgacaagatcttgatactttatcattggggatactagagaaggagaggaagtgggcgtcaaggtgtatctttgaatgatattggtaaaaggtgtttcattttaaaagttctgatcttaggtcagttacttctacggaaccagagtcatctcaatcaccgttacatggatattttattctgagtacacactattatttagaactaatgtgaggagcatgaattttaatagtctgtgtctagtgtctaatattttttctttcataaagtagaaattacgtcaaatattacaattagagtatttcctgttggcccactattctaggggagagttccctgaaagcttcactgttagagcaagcttgagtcatggtggttgacggccttactttttctggactccatcatggtttttgtcaagtcatgatgctttgtaagagtagtagtaactagtgatgatcactacaaacttggagaggctattccatgtttgaatgttaaaatagttattaactgttgaaaataggacagatagcacaaagttattttaacagacctcaatgcattaaaaagcagcagtctcccctaagtgtagctgtgcaggatctggggctttgatagagttgtttttcttgaatggctttatagacctgcttatccctaacacacccatcagctgaggctttgcacagacctaaagtttattgaaacgcttttgacttacaggcatcagtaacttggtcaattgattttagtttgtggcataaacgcacaggcatgtttaatatcttcccataaaatagtgactggaacagatcttggcaccataagtatgaaggatttgttttgttttaatttcactttaaccaagtgaccacaacagaaacttagtgtatgtaggtaagcaaaattctgctgggtagaatgaaaaggcacatttaaaatcaaagagaagaatcctttttttatgatttacatggagcatattctacgtatatatgatcttttttttttcctggcttagagttttttttttttttttaactctagaatttgtcttttggtaaatatgtttgagtttgtaatggatcttatgagggtgaaatttccctcagtcttcattttttggtcagaattttaagagggtttgcattttcctctcccagtgaagcgtgacattcaggaaaacgatgaagaggcagtgcaagtcaaagagcagagcatcctggaactgggatctctcctggcaaagactggacaagctgcaggtaagtgctacacatggattgtatctgaaatgctcagtgaaattcctgtcttttgttggagtgaagaatcatgggactgatccacaaactgaattcagctttattttcttggcaacttgttgagcttcagttttttagcaggcaattaagtggcctttaaactcacttctttcctggtagtttagttttgcaaatgagagacaatcttatttttgttgggatatagtgatttctgatttgtttctggtttttgaattctcactgtattcccttacatagaggcagcaacagtcttcaataatttcactgagcaactctgatgtatttaagatagataacaactttaagcgcctgatttaaaaatgacaaaggattttgtatccaagtgactcactgtcatttttttttgatagattcagaatgagaatgaataagacattaaatggagccttcccaagacttctgcattcatacctaggactttgtgcacatcattgctcaaacattctagttgtaattgaaccattgactgattagatttgacataatattctgatgatgggtgtgtccttggaatgagaagggagtccttttgatcaggaaggaccttttaccagtaaagtggtaatagtatttagagagaagtctgtttaaacttaaatgggtgatttttgtcaagtttaaagtgaatttagagcttatttgattagattggattaagatctggtaagtgacctcatgaattattttccctaaaattatgttgttcaagagaatgatgggggttagttagcacaacttcttcaacttgagaactaaagattttttttttctttttctttttttttttttgagacggggtcttgctgtgtcacccgggttggagtgcagtggtgcgatcttggctcactgcaacctccgcctcctgggttcaagcgattctccttcctcagcctccggaatagctggaattacaggcacgcgccaccaagcctggctaatttttgtatttttaatagagacgaggtttcactgtgttgatcaggctggtcttgaactcctgacctcatggtccacccacctcggcctccgaaagtgctgggattccaggtgtgagccattgtgcccggccagtgatttttttcaattaaagataactaacttattaattattaggctcagtctatagagctgaataaagatgtatgaaattgtgaggatgtgtttacatgggccttatatcttacttaaaacatcattaagtagctataaaaagaaccatccataatggtttttgagtgctatgaacttttttttttttaattattattatttttgagacagagttttgctcttgttgcccaggctggagtgcaaatggtgcgatctcggctcactgcaacctctgcctcccaggttcaagcgattctactatctcagcctcccgagtagctgggattgccagcatgcgccactatgcccggctaattttgtatttttttttttagtagaggcgaggtttcaccatgttggtcaggctggtcttgaactcctgacctcaggtgatctacctgccttggcctcccaaaatgatgggattacaggtgtgagccactgcacctggccaagtggttactcttctaaacacatacatggtttaacttaattgaatcctcgaaacaacttgaagtaggttctgttaccattttacacatgaggatactgagcacagaaaagttaaataacttaacaaagctcattcaactaataactggtagacctaggatttgagctcatgtagtcttacttcagagcccatatagccacatgacatcatggttattgctttcctataactgtctacttaaatgaattatcattggtgggtggtgtcttttcatcttaggctgacttccttcctatttaacatacataaggattccacttgtctgtcagttaatttgagcttggggggttccaaaacagttttgataattactccatgcaaaatataataaggtaatttttctgaattataaagccaactgaagtgatgtgaaaattttttttgttgttagccaggcgtgatggctcatgcctgtaatcccagcactttggtaggctgaggtaggaggatcccttgagcccaggaatttgagaccagctctggcaacataatgagaccctgtctctacaaaaaatagaaaaattagctgggtgtggtgttatgtgcctgtagtcccagctactctggaggctgaggtgggaggattgcttgagccgaggaggttgaggctgtagtgagctatggtcacactgccgtgctctagcctgggtgacagagcaagaccctgtctcaaaaaaagatttttttgttgttgaaatatccaaatttctactttcctccagtggcatgaattaagaacagtgtgtggtatatagtcaatacttaagtaattttcatccaaaaatgttactgttttgcttgaaattcctattttatatgtattctccccttatttcttgcccttcctgccttgtgacctgagaagtttagaagtgtactgctaaagctattggaatttaatagatgaattataagaactttcaaaaacatttccatgttacttattgttttctaagaaagtttgatgagtataggtatacacaatgggaactctaaggaagtgttgaggcctacatatatttagctgtctttgctattaatgatatgtttgtattgtttgctcctgagaacagaaaatatgtctgttccattaatgttcagtttttttatgcatttaataaatgcatagcattgtgctaagtattctactcaaaaatttaagataggatccctggccaacaaaaatcacttggggattaccaaataaaacaatgtctgatgtgtaattgtgattgcaagtagtgttagtagtgttgagcatcatcagacatgatgccttggctcaggatttcatagcctaaaacttctaaaaggaatctgttgagttctgtgaggtcctgcctcaggctcccaagtggctggaactacaggcgcccaccaccacccccggttaatttctgtatttttagtagaggcggagtttcatcatgttgtccaggctgatcttgggctcctgacctcaaatgatccacccacctcagcctttcaaagtgttgtgattataggcatgagccactgtgcctggccttttttttttttgagaccgagtttcattctgttgcccaggctggagtgcagtggtgtgatctcggctcactgcaacttctgcctcctgggttcaagcaattctcgggcctcagcctccccaagtagctgggactacaggcgtgagccaccatgctcggctaatttttttttttttttttttcttttagtagagacgaggtttcaccatgttggccaggctggtcttggactcctgacctcaggtgatccacccgccttggcctcccaaagtgctgggattccaggtgtgagccaccgcgcccagccaagttctgtgaggttctgacaaggaaaatctggtcatataattacagataatcccagtaagaataggaggaagtcagtatgattttatgggacttaaaaaaaaattaactcagtatgtatgaaagtggaaggaaacaggaaatacaaacaagaatgaatataaaacagtagtagactaaaacagatgatgaactgagtctgaaaaatgcaggtgggcacagtggctcacacctgtaatcccaggactttgggaagctgaggtgggaggattgcttgaagccaggagttatgtggaccagtttggaccacacagcaaagaccctatctctgttaaaaaaaattttttttttttaaagcagcatgggtaacataaggagaccacatatctacaaaaaagataaaaaaattgactgggtgtggtggtgcgtgcctgtgtcccaggtacttgggaaacagaggcaggaggatcacttgagcctgggaagtcaaggctgcagtgagccacaattgtgccattgtactacagcctgggtgactgagtgaggctctttctcaaaaaaaaaaaaaaagaaaaaagaaaaagacatgtagggggacaactaagagatcatttgcttctttcggcgtaagaaggataacactcagtgcttagagaaaatattgtaaggctagcaggtgttagaaaggcacactgcttagctcatatttcacttctgccttttctaggaaggaaaatgattttcaaactgcaaaagatagaaataacagcagaaagagataattaatggtaggtgagagaagacagagcagatagtctctgtaaataagttcaggtctctaggctctaacagtttcttttattatcaaaaaaatagttttagcagatataactatagagccatatattattctgagaaaaatcatggagaggtataaggaagatgaggcaaatgttatcctgcctttcaagagggtaatgcaaagaatagatgtattcactgtgtgctgcacattgaaataaagaaattaaaaataaagagtagacactatacatggtcatcagtggtagagttctgggacagattatttgataaggagatagtaatctcttaaaaaaaagtggatttattgtgaacagattattccaaattcaccttagttctctctgttttgttttgttttgtttttttgagacagagtctcactttgtcacccaagctggagtgcagtggcacaaccttggctcactgcagcctcgacctcctgggctcaagcagtgctcttgcctcagcccgccaagtaactgggactacaggccttcaccaccatgcctggctaatttttgtagagagggggtttcgccatattgcccaggctggtcttaaactcctgggctcaagcagtctgcctgtcttggccttccaaagtgctaggattataggtgtgagccactgcacccagcctagttctctttttggttagctttatcagacccatagattttcaggggtctgcatgccacctgtttttgtaaataaagttttattggaacaaagccacgcccatttgtttccacattgtgtgtgactggctgagttcaggacctgctactaagaccatataacctgtgaagccaaaaaaatttactatctggctcttcacagaaaaagtttgccagcctctggattagaggaatgatatagactgtatatctgatgtaagcagggtagttgaacatttgccataatattaatatcacaggtacaggttatgaatttacaatgggctgaataactgtatccaaaacatgttaataaatggatcatttgtcaacctgaagggaagtcttcaggcattgtgtcatgaggatctgtccttgtttttctggtcagcatctggaatcatggttaaagccatttcagaagggatgcttatttttgtagatgactcagtacagttagaagacagaattaaaattcacagttattgccaaagccaggaagattaaattcagttgcgataaggattaaattatatacttaaagtatttttcaaaacagaggaagttgggggaattacctgttttgacagtagtctattaaaaagaactttaatgggctcagtctgaacaaagagaggtgttagaaaaagcaaaacatgctatcttgtgttacatatcatggccagatcaagagaattaaattgcctcctggtctactgtcagaccctacctggagcaatcgttttcatttctgggtaccacaaaataccacaagtagtacctttacaaagtagagtttgttcagaggagagcaactaagttacctagaaacaaggacttcggaggaacagttgaaatagccaaagatgttaagcttggataaagggaaaattagggaaatgtaaatgataattatctttaagtatttaaagccatgtgaaagaaggtatagatttgtgttttgtgtttcaaaaaggaataatttgttttggccaacattggaataggctgctttgtgaacatttctgtgactagaaatcattcagaattgttcaggcacaggaggaaattctgtgggagaagggacattgcttcagactacttttaaaaagctatcattacataatataattgaaataaatgcaaaaggaatttgagggggagaatcactgtagactggagttacatgggaaactcaataggacttcagatggacctaaaaggatatataaggtttatatagactgagaagatggcaagacatttcagatgggattatggcattagtgcctcttgaaagcaggagtatatactgtagtcttgtgcagaggtgaatgaggtggcagaatggcgaaaagttttaaacattgggaatcaaaggtcattactggggagtgaagggaaaagatgaacttttctactctatatcaagttcttaagtaccggacacagtcccatgcattctctgactattcaggcagatgaggatttcagggccttgaattagcattctctggagggtgaggtttgcttgccctgaattagagttctcaggagggtgagtctgcaattggagaatattaaagaggcagtggcactaaagtaattttaacctacattccaaaatacctccttagttgttgagttgaaccattctctaatttttactatttgacaagcatatctctagtttattgtttcaaaagatgtttctttagagttcatatactgccctcttctatatagtgggggaaaagctctgtgatggatcccttttttggtcatagtttaagacttaggttttgaagattaatgaggaatttaaaagagatatagcagcactttaagggcaaaacactcttctatgtgaaaagtttattcagaagagtgccagggaagtgacaatgcagaaaggctaaactggggagcactgcagaaagacaggaaaaaggaatctggagtagaaaatctctgtctaaggggaacagctgaagcagacttggaagttagaaaaaaattacccctatgacctgatcatatttattggttgtgaggaagtaattttgtgaaggtggcagggacacagcatatttcatgttctagaaaactggtttttgagattatgaatactttgctgtttatctttcattaagatggataaatgaagcagagacatgagcttttcctgcaacttcatagtaatccagtggctgagtagggaacagaatgcaaatttggtatatgatgttaacttatttttgctattctgctatttgctaggaatgctttaaactcctagtaagtttcacttagactgattccagtgatgtaagtaccgatttttatgacgttgggtcagtttcttaagtgggtattttgtctcaaatgttgatgtttactcctctttttgaattgcctttcctacagagcttggaggactcctgaagtatgtacgacccttcttgaattccatcagcaaggctaaagcagctcgcctggtccgatctcttcttgatctgtttcttgatatggaagcagctacagggcaggaggtaagtgatattaatgacagaaagtagacaatatggagaaaagtttgtttccaagaaagaaatgcctacctgcactttagtactaatgtggaagggaaaactgggaggacagcgcaggacttatcatgtcagtttctctttgttacagggcatttgatactttgggtctgttccatgctttgctttgtaagtggagattgtcagtggtccctggaatcctcattacatcagggtcacaaactgattcttgtctttgaggtattgtattgccacacctttgtaatgttttctgtgtctgtggtacctttcatcttgtgtcacaaagctccttctgagcactaattaagtcttgtggtattccttcttagcatgttttgtactgcatatatgcctttattgaggggtgagcatccatccatttgtgtctcattgtgcagaagtgactctggtgttcctgtatgtgtcccacaagttcagactagaccctgagctgtattaaagagtgcttctcagtaatcactgaatcttccaaccttctcaaagataactgtattttctgcaattcaggaagagacgcataccaaaattaaacatcattctgtaaaaagtggcagattgaagcagggtatattgtcattgcttgaatctgtttgtaggaagaatatagttgttgtttttcttatggatatattgatcagtactcattgagtgcctgctacgtgttaggcactgttttaggtattggggatacagttgtaaaaacacagtcactgttgtcatgaggattattttttaacggggaacgcaggcaataaacaaatgtaaaatggcagataatataagggcagaattgctagttggttatatgtctgattgtttgctgtagcctctgtgggcgtgaaaggtatgaaaggccatagtagcatattgaataaatgggaatttcagaaacctaggacacatggatcctactttggaatcataccttttgtaaaatctggctttaatgattctttgaatcctgatttaaacactatatactaactttatttgtagaaaattcatttgtagagtagtcttcagatttatgtctctggcaaaactgtttgatgatagtatataaaaagttagatggctattttgaattaaagtgtcagttattttaatgaaaaaattaaaagttatttagggtattagtcttatctaactttttttaaaaattgtactttaaaaaactcatgagtccgggtgcggtggctcacgcctgtaatcccagcactttgggaggccaaggcaggtggatcacgaggtcaggagattgagaccatcctggctaacatggtgaaaccccgtttctactaaaaataaaaaaaaattagccaggtgtggtggtgggcgcctgtagtcccagctacttgggaggctgaggcaggagaatggcgtgaacccgggaggcggagcttgcagtgagccgagatcacgccattgcactccagcctgggtgacagagcgagactctgtctcaaaaaaaaaaaaaaaaaaaaaatcatgaaagtgataccattctttgtttgaaatagagtaccttaaaatagactgatcagtaaatgttaatttgaaactgactgataaatgttacttggaagtttttgggcagaaaagttaattatggaagctgctcctttttgcacactgaagtttctgaaattatccatccccataacctagagctcactcagcggatagaacagcatttatttttttttattggtgacagagtttcactcttgttgcccaggctggagtgcaatggcgtgatcgtggctcactgcaacccccgcctcccgggttcaagggattctcctgcctcagccttctgagtagctgggactacaaacatgcatcaccatgcctggctatttttttttgagacggagtctcgctctgtcgcccaggctggagtgcagtggcacgatctcggctcactgcaagctccgcctcctggattcatgccattctcctgcctcagcctccccagtagctgggactacaggcgcccgccaccacgcctggctaagtttttgtaattttttaggagagatggggtttcacagtgttagtcaggatggtcttgatctcctgacctcgtgatctgcctgcctcggcctcccaaaatgctgggattaccggcgtgagccaccgtgcctggccctaattttgtatttttagtagagacggggtttcaccatgttggtcaggctggttttgaactcctgacctcagatgatccacccgccttggcctcccaaagtgctgggattacaggcgtgagccactgtgcctgacttgcatttatttaatgatcatttctcctgttcctttgtggaaatccattcaagtgctctgctatagttcgctagtaggatttcctggcctttgtcatatggctccctgactggttaggcgctcccttaactgtggttatatgttgtcattgttcattgcacattacatttatataaagtaaagacctttcttcctttccttagggtgaaaggaaacacttttaggcattgtatcattttatcatcagtgtcattttactttttagtaaaggctgtttttgttttcgttttttgagacagccttgctctgttgcccaggctggagtgcagtgacacaatcttggctcactgcagcctcaacctcctggagtcaagtgatcctcttgcttcagcctcctgagtagctggaactacaggcatgcaccaccacactcggctaatttttgtatttttgtagagatgaggttttgccatgttgcccaggctggtcttaaactcctagtctcaaatgatctgcctgccttgcccttccaagtcctgggattacaggcgtgcagcactacgcccggctaaggctgatttttttgatggttagcagctttgcttttatcatgaaccagagtcttattccactaagtaggacctcttttggtaatttttgtggattataggttatttgcttgttttggagcaaattgtgaatcatccagactgtctcacctgcacctcagactcaatatgggcaacctcaacatccagccatttgttaaattttgtcaattcagctttcttcattgtctgcttctccacctcttttgtatttgttctctctctctcttttttttttttttccccgagatggagtcttgctctgtcacccaggctggagtgcagtgttgcgatcttggctcactgcaacctctgcctcctgggttcaagcaattctcctgcctcagcctcccaagtagctgggattacaggtgcccgccactgcacctggctaatttttgtatttttagtagagacggagtttcaccatgttggccaggctggtctcgaactcctgaccttgtgatctgccggcctcagcctcccagagtactgggattataggcgtgagctactgcgcccagctgtggtctctctttacaactaccatctagtttggttcttaatttttttttacttggactactgtaaaagcctcattccatcattgtcagagataccttaccaaatagccctctgataattttattcctctccctcttctcccacaactcaaaccttcagtggctttccattgcctgcagaattagataattaatggttttctataatacaacctactgcaacctactgcagtagtctaatctcccaggactctactaagcatatcaaatatgtcagccatgttggatccctggctgtttgctgaacaagcctgtataaccctcatgctgtacctttctcttccatagtcttatctcaagttctacctcctctgaactctttccttcctgactttaatgtggttttaactctttcagtgactcacattgtattttgtacatgctctgagtattctgccttgtatgacagtggctttacacttgccttgtctcctttactgtaatacaatctcactcaggtgaagcactatgtgccttgcagtaccacagagccttcctcattcccagtacagttcaaattccttaaccatggctacctctgaccacatccactatactagtctccttttactttctttacagctgtaattactggccttattgccttatgcttcaaactgtctggggttgggacattcatatacatatggattgctgtcagcttgatcttaacaggattttttttctttacactgtttcaagtctttgctcacatcttacctcctcagagactttccttgatcaccctatctttgtttcctttttaacaatatttattttttacaaaaattagccaggtgtggtggtgcatgcctgtaatcccaggtactcaggtggctgaggcacaagaatcacttgaatccaggaggtagaggttccagtgagccaagatcgtgccactgcactccagcccgggcaagagtaagaagagtgagagtgtctcaaaaaaaaaaaaatacatatatatatacatatatatatatgtatttttttttttgcttatatactcttaagttgtatccctagcccttagagtactttggcttgaagaagctgcatacctatttgtcaaaggaatgtatggactgtgcctgtgccttccctatggtagatgtgcagtggtatgctcacagctcactgcagcctcaacttcctgggctcaggtgattctcccacctcagcctcccaaataactgggagtacaggtacacaccacgacgcctggctaattttgtttgtttgtttgtttgtttgtatttttagtagagatgggattttgctatgttgctcaggctggtctcaaacttctgggctcaagtgatcctctggactcggcctcccaaagtgctgggattacagatgtgagacaccatgcccagccaggaaatactttgttgaattaagatctgagtttattgaattgaaatgtaagcatggggtgttgttactacattcgtttaggtaactcaaggtctctgacttggggaaataggatataatttttattcttagttcttttttctttttgagatggagtcttactctgtctcccaggctggagtgcagtggtgtgatcttggctcactacaacttctgcctcccgggttcaagtgattctcctgccttagcctcctgagtagctgggattatagtagagatgggcttttgccatgttggccagggtggtcttgaacttctgacctcaggtgatccgcctgtcttggcctcccaaagtgcctggtttataggtgtgagccaccacacccggccttgttcttagttcttttaaaattttttgactgggtgttgggaaagaatagacaagcaagtcataggtgggaaagaatagacaagcaagacataccatggctatcatggtagtattgaggcctgaggcaaaatgggaagttttatttatttgaaatgggggtcttggtctgtggcccacgttggggtgcagggtgcaatcgtagttcactgtaaccttgaacatctgggctcaagcatttctcctgcctcagcctcccaagttgctgggactgcagatgtgcaccactacacctggctaattaaaacaatttttttgtagagatagggtcttgctatgttgcccaggctggtctcaaactcctggcctcaagtgatctgcttgcctcagcctcccaaagtgcctggattacggatgtgagtcactgtgcctggtttaaataagacgttttagaatactgttaagacagctagaattttgtgttaaggagtttggtactgagaatatgagggaggggatttcccttgcttttttctatttgaggactaactataagacagatatatctggtcaggcatggtggctcacgcctgtggtcccagcactttgggaggccgagtgggcggattgtgaggttaggagatcgagactatcctggctaacacggtgaaaccttgtctctactaaaaatacaaaaaattagccaggtgtggtggcgggcgcctgaagtcccagctactggggaggctgaggcaggagaatggcgtgaacccgggaggcggagcttgcagtgagcgccactgcactccagcctgggtgagacactgtctcaaaaaaaaaaaaaaagacagatatatctagagaaccatcttcagcttgctattcccaaagttggtatgattcaggttatgatctgttcatttaaatgcaaggtttggagcctagaaagtgagggcatgtgagtcggggagtgagagagtgaggatgggttggttggcaagggctggggagtggaaaagtaaggtgaagaggagggaaggaagactgaaccagactcttgccaaatagtgaactcaactttccttccagggatctctggggagtagcctatgggcaacttttctggtatagtctacccaattgaaacacaatagcactttttcttttttttgagacggagtctcgcaccgtcgcccgggctggagtgcaatggcatgatctcggctcactgcaacttctgcctcccaggttcatgtgattctcctgcctcagcctcccgagtagctgggattacaggtgcacaccaccacaccctgctaattttttgtatttttcgtagagatggggtttcactgtgttggccagactggtctcgaacccctgacctcgtgatccgcccgctttggcctcccaaagtgctgggattacaggcatgagccactgtgcccgacccacaatagcacgttttaagaaacctctctactaaaaatacgaaagttagctgagcatggtggcaggcgcctgcaatcccagctactcaggaggctgaggcaggagaagtgcttgaacccaggaggtggaggttgcagtgacctgagattgcgccattgcactccagcctgggcatcaagagtgagactctgtctcaaaagaaaagaaaaaaaaaaaggaaaaggaaaagaaaaaaagaaaaaagatatccagttcgtgtaaaaaaaaaaaaatccttgctgtaggagaaacatctatgatgaccttaacttaaggctgggttaagataggtagagtgctggagttaggcacaagttctggtgccagcagcagatatatgtgatagtccagatattaaccgattagtagtccttaggtgaattcatcttatacaattgtgatatagcttgcttttattttagtttttcgttctgtcttatttttagaaaatttttatgaggtcagttgagtttagagttggagattaggtagccaccagggggctccaatgaggagttacaaaggttttgctggttctcttactggcaaatcctctgatgttacccgtcagttcaccttaggtgaatcacttagtgtctggactatcagggaaatggaggcaggtgaattgcaggagtataattcattgtttcttaattagagatatactttcaatgaccaagctctattctagactaatgaatcaacagcccaggcattctttttttttggtagatgagtgtggtaaatggtttattgaaataaaacttacagaggaatatttctaagtcctaggtattcatttttgtgtcctttgaaaaaactccctgggtaaaactgtggggggcacttcttaccctttgaagtcatgtagaactaaacacttatatttcctttgctaagactattcagagaaatattttcagttccatttatattagaaatcttactttgaatttagcttttcagaatataactcaaaactctgcaattgtgataaagcttgcttttattttagtttttggttctgtcttatttttaggtaatttttatgaggtcagttgagtttagagttggagattaggtagccaccagggggctccagtgaggagttgtaaaggttttgttggttctcttcctggtgaatcctctgaatactgtgtaatgttatctattaatttatttacagagctagaatttaggatctaaaagtagaagatcctgtcaatttggattatgtccctatagtttttccttcttacagcatttcttttcttttcttttttttgagacggagtttcactcttgttgcccaggctggagtgcaatggtgcgatctcggctcaccgcaacctccacctcccaggttcaagggattattctacctcagcctcccgagtagctgggattacgatcatgagccaccatacctggctaatttcttctatttttagtaaagacaggatttctccatgttggtcaggctggtcttgaactcccgacctcaggtgatccacctgccttggcctcccagattgctgggattacaggcatgagccactgcgcctggccagcatttcttaagagaactttggatttatataaaaacctgttgtattagcaattagttctctggagagctcagtttctcatttcatttcttttgctcttatgctctagttagcaaccttaatataaaacttgcagtaaccaaagtgatagaagatcttcagtacttaatatttactttgtcaaagctagcatgtcagggatacctgatggcgtgctagactgtctagcattgagtgctgctttaagtcagttactttgcaccttacctcactacttaggtggcagatagtagtaggggttcagagtgcctttaaataaagcttaaaagcgcttttacgtgttaggctaattctaatttcttttttttttaattaaaaaaattttttttaagactagtcaaagtgcagtagtgagaagcagggaaagagtagatcaggagctcaatctgtaactgactgtgaacaatcgagattactcattaccttcagaccagcttttatcccctttaatgcaagctaggttactgtacctgtttgctttaagagtgatgatgaattgattagttgcactgcttagaatctgaaagggaaaaagccagctggaccttttgagtcttaaaagcaactgctaggaatgaggcattagtgcttaggatgagaatttctcccctttattacctgtgtattatacattaccattactatttctaaccagggagaaatctgtgctttaaaaattcctaatctgtcatagaaatctacattccaggtctatacatgttgtttggaagttcttggtctctcctcagtaggtaggagtcttgaagatagagctcttttcctaaaaaacataatctaagcacaaaaatattttatgtgtaaaaagccaagttgatgctccattatgatataactattacacattgagatactgtggatcagacactaaatagagcaacatggataatatgtaaggagggaatttaagctgttctccaaagcatggtttgtgggaagaatttgaggacataatgttgcatgtactgtctctccttattgcaggtcgagctgtgtttagagtgcatcgaatgggccaagtcagagaaaagaactttcttacgccaagctttggaggtaggttttacattagtactcatttcaggtctctaagcatgagacagagggtgaatgtaagcagtaccatccttatcaaaagtatcttcagcaactttgtaattacctagataccgaaagattattgatggtagccccacttatgataattgctctgattgaagttttgagacagatttgctacttggctcagagtagtaagcaacaacatggtaaagttaacagtcatttgctggctataataggagacaatacattggctagatcgtctcttatgctgaatttgatgctatcatcagaaattgcatatttaacagtaacagttctgtgactgtcaatctttgatttctttctgtggctttttccccccccttcaatcaatgccttttctctttcctaggcaagactggtgtctttgtactttgataccaagaggtaccaggaagcattgcatttgggtaagtaagctggtaataagtcatctcagctagctaaatgaatgtattctaaaccacctggctactcttactaattacctgttaataatttatattctactgacttctaagaaggatttaaagtagcttacagttctgcatttgtcatgggaaaatgtcatttgaaagtttaaaaaactagctagagttaatctgtcaaatttagaggacaaatgggtagttttaagtttacttgaatttggagcagtaaaatcaattccattttaataactgaaatttaaaaaaagtgtatctatattttgcatatagtactctgttaaatttcagatttaggtttttaaaggcaaatgtttggcttactgtcctatttactatatctgcttatatacttaaaatctattttaaaaatcaagaaattaattgggtacaaatatatttggaagctggagtggctaactgaagcctttttcctgtgtggcctttaaacaccttgaaatcttctctgctttttttttttaatctatctatctatctatttattattattattattattttttgagacagagtcttactctgttgcccaggctggagtgcagcagtgtgatctcagctcgctgcaacctctgcctttcaggttcaagcgattctcctgctttagcctcctgagtagctgggactgcaggcatgtgcctggctaatttttgtatttttagtagagatggggttttgctgtgttggccatgctggtctcaaactactgacctcaagtgatctgcctgccttagcctcccaaagtgctaggattacaggcatgagccaccgtgtccggccactgcttgctttttatgagtgggtagatctggactattttttccgaacaaaagaacatggctcttatgatctattaggttgaagagtttccaatattcaatttttggactgcaaaagtggcaatttcatatggttcaaataggagcatttaaaaaataactttaataagatatggttcacttaccataaaattcacttttaaagtgtataatccagtggttttcagtgtattcactaagttgtacaaccatcaccactacttaatttcagaaagttttcagctgggcgtggtggctcatgcctgtaatcccagcactttggaaggccaaggcaggcagattgcctgagctcaggagttggagaccagcctaggcaacatggtgaaaccccgtctctactaaaaatacaaaaaatttgcaggacatggtggtgcacacctgtaatcccagctacttgttaggctgaggcagaagaatcatttgaacccgggaggtggaggttgcagtgagccaagattatgccactgtactccagcctgggcaacagagcgagactctgtctccaaaaaaagaaaaaaatttcagaacttttttttttctttgagatggagtctcactctgtcgtccaggctggagtgcaggggtgtgatgttggctcactgcaacctccgtctcctgtgttcaagcgattctcctgtctcggcctcccgaatagcagagattacaggcacctgtcaccatgcctggctaatttttgtatcttttagtagagatggggtttcaccattttggtcaggctggtctcaaactcctgacctcaaatgatctgcctgccttggcctcccaaagtactgggattacaggtgtgagctaccgtgcctggcctcagaacatttttatcaccccagaaagaaacttcctattcattagcagccctgggcgattactaagctatttgtatctttgtagatttgtctgttctgggtatttcttaaaaatgaaatgatacaatatttgtttctctgtgattgtcttctttcacgtagcattatgttttcagggtttatgttgtagcatgtgtcagtacttcattcctttttattgctgaataatagtcaattgtaaggatatatcacatgtgtttatccattcatcagttgatggacacttgtgttgtttctacattttagctcttaagaatactgctatgaacaggttttatgtggacatgttcttctgggtatatacctagaagtggaattatactgtgtcatgtggtaactgattagctgtttaaggagctgctaagtaagctgttttccaaagtggctgcaccattttacattctctttaacattgtatgagggttccaatttttccatatccttaccaacacttgttattttttaattttagccatcctaaatagcatttcattatgtttttgttttgcatctccctaatgactgatgatgctgagcatattttcatgtgctttttgctccttcgtatgtcttgtttttttgtttgtttgtttgtttgttttttcttttgagacagtctttctttgttacccaggctggagtgcagtggcgtgatcttggctcactgcaacctccacctcctgggttcaagcaattctcctgcctcagcctcccaagtacctgggattatgggcacgcaccaccatgctcggctaatttttgtattcttagtagagacgggttttcaccatgttggccagcctggtctcgaactcttgacttagtgatctgcccgccttggcctcccaaagttctaggattacaggcgtgagccaccatgcccggccttttttttttttttttttttcttgagacactcttgctctgtctcccaggctggagtgcggtggcacgatctcggctcactgcaacctccacctcccgggttcaagtgattctcctgcctcagcctcccgagtagctgagattataggcgtgcaccaccatgtccagctagtttgtatatttttaatagagacggggtttcaccatgttagccaggctggtgtcgaactcctaacctcaggtgatgtgcccgccttggcctcccaaagtgctgggattacaggcttgagccactgcgcccggcctcctttatatgtatgtcttcagataaatattcagatcctttgcttattttttaattggttatttgtgtttttattttttagaaacagggtctcactctgtcacccaacctggatggagtacagtggtgcagtcatagctcactgcagcctggaaatcctgggctccagcaatcctcctgcctcagtctcctgagtagctaggactataggcgtgtgccaccacacccagctcttgtttttattttttattctgaagttcttttcttttttttaagtttgttttaatgtcgggtacatgtgcaggtttgttacataggtaaacttgcgtcatgcagtttgttgttcagattttttggtgctcaggtgttaagcctggtacctattagttatttttcttgatccttttcctcctcccaccctctgataggccttagtgtgtggtgttcccctccgcgttcaggtattctcatcatttagctcccacttacaagtgagaacatgtggtatttggttttctcttcctattttagtttgctaaggataatagcctccagctccattcatgttcctgcagaggacgtgatctcgttcttttttatggctgcatagtattctgtggtgtatatgtacattttctttattcagtctgccgttgatgggcatttaggtttattttttattctgtatacaagtcccttaccagatacatgatttgcaatttttttttctttgttctgtgggttgtttttttccttcgatgacgtcctttgaagtacattttaattttgatgaagttctgttacctgttttttgttgttgcttatgcttttggtgttacatctaagaaaccattgccaaatccaaagccacagggatttatttctgttttcttctagaagttttataggtttcactcttaaatttatgtctttgatccattttgagtcaatttatgtatatggtgtaagtctgtttgaatttgatattctagtttgagatgggggagtcagggaagaaggtatatttggagaacattggtatatctagaactctttacttccttcatcaacctagtgccccagtgtttcttatatagccttgtgattgctagacaagaagagagcgagattgtgtctttctgaactggataactagatttagcattttataggtagagattcccactgtatttaaatcttaggagtaagctcataggactgttggctctaatattgtccttaggaagcagaaaacttcaaagaggtgtgtttttctcttggaagatagcacattagtggaaaatttaattattgcatggggtctagaggtaaccttttttgagttcaggaatttttttttttttttaatcctgagtgttatgagggtgggagagtgagctattattaggtattaagctgatggctataaaggagaatgtcttttcctttttcaggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtaacagacgtagctattcctgggatgtgttttcttaaagctcatcttattttataggtggaaggaatgggggttggggctggagaataaaattggctgatttggctctagcttcttcagagaaccagttagaaagctacctttctaactagctgctcccctcctgttaactgcctaaaatgtattaagaacatacctatctgtggttgaccaggcaatctgacttttagaaccaaacttagaaaggtcgcacgtagaagactcccttagctcttagccacttactcagaatagtagcattttcctttgggattggcctaccccaagtctgttgactcttggagatctttgtaaagttggttgacttttccaaagggcctcaaatcagggctgaggaatgataacccaatttcagctgagtgtggtatgtagttttccgatggagtgcgtgaatgtgaggctgggaagccatggattggcaggtggaatactttcttttgtattcagcagtttttttttttactggaggcgtcattattgaaggaatgttggaattggaagcagaagacgagtttaagtgcttgtgttacctctcatctgtaaaagataatgcctactcgactcatctgtcagggatgtactgatctaggatcaggctttcctaggttgacattttgttctgctgctttctagtatgtgactttgggcaagttacttaatttatgtttagctcatctgtaaaatggtaataattggcacatgatagagcctcattaatgtttgtgttgaatgagtgacagtctagttttttgttttgtttttactttttttttttttgagacagggtctcactctgttgcccaggttggagcacagtggtgcagtcacagcttaccacagcctcaacttcctgggctcaagtgatcctcctatctcagtctcttgagtagctgggactacaggagcgcgacaccatgccaagctaactttttgtagagatagggtttcgccatgttgcccagactggtcttgaactcctgggctcaagcaattttcccaccttggcctctcaaagtgctgggattataggcatgagccaccatgcctggcctttgtttctgtttttttttttgagatggggtcttgttttgttcagccacccaggctggaatgcagtggcgcaatcttggctcactgcatccactgtctcctgggttcaagcgattctcctgtctcagcctcccgagtagctgggattacaggcacctgccatcatgcccagctaatttttgtattttagtagagatggggtttcaccatgttggccaggctggctgcacgcctctgcctcccaaagtgctaggattataggcatgagccactgtgcctggcctgtttctgtttttaacaataaacctcatgtgccagccatgacactcagagtgctgatatggcccctgttaactaatgtgtttggcaaagcagtataccagttcttgggccttattttatttatttgttttttaaccatacatatttttgggtctggcttattctctctctatactgggagatgtggaaaaatggagatgtgtctcatttagtttagcagcattaatggtttgttgggttgttgaaggggctttccttagctacagagaagagcagatattccttgaggcctctatacttaacagtagtagaaaaaggatctgattcccacaaacccaaagtgggaggttttttgagtaggctggaaggacgcatcactcaataaatggtgaagtcagaaggttcctgctggtattgagttctttggatcatgtgtcagcagcgtcatcctttgactctagtgtgctaaatactttctacatgtatctcgatgtgaaagatgttgggaagcagttgtggtaaacaaatggatggggctgaggtctgtaacttcttaaagggctggggcagagttagagctaatatacacaaatagagaattttagggtttagatgcctcccaagcttggaaagaactaatttttatgttatcccaagtgatagcataggttggcagtagtagcaggttcaatcaaagttaagctcattgggagcaactcaacttctaagcaataggggattggttaggtcaactatggtatatcagtctgaagaaatactgcttagccatgtataattaagttcatggatttggcattatgtgaaagctgtacactgagtgcatttaggcaaaagcacatccacaaatgataaatatttgaaatgaaaatataagatgttggattccctctcccatgccccatgacagttgcataaatataaaactatcaggcttagaaaagctatcttaaagtagttaatattattagaacaggtcattcaggcagtctagagatgtttaggtcaactccctgacctgtgaatgtgatgtcatggagggtaaacatggccttttcctgtggctccaaaagatagcaggactggaatggtggtgagaagcatggaagaaagatggtacagtatgtgtttttcaggtcccttttaagttgagtctctaactcctttgggaacttatattggcaatatgacattgagctgggaggtcagagacttggattctcatcttctaatctcagctgtcaaattgctgactatggtgactttgggcaggtttttttttttttagacggtctcactttttcacccatgctgcagtgcatttttgctatcacagctcccatcgctatcatcagcctcccaggctcacgtgatcctcctacctcagtctcatgagtaagtagctggggctacaggcatgtgccaccacgcctggctaattttttgtagagatggggtttcaccctgttgcctaggctggtcttgagctcctaggttcaggtgatccacctgccttggcctcccaaagtgttgagattacagatgtgagccactgtgcctggcagagcaggttctttatcctttcctgacctcatcagtaggttggtggagttgacgtagagtttttttttttttttgagacagtgtcttgctctgttgcccaggctggagtgcagtgacgtgacctcggctcactgcaacctctacctcctggattcaagtgattctcctgcctcagccacctgagtagctgggattacaggcatgtaccaccaaggccggctaatttttgtatttttagtagagatggcgttttgccttgttggccaagctgatctcgatctcctgaccctcaagtgatctggctgccttggcctcccaaagtgctgggattatagacgttagagtttacagacgtgagccactgtgcctgacctcttttttttttttttaagacggagtctcactctgtcgcccaagttggagtgctgtggcgtgatctcagctcactgcaacctccacctcctgggttcaagagattctcctgcctcagcctcccaagtagctgggattacaggtgcccgccaccatgcctggctggtttagtatttttagtagagacaggtttttaccatgttggccaggctggtcttgaaatcctgacctcagatgaccctcctgcttctgcctcccaaagtgctgggattacaggcatgagccaccatgcccggcctttttcttttttttttttttttttaagagacaaggtcggctgggtgtggtggctcacacctgtaatcccagcactttgggaagccgaggcgggtggatcacttgaggtcaggagttcaagactagcctggcgaacatacggtgaaaccagtctctactaaaaatacaaaaaattagccgggcgtggtagtgggtgcctgtaatcccagctacttgggaggctgaggcaggagaattgcttgaacccacgaggcggaggttgccgtgagctgagattgcgccattgcactccagcctcagtgacagagtgagactcggctcaaaaaaaaaaataaagagacaacatctaactctgttacttaggctcaaactcttgggctcaagctatcctcctgcctcagcctctcaaaagtgccgagattacaggagtgaacccctgcacctggctttttttttttgagacggaagtttgcccttgttgcccaggctggagtgcagtggcgcaatctcggctcaccgcaacctccgcttcctgggttgaagtgattctccttcctcagcctcccgagtagcagggattacaggcatgcgctaccacacccagctaattttttttgtaattttagtagagatgggatttgtccatgttggtcagtctgatcttgagctcctgacctcaggtgatccgcctgcctcagcctcccaaagtgctgggattataggcgtgagctgaaaccgtgcccagcatttttttttttttcaagagatggggtcttactatgttactcaggcttgtctcgaactcctgggctcacatgatcctcccatctcagcctcccaaagtgtggatttacaggtgtgagccaccgtgcccatttaggtagatgtctaagctgcctcccagctctgatcttttatggctctattattttatatgttcttattcctttcttttcaatgcccaggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacacgtaggtgcaccttaactctggactacaagaactcagatccttcagcaagtctgtttgccatggcagagatggcctgagcagggagtttggccagttacagaaacagcagcagctgcggcctctagggctggctaaggtagagcgggaggatcaaaagtggtccagaaaactttcgcttgctagtctttcagaatcaggcagacattttagaaatccccttcccagctcctcttggagaattctcctcatcctttaaatattctgtcctcataggtgcagagcacaggacagagggtcaggaaatagcttacagatcagccagtaacagccaactgagccacccagaatgaggaaggaagggttaaggagaggtttgaaaaagtggacaacaaaagtatgacagacctacttataaagaagtctacagaattattcaattcttttgggaataaatgaaatattgactaagaactctctctggatctttggattacataagggctatgttttaataatacctgttacactgggatttgacttaaacttatagttctgcttgttgtgtctattgcttttggtaggttcagttcagctttctaacattggagtttttctactcttcaggctgagctgtgacccagagtggagaaaacctagcttttgcaatgtgatgggcatatgggtttaggggttgggctgattgtctgtgtgggcagagtctttattacaatggaattctgttaaaaagaaatttgcccaaaccttcctttagaagcataacatctgcagcaattgaccaagtatgtctttttttctagcccagaagatgtccaggctttggtgagcgggaagcttgcacttcggtatgcagggaggcaggtagggactcccttgactgcagttctgctcactctgagaccagcatgttttcagagtcacaacgtttgatgagaccagcactcttcagatcttcatactactctcttccttctgccccactcacttccttcccttaagcccattcagtgtgtttcccagactgttaaattcttggcctggaaagtcagcgtttggtgctcttatggacatcacgttgtttgagggacttagggaactgaactgtagcatttgcagtgagttagtttgcatttggctttgaccagaagatttatctaccacgagtctgagttgtgaatttaacataggcagggtatgaaatcttagattctccaggttaggagcctggtaaggtctggtgcatatgtgctttagagaggtctgattgcttggtgcagaaactaggttttgagatttacttctgtgcttctcagatcagtacctttctactcgtgctttgaattttgggtgtggtgcaaaaagaggccctttttttttttttgttaccttaatgcccaagtaggtatgagtgtgacttctgagagcagacagttaggacctacgcaaagatgacgtctagactgtctcctctttgtattttgcttgattatcactagtaaagtaagtgtaatctttctggatttcaactgcagtggtctctaaacacagactgattggctgtctatataatctcactgtatctctggaggagtggccacatagatgatttcttccctctctacaagtggccctaattggctttttttttttttttgagttggagtctcattctttcattcaggctggagtgcagtggcgtatctcggctcactgcatcctcctcctcccagtttgaagtgattctcctgtctcagcctcccgagtagctgggattacaggcatccgccactatgcccggctaattttttgtagtagagacagggttttgccatcttggccaggctgtcccaaactcctaacctcaagtgatccgcccacctcaacctccaaaagtgctgggattgtaggtgtgagccactgcatccagccacgcatcttccagtatagtaataaccggtactcttgaggtcaaaaccaggagctgacctgaaacttttgctgataaaaagccaattaggggctggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagtgcattggtggctgtaatcccagctactcaggaggctgaggcaggagaatcacttcaaacggggagtggaagttgcagtaagccaagatagcaccactgtactctaacctgggcgacagagtgagactctgtcttaaaaaataataaataagaaagatgcactactctcactataactagagttgaggagacaggctcagggacatccaagtgttcagggcaaggtcaggtagctaatcaatggtggagctagactttgaattagggtcattggctctaagttccaggcttttctcattttgacacttttttctgtctataggacaaatgctggagacaaacacactaatgattagccttgcaccatgtagtctactgtataagacacactgttcttatataagcatgtaggctgataaaagagcagcttctcttagtcccttgcgcctttgatgttagcttttaagcaggagataggctaatctcccagaaagatgagtgttgcagattttttgctgagtggagacttaatagcttggtcaggtgccttttttaaccatgttagaagttgttctcaactattgattataccttcatcactctgtggggtcttaacatttggtgtaatatgttaatgccgcaacctttttttgagacggattctttttctatcacccagctgcagtgcagtggcatgatcttggctcactgcaacctctgcctcctgggttctagcaattctcctgcctcagcctcccaagtagctgggattacaggcgtccaccactatgcccggctaagtagagaagggagtttcaccatgttggccaggctggtctcgaactcctgaacctcaagtgatctgcccacctcggcctcccaaagtggtgggattacaggtgtgagccactgtgcctggccttgatgcctcagtgttaatgaggtagaccttgttcagtgccttgttccaaacctagcagaatgaatcttgataaagcacagatataatagggtctaagggcaagaaggagtttgggtggatgtggcgataacaagccttggaggaagggagaagaaatcacagttctcttgtcatttttccttttagcttgtcatctctagagaatgctatattagggtcggtctgtttggaaaatttctgtttcctagtattattaagtcatttcaggtttcaaagggaaacaggttggcatatagtggtattcagtacttgcggctcttcttcccgggcgtctgaagaagaacgatggtggggcgggttcttccttttggcagaagttgtgtggacacagcatactgcttatgagacttgggtaaatgttagtgtgcagaataaatcgctttcatggtttgtctctttattctcagacagaagcattaaaatgcgtggctcaggctagcaagaacagatcactggcagattttgaaaaggtgagtatgatattgggttggtatggaatgtgagtggaagagagggacgtttaagtacttcaaaacacacttttaaaaataattatagtttcaaaagaagttgcaaatgattccatgtatccttcacctaggacagtattaaaaccaggaaatagttaagcactttgtacaatgaaacttactgagttgatataaaatatatattatttatacataatacctttctatttcaaaagttctttctgtccttttttcactttgatttttcacaacacacctatttattatctgcattttatggttaagggaactgggattcaggaggacactcaaagtcacacagcatagggtcagagtttgactctaggcctagtgcttgttccacatgacacagttgtaggcattccttcagctccagaaatgccaggtctgctcctctgtggacagaagggaagtcttgatgtgcgtacttggacccaaagaaacgtcctcagggtgatgatctaggctttctttaaccctggtgcattttgctcattgtttgggagttttgaaaagggagaaaagcctgtctgggcattagggtgagaattatatagtctttcctgaacctctctccttttagtctgagtataatgatcaacttaataaaaacaaaacctagatccagagagaaaaacttagtgtggatggagactagaccatgtggctttgactgtccctgagattcaccatcttcctggagggctcttgccaattcctattgcgtcttacttggcatgattcgcctgcttcccttaacaccttgtagcacagctgacatgaggctgggatgttgagaccattactgatggtccagtaaatcacacacatgaatacttggtctagatcattttatcccaatgtctgagatgtttgatgggacacttttattccaaatagttccttggaagaaggattctgtgattagatatttgggaaatactagggctaaacaaaatactagggctaataataattaaaacacctaattttgcttaatcattgcagagccatgttatgctgatggtcctcataaaactcccaagagctagttgtggaattcagcatttcctattctttaacctcaatgttctttttttcccccccatggagaccctatttattctgtagaatacatgctgagaaatgcttgtgtagctaatttggttcatgagctgagttgctcttggggcttacatggtttgagctgttcacctgaagcctgcagacagaaagatggtccctagggtgactccacctttttgttctattttgtattttttttttctcttagagactaccataaaatagcatttttaaaaatttatttttagagatggaggctctctgtgttgcccaagctggacttgaactcttgggctccagcagtcctcccacatgagcctcccgagtgactgggactccaggtgcgtgccaccaagccaaacttccctttcagttcttgacattccttttctgctttgtatcatgcatctccccagatctcccctaacttcattcaaccatgtagttttataagggccagcagactatctaggaagcaggagtagcatgactttaaagtgattctctgtgccaatctctgcaactggttcctttggcaggctctgacagattaccgggcagagctccgggatgacccaatcatcagcacacacttggccaagttgtatgataacttactagaacagaatctgatccgagtcattgagcctttttccagagtacaggtgagaaccctctggggactccatttctggccaggcattctcactgtagccacctcccttccacacctgtccagaatgggaactcacttctaggggtgtgcctggtgggcaagaggccaccaagagcttgggcctctgttgataaaatgaacaaaaatcgaggagagagatgctgtgggtagaggcatgtgggttgcccctgcatgtgttctgagcagtttcctcctcgcttttagtcactgcatgtgttgtacctgttttctgtattgggtgtgtgggataagagtctgtttattgtgtgtagcagtgaagggcaggcagatgggcagagaacaagagacttaagcacggccaaggagggtcttacattagaattttgagaaatacagcagttctccccctgttccctcccttctcttattggaggcaaaagtaaaactttcagtgttggtgtctctctgcctttccttttagattgaacacatatctagtctcatcaaactctccaaggtaaggagtcttaaggccatctgcagggaggaatgggacggggtggcgaggaggggtggcacatgcacctgattggcctcattggaaagctccccagcttctcagtggggaatgggcagtgtggactagagtaggagttgcattgttgctattttgttttcagtccatttggcctaagacccctccaacaaagctactgtgtcagggtgatctctgactagtggatactggtccctttaatcatgtgctttgattttaggccgacgtggaaaggaaattatcacagatgattcttgacaagaaatttcatggtaagtaacagtcacacaggcaagggggctggtggtggtgatgagatggttgaagaagtttattttcaaagaagatgttctatttgtttcccccgatggttcaccctggggtcctggcccctcttccctgtgatgagaatgtgtaataagcatgtgtacatggaatagggagatgaattctatttcccttcttttctggacacagtgagtcaactagggagtgggctgcttcacaaacacttttgtgtctaacctcatcttttacctgggttgcccttgtgtttcttgcagggattttggaccagggggagggtgtcctgattattttcgatgaacccccagtagataaaacttacgaagctgctctggaaacaattcagaacatgagcaaagtagtggattccctctacaacaaagccaagaaactgacataggtgagtgctggcttcaggaccccagggctgggcagctctgtcttctgcgtgtcgagactgaaaacctcctcctggtgtcctcatggcttcctgattgacactgctctgtcttctcttgcagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggctttttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtaccaggttttgcatcctcactgaatctgactggcttttattttcctctccaaaatcaggtttttgttctcaacatctttccccatcatgtctagtcactgttttggttttggcaccatcagtatcaaatgtacaaacggttcttgctaaccaacaccaggtatatctgatgttcagatgagttccaataaaaataatttttttttttttcaaaaggtgtctttttcttgagtgctggagggcttccaagcaagtccagacagctctgtgtggccccacactagtctagctctcatctggccaaagctgttatctcatttgtgtaatgggagtccttaaggtaaatttggggtccaaacttggagggctttgggggcaagaaagttggtgtgtgagttctgaggttggaaatgagttcaggtgtcttcttccagggcagcatggtccagtgagcacatgtaagtttgggcagtagatcctctgagcctactttctcttctactcagtgaggatgctgcttccttggcaggtgattgtgatgtgaagcttagtaagtcatagacgtgcaggtgtctggagagtcctgacatgcagttgtggtttcgtttccttttggaatcttcaaaggcagcgattttcatattgcctcacaccctggcgggggcggggggctctgggaccactgggggacctgctaaatcctcttcagtctgagcagttcagccattgtcagttttagtattgtgtctctgtatttcacttgcagaaagagctttgcttctataaaggactttaaaaagtactccaaagag

SEQ ID NO: 15454 - DNA, 11186 bp, Human; identical to SEQ ID NO: 12624
  misc_feature (1)...(11186): n = A,T,C or G

SEQ ID NO: 15455 - DNA, 8671 bp, Human
tttcctaatacagctcaagcttaaaaccttcaaagggactctgaattctccccccaaaacccaccgtcttttcctggatgaccgcagtcaaggagtcctcccttctcaaccatgcacactgtccatgcagcccccacccaaccctctccacacacccactgcagtgctcctggcctggtctctgggtcatccgggctgtgcacactagcccagccagtcctttggagcctacctcagccaacacatttttgcctcagacttccatggaccctggcttctccctggggtgctgttcccccgaccccactgccaccacatccctccagcctcagcctcgagcgaatccctcagcgagtctccccagccctcctgtctccgcaagcccaccccacatccctcgcccagtttctttcacacctcgcattgccacgcacactcactcactcccgagcctgcttctggctctgtgcctgcctgcactaaaagctgtggggtcaggggccatcatccctctcttcactgtgccaaaaaacaggcctgatgcatcaacacggatcgctgaaggacgacctgccttcaagcacgctccatctggggcaaggcgggcatgcactcagatggcgatgcactgatgggggtccactgggacttacatttacacagagctcgctggtaccgccggccctgggtgtgcctcagcacgtgttctgggcacttgttgatgtgccgcagggtgagtttgcagaacaactggtgcctacagagcagagagaccaaatttgtagggacagttcacagcaaggattcagactggtggctgtgtcttggactcatccctggacagtctaccatgcggcttggacatcgggcttttaaaggctcccggagcaattccactctgaagctgggtggggaaccgtctgacccaggccgactgcagcctcttaatgtttaccggaaaagcacgcatggcagcctcactgactgctccaggatgagttcatgcaagaggatggctccacctggagcaagggctcaatgaatggaaacatcctatctctgttttgacgattattacaaagcctagctcccagctaaatcaaagaccccttctggggttaagggaagaacccaacgctgttcacaacctcaggtgacaaatcacaagcctctactcatctgggaagcagccacaccccacaggacaaacctcaggtgagcaaacgagctcaccaagaggcctcgccgctgggaccgcaggtgattccagcacccgggcgcccacctgggtcccagggctcccaactctgaaagagtaggggctgcagcactggcggagtccagcggaggggctgtcctaattgccctgggcctccccgcgccgccgcggaccacctacgggttcttggtgctgggcacgatgtgcggctcgaactctgcatagtcgaaggccggggaggcgcggaccagccgctggtactttttgccgcgggtgtagacctggagctccggcaggcggcagggcagctcgtgacctgtcaggatgcacctcacctgcggacgcgtgggcgggcaggacgtcaggagggccagggctccgctccctggtgccccctcctgccgcgcccccttccctctcctcccctgatcccgccgcgccctctcccctgccctcccctctctcctgctctcccctctcccctctcccctgccctctcctctcccctgccctcccctcagcccctcatcccaactgcgcccttctccgccactccgttcccctcccgcgctgcgaaccttgcgggcgtccgtctggagccgcaggctcgggtgctcccgcagaaacgcccgcacgtcgcccggcaactcgctcatggccgacgcgcccgcggagcagcccggcggaagccgctcgcagaacctggagccgggggcggggctctgggcgggactcagcggcgccccggatgcagatgcctcctgcgtcccggaagcgcccgcggggccgggtgcgatggcggcggtggctgcgttgcagctggggctgcgggcggcggggctgggacgggtgagcgccgggtgcggggtgcggggtgcggggtgcggggtgcggggcgcggggaggggtcccggagctcagcccgcccgtccgtgtccgcaggccccggccagcgccgcctggaggagcgtcctcagggtctccccgcgcccaggtgagggctgcaggccgggctgtgatccaggcgcctgggcagagccacctgctgtctgccctgcactttgaagggttgtcgtggggattgaaatgaaccaactgccggctgagcggaggctccctgggagtgacaagttccgtattaaaatgctttcagtggaattgtggtcgtgtgccgggcatgtagcgagcgctttgtcctcacaacgcgagaggtagctccttggtcgttcccctgttacagagaaggctcgagagttacttccgaacgtcccatccagctaatgggtggccagcccaggctgaaagcccagggctctgaaagtaaagcgtatctaaccaccgcggcttacgtgttcctctcagtgtgcagcacagggctgttttgccgtgtgtagagtgctgtgcaagcctgccccaggcctgcctttttataaaaaaaaaaaaaaaaatagtatccgcaaggcccctggtgcttttcagcggatggaactcatcctctgagagcttaaaggcactttctgtgtacattcttccctctttacatttacgatgagttgtaaaaatggaaagctgttaagagagctctgtgagccattactgaattgatatatttttctacataacacaacaaccactagtgcctgactaagctacttagtaactgtagctgcttattttttattttttgagacagtttcgctcttgttgcccaggctggagtgcagtggcgcaatctcggcttacagcaaccacctcctcccaggttcaagcgattctcctgcctcagcctcccgagtagctgggattacagaagcaccatcgtgctcagctaatttttgcatttttttgtagagatggggtttctgcatgttggtcaggctggtctcgaactcctgatctcgtgatccgcccgccttggcctcccaaagtgctgggattacaggcgtgagccaccgtgcccggccaactgtagctgcttattaaatgcattttgaatggatgaatggtgcatcttagtgcagtggaatacatctagattcttgagtaaaaaggcatgagttactcagggtcgtggttggtggtcaaaccggcactgagccctagatcccacttactcacttggcagacgtactgtgtgtgccttgttctgggcaccgggttaggagctgggctggatacaggtgctgctagttggctctaggcagcaggttttgattggcagtactggagtctgtcttggaacgggctgctccaggtctgtgttcgagggcttctggctccatgtcagtgttgtgaaactctccaggggtggcctggaggccaagcagatgtggcagttctgcagcagaagcatctgccacaaaagcggaagatgactcctttcttcagtgggtcctgctcctcatccctgtgactgcctttggcttggggacatggcaggtaaagaccggcatctggtgtgcgtaactctgggcccttgaccttgctgccatctgcttggccttatgctctgtcactgtaggtccagcgtcggaagtggaagctgaacctgattgcagagttggagtccagagttctggctgagcctgtccctctgccagccgagtgagtgcatggctgcccccctagggcctgttttacttgagttcaacagcagagccctggcttctgctggccagcttgccccttttggtgggacttttagtcactgccttgacctcaggtgggagctctcattatcagtcatctgttgggcttgctgttgacacctgactgcccttgtgaagctacctgagaccgcctcctgacatatggaggaaagtcttattttgagtcctgggtgtcacccttttttcaggtatagtaaacttatcctccacagggcccaaggccctgtggctgagggcagataatgtaggtctcaccgtgagggtggtcgtttgaaaaagtgccctgaatgatttgtctgctctctccctagaatatgccctacagagataggtatattcagccacattttccattcagggtagcaaacagtatgccagatttggcttgcagatggggttttggcccacatattttttaaaatttcacataaaatattcattgaggagtccagatttttagcctctcttgtaaagttggactctggcagtgcagatccacattcccacatggcatcaaagttcccctttgaagagcacgccctttgcctttctccttcacttgtctggccctggtgggctgtgtagtctgccaccctcaggggattcgttttccagccaaaccttgctcggccactgttcttatctccatgcagcccaatggaactgaaaaatctggagtataggccagtgaaggtcagggggtgctttgaccattccaaggagctgtatatgatgccccggaccatggtggaccctgtccgggaggcccgggagggcggcctcatctcctcctcaactcagagtggggcctatgtggtcactcccttccactgcaccgacctggggtgagtaggacatgtgggagctggctgtcctggcagaggcagtcagggtatactaatttacatcactatttccttcacaatccccaaccttggtaggaccctggggaacccaagatacccaggagattcaattccttgcatagtttaagtccctaattgtgacattgacttaatcttctcagccagctcatttatgactggataatttctgtatgttgacctctgaagggaaaggagggattcgtgaaacaggggccctgcctctggagaactgtctagttgcccacacattagatgatggcaagctatgaggggccagcaagaggacttcaagagaaaggaccccagccctaccttgagggagtggaggcaggggtggctccctagagggctatttgggagttaagagatgggaagaacattccaggcaaagcaaatgacaggtacaggagcacctgtgtgattaactagggaactggaggattcacgtaaaaatgaaaatacctggggctcttgttaacccatgggttcctgttttagggctgggatggggcccaagtactcatctccagcaggctggggtgccagggctgctcctcacggctgccttggttaggaggagggattggagacagctcttgccatagttcaggggagaggtgtggggtctaaactctggcgtggcagcgttgctcaccagttgcacgttgtagtaggtagaccacaagaagcagagatagaaggggaaagccacactggtaaaaaggtagtgatggtggcagggagccttttaccaaccacgaaggtgcctcaagagaggaagactttgcctgtgtggcactgccagggctccactgagccagccctgttttaaaagccttccttggtgctctagttgttcctatgggtgcctgagtgaccatgagtgactgtctttagtcaaaaaccctccccacctgaagtagcactttcattaccctagagtcaccatcctggtaaatagagggttcgttcccaggaagaaagtgaatcctgaaacccggcagaaaggccaggtaagggacatggactcttcctactttagagaaggctctgggagtccaccaggctccatgcaatctcacacaccttcctttatagattgagggagaagtggacctcattgggatggtgaggctgacagaaaccaggcagccttttgtccctgagaacaatccagaaaggaaccactggcattatcgagacctggaagctatggccagaatcacaggcgcagagcccatcttcattgatgccaacttccgtacgttgtggaccagcccatctcggaacaagtagcttttgtgaatactgtccttcctcctaaccctcattgcccagtcactactgtggcttatgttctcacatgtgtatatggcgggtgggaggaggcagcaactcagcaaagaacctaggcaagtactgagcggacaagggcggggatggtcacccaacgtaaaggccatacaggacttccaactggccacgcaaaaatgacagccactaggaagtggtgcagaggctggcaggccagtagggggtggacttgagtctgctgtctccacagagagcacagtccctggaggacccattggagggcaaaccagagttactctgaggaacgagcatctgcagtacatcgtgacctggtgagtccccagcggccctctggcttcctccccttcagcctagcagcctgctaatgctggcttgctttcaacccctaggtatggactctctgcagctacatcctacctgtggtttaagaaattcctacgtgggacacctggtgtgtgacagatcagctgctgaagccctgtccctggataatgcagtatttcaagactgcctttatgctggatcatgtgctactggtataaagttctggccttctaccttaaatgagctcatgactggttcatcataaaatcctggcttggtttcagtccaaagaactttcccaaaacttgatattcaagttacatctctagggaacaaaatgcctggtttaagaatgtatttaagggtgggaagggccgggtgcggtcaggagctcagaccagcctggctaacatggtgaaaccccatctctaccaaaaacacaaatatgggccagccagttgggatgctgaggcaccagaatatcctaaacctgggaggcgaaggttgctttgacatcacaccactgcactccagcctgggcgacagagtgaggctgtgtctcaaaaagatacttgctaaccccaagtaagattcaacccgagatactcaacagacactggctgaaggaaaatttgtattatttcaattatttttatgtacagaaaactcaacagtgtacatttaacccagtttagtggcaagttctttagcctttgccttttcgagcttggcgatacgagccacagacttaggacccaggacattgccaccccagtgacggcggatctgaaaagacaaaaagaggcagttagcttggcttactgttttctgagattttcaaggttattagttgcgttaattctgtttggctgttccaagctgatcgtcagatagaacttctcataggttaagccagccagttatttgggagaaagatttgtgaatgacagtattttggtgtaaagctgcctcttacctcatcgtatctgtcattgtaattggtcctgatagcttccaccagcttagccaaagcgcctttgtcttccctaaaaggcaggaggggaaacaaaagtgggttttttgccttagtttcccttttagaatgcaaaaataccttttagctcaagacagtcttttgcctcagatgcaatgctgaccacatggtttattcaggtgaagaaattcttaaccatcattggcaaaagttcagataaatatatttcttaaactaaaagattggcctttaaggcaaaaggaaacaactgtgaggcatggattaaatgaactggggggaagtttggggccaggctgtgtacttacgagttcacctgtgtgaaggcgacagtggtgcaggtcttcctgtggactagacgtcccagtcttgcctttcccttgataatgcagtaagggacccccattttacgacacagggcaggcaagaagacaaccagctggaagaaagcattagctgaagactgtattttgaccaaaagcagcaaatttcagttagcttgtaacaattgctcagggttaaaaagctcatggattcgcacttcaaggttgaattcagtgagagattcacatcattgcaagagccacgcatgtgttggatctgtgtcagtactgccctcacccacttcggtcccatcactgacttggcattaggtctactctctcttcctggtactgccagaagcccttgggttagcagtcaacaggcaaacgcacctcgatgggatccacgtcgtgtgcaatcaccaccagctgagctttcttgttctccaccaaggtggtgacggtgttaactcctagaacacacaaccactttgtgagcactcacagggcctgctctagtcacaagaagctgctgggctcagctgctgactcagtgttaaaaagctcggttttactcttcacagtaatttcaggccaagaaattttacatcactgcaacagcccgcccccagtgttcaccctaaggtggggcctactcacctgctcgaaggacaggtggtctcttcgttgggacgtcccctttgccagcagccttcttctcggcccgggccaacagtctctgcttcttctcttgctttgtctctggtctgtacttgtgggccagcttaagcagctgagtagctggaaaaacactcttcagtttaggcttggagtcaaggttctaatccttgtcacttaacacttaataacaaatgctggactgcggtcctgctatatgacta

SEQ ID NO: 15456 - DNA, 6510 bp, Human
gccctccaagccctgtccagggctccagtccagacttcacgtccaggcccacagcgtgtcccagggagccctgcaaactcaacaccagctccccgtccccagcccttggcttaacttcttagcccgccgccaccttcgccacgccctcccatccgaagagtccttccaattcgacccctctgcaccgcctacatccacgctttccttccactcccactcaggctgccccgctccagacctcatccctgcactgcgggccccgctccctccagtctctgcgcggcagggaagaggtcctaaaaagtggtcattccaaccgggcgcggtggctcacgcctgtaatcccagcactttgggaggccgaggcagggatcacctgaggtcaggagtttgagactagcctgaccaacatggtgaaaccccaactctactaaaaatacaaaaattagccgggcgtgatggcaggcgcctgtaatcccagctactcgggaggctgaggcaggagaatcgcttgaacccgggaagcacaggtcgcagtgagccgagatcgcgccactgcactccagcctgggcgacagggggagactacgtctccaaaagaaaaaaaaaaggggggtaattccactccctcgcttaacatccctcatggttccccggtgcgccgggacaaggggctcaagttccgcgccgcgcctctcggcctctgccctccagccgcactggacggcctcggcgctggagttgcctggccctggggccgggcctttgcgcgcggtgctcagggagggcccggggccccctaggttcggagtctggcgcacgaccgagcggactcctggacgcactcgcattgtttgtgcccatttttggcggggtgtgggaaataagtcacacgcaggaaaggggatctccgaccccagcgcctacgcacccacccacccccactcccgcccacacacccaccccccctccatccccaccccccaccacaccctcatacccgccccagcgcccgcacaccagacgccgcgtccgccgggtcggcctagggcggggtggtcaagtgcctctgcgacccgcactttcccgcgtctctcccacggcctggccctcccgccgcagtctctcttccccgccgcgccgcggtccgaaaacctagtcagccgccgcagcctctcggccccgcctcgatttttagctttataggaatgctgttgctttaaatccgaaatcccgtgccggtatcaactctcgcgatctccgaggccgcatacatattacccacaattccctttcctttctctctcctcccgccgcccaagatggtgagtgagctgtagttccgtggcactatagccaggttccggctgtatccgctgccatcctcctccaggcgcggcctcggagggcctcctgctcctcctggcgctaggagagccccactcggtgtggcacggagacaccgaggtggattagagccccacttggtgtggcacggagacattgagatggactagagccccgggcggccgagagcggaatgcgttgttcccggtgtcgcagggctgggtgtcgcaggcctggagcaccgcagtgcggggctcggagccctagcgtctctcgggcttgctgggggccgctccagaggccttgtgagcgacgagttctgagcccgcccctgttgcttctagagcctgtggggccgcgactcagaggagtcatgagtccggggtgtctcctgggtgggcgacgcgaagagagcgtggtctcgggcttagccttgctctggccactcggggttcccggggctgcatgcttgtgcggctgaatgtgagatgctcctgtcgaggggtggtgctggggggttgcagaaagctgctcgccagcttagttcaggcaggtgctgtcagcgtcccttgttttggaggagccagcctgagccctacccccgacgaagcgagtggaggcggcggtttaactgacgttttctttctgcccagccgaaaggaaagaaggccaagggaaagaaggtggctccggccccagctgtcgtgaagaagcaggaggctaagaaagtggtgaatcccctgtttgagaaaaggcctaagaattttggcattggtaagtaacaaacggcagaatgaaaacggtctatgtttttctcaagggaaggtggtaattgggttgtgttgtatcttgtaggttttagtgggtgtaaagtggtcgcagtccttaatttgtgtctcttagagacgggggcaatgatacatgcttcttgctttcattgggagttgctgagcgagcattcagctcaatatggtagtggccttgaattcagcttagccatctggaaacaagtacagtagcagtgtcgcagcgaggtactaggactgcaattctgctgtacttcgtggcaccttggcttcttgttagatgaggaaaagcatcgtgctctttgttctcaggtgtttgtgtgcagatgatgtaaaagaatatttgctatctgagagatggtgatgacattttaaaccaccaagatcgctgatgcaccaacacccttcctagtggccccagacatgaacttgacatggaatttgagcctcactcggtgtcaccctttacttctcaggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacaggtgaggttctgtggcgtggaaaggagtttctcaggcaaggattccttatttcatccagaacatgagggggatggtcttaggcttcttgaactgcagttgtcattaaattatagtcatatagcaggaccgcagtccagcatttgttattaagtgttaagtgacaaggattagaaccttgactccaagcctaaactgaagagtgtttttccagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggtgagtaggccccaccttagggtgaacactgggggcgggctgttgcagtgatgtaaaatttcttggcctgaaattactgtgaagagtaaaaccgagctttttaacactgagtcagcagctgagcccagcagcttcttgtgactagagcaggccctgtgagtgctcacaaagtggttgtgtgttctaggagttaacaccgtcaccaccttggtggagaacaagaaagctcagctggtggtgattgcacacgacgtggatcccatcgaggtgcgtttgcctgttgactgctaacccaagggcttctggcagtaccaggaagagagagtagacctaatgccaagtcagtgatgggaccgaagtgggtgagggcagtactgacacagatccaacacatgcgtggctcttgcaatgatgtgaatctctcactgaattcaaccttgaagtgcgaatccatgagctttttaaccctgagcaattgttacaagctaactgaaatttgctgcttttggtcaaaatacagtcttcagctaatgctttcttccagctggttgtcttcttgcctgccctgtgtcgtaaaatgggggtcccttactgcattatcaagggaaaggcaagactgggacgtctagtccacaggaagacctgcaccactgtcgccttcacacaggtgaactcgtaagtacacagcctggccccaaacttccccccagttcatttaatccatgcctcacagttgtttccttttgccttaaaggccaatcttttagtttaagaaatatatttatctgaacttttgccaatgatggttaagaatttcttcacctgaataaaccatgtggtcagcattgcatctgaggcaaaagactgtcttgagctaaaaggtatttttgcattctaaaagggaaactaaggcaaaaaacccacttttgtttcccctcctgccttttagggaagacaaaggcgctttggctaagctggtggaagctatcaggaccaattacaatgacagatacgatgaggtaagaggcagctttacaccaaaatactgtcattcacaaatctttctcccaaataactggctggcttaacctatgagaagttctatctgacgatcagcttggaacagccaaacagaattaacgcaactaataaccttgaaaatctcagaaaacagtaagccaagctaactgcctctttttgtcttttcagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcagccagtgtctgttgagtatctcgggttgaatcttacttggggttagcaagtatctttttgagacacagcctcactctgtcgcccaggctggagtgcagtggtgtgatgtcaaagcaaccttcgcctcccaggtttaggatattctggtgcctcagcatcccaactggctggcccatatttgtgtttttggtagagatggggtttcaccatgttagccaggctggtctgagctcctgaccgcacccggcccttcccacccttaaatacattcttaaaccaggcattttgttccctagagatgtaacttgaatatcaagttttgggaaagttctttggactgaaaccaagccaggattttatgatgaaccagtcatgagctcatttaaggtagaaggccagaactttataccagtagcacatgatccagcataaaggcagtcttgaaatactgcattatccagggacagggcttcagcagctgatctgtcacacaccaggtgtcccacgtaggaatttcttaaaccacaggtaggatgtagctgcagagagtccatacctaggggttgaaagcaagccagcattagcaggctgctaggctgaaggggaggaagccagagggccgctggggactcaccaggtcacgatgtactgcagatgctcgttcctcagagtaactctggtttgccctccaatgggtcctccagggactgtgctctctgtggagacagcagactcaagtccaccccctactggcctgccagcctctgcaccacttcctagtggctgtcatttttgcgtggccagttggaagtcctgtatggcctttacgttgggtgaccatccccgcccttgtccgctcagtacttgcctaggttctttgctgagttgctgcctcctcccacccgccatatacacatgtgagaacataagccacagtagtgactgggcaatgagggttaggaggaaggacagtattcacaaaagctacttgttccgagatgggctggtccacaacgtacggaagttggcatcaatgaagatgggctctgcgcctgtgattctggccatagcttccaggtctcgataatgccagtggttcctttctggattgttctcagggacaaaaggctgcctggtttctgtcagcctcaccatcccaatgaggtccacttctccctcaatctataaaggaaggtgtgtgagattgcatggagcctggtggactcccagagccttctctaaagtaggaagagtccatgtcccttacctggcctttctgccgggtttcaggattcactttcttcctgggaacgaaccctctatttaccaggatggtgactctagggtaatgaaagtgctacttcaggtggggagggtttttgactaaagacagtcactcatggtcactcaggcacccataggaacaactagagcaccaaggaaggcttttaaaacagggctggctcagtggagccctggcagtgccacacaggcaaagtcttcctctcttgaggcaccttcgtggttggtaaaaggctccctgccaccatcactacctttttaccagtgtggctttccccttctatctctgcttcttgtggtctacctactacaacgtgcaactggtgagcaacgctgccacgccagagtttagaccccacacctctcccctgaactatggcaagagctgtctccaatccctcctcctaaccaaggcagccgtgaggagcagccctggcaccccagcctgctggagatgagtacttgggccccatcccagccctaaaacaggaacccatgggttaacaagagccccaggtattttcatttttacgtgaatcctccagttccctagttaatcacacaggtgctcctgtacctgtcatttgctttgcctggaatgttcttcccatctcttaactcccaaatagccctctagggagccacccctgcctccactccctcaaggtagggctggggtcctttctcttgaagtcctcttgct

SEQ ID NO: 15457 - DNA, 8264 bp, Human
aagtggtgatgagatgggagtgggtccactgagattctggaggtgctctgaaggcacagctgacaggatttgctgaagcattggatgtggggaataagaaaggagtcagtggtttcaaggtctggcccaagcacctggaaggatggagccgctttaactgaaaaaagggttgacagtgagaggaagagatggggcttggggggtcagatgcccattctgaactcagtaggtgatggtgttaagatacccagcagttcaggggagtcagcagcagcgtcacgcctatcctccatgaaacatcacctctaggctggtctgaatggcagtgggatgtcagaactaattaaccttagtgtcactatagttggcattcgacccccacactgctaaatttgactgccttttttaaaagtgaaaaaaatacatatatcttgagacagcctggcactccaggctagaatgcagtggcgtgatcttggctcactgtaacctctgcctccccggttcaagcaatcgtctcttctcagcctcctgagtagttgggactacaggggccggccaccacgcttggctaattttaaatttttttgtgtgtggagacagggtttcactatgttgcccaggctggtctccaactctagggctcaagtgatcctcccgccttggcctcccaaagtgctgggattacaggcgtgaaccactgcgcctggccaaaaaaatttttttaaatcacctcatggcagaagttaggggaagaaagtttagttctgtttcaaatacaacagttctgtttctaatatatatatcagcagccaccttttcaaattgtaatttaagactcttaagttctcccttctctaccaacggggtggccctggaaggggctctgggtccttaatgagcctgtaattttccagtgcaggaactggggtgtggtggtcccaagcctcaggccatgacctctcttttctcctgcccctagtgagttattataaagaccacatcttgtgttaaaaatcgcagtgtgggctgggcacggtggctcatgcctgcaatcccagcactatgggaggcggaggtgggcggatcacctgaggtcaggagttcgagaccagcctggccaacatggtgaaaccccgtctctactaaaaatacaaaaattagctgggcgtggtggtacacgtctgtaatcccagctactcgggaggctgaggcaggagaattgcttgaacccgggaggtggaggttgcagtgagccgagatcttgccactgcactccagcctgggcgacagagggagactccgtcaccggggtgggggagggaatcgtagtgtgtaattctatttttcagagcaaaagccactgcccagggggtcttccttgaacatgcaggctccctcccgcccaacacttctcccttttcccctgggctttctttggcgctcccctcacctgacagtcacacgcttgccaggtttatcagtcacctctacggcagacactcgccgagaacacatctgtgtgtgtgacacactgcttgtgtcccctaggactgaacctagggcctgccacgtgccaggcgctcagtctgtgtccgcctgagacctgaggccccccactccaaaggacggaatgaatgtactgctggtcattcattcatttcgcccctactcatgagcgcctgctgtgtcggggttgggggtgaggggagcacaggaacacgtgcgggaccggggtgatagaggcactgaggccaggccccgggggtgccctgctgcaccgactccgggcggagattggctgtcctcggcccgcaatgctgtgcgccccgccccgcgcgccgcttccggcggagtcaggcttggctaatcgagcgcgcgggctggcggctcggcgttcgtttggccgcgcctgcccgtgtggtggtttccggcggaggtggtgagagtcgcacgcgcagcggggaaggtgtgagtcgtgaacggcccgggtctccgccatggcctctctactcgccaaggacgcctacctgcagagcctggccaagaagatctgctcccattcggccccggaacagcaggcgcgcacgcggggtaacgcacagggccgggccgggactaaggggcctgcgaaacgggggacgcggccggagccggtgtagacgagtctgtaaagtactagaaaaaaaatctaagtgacttgtgaaattatcgccgtttcccttatttgttttttttgtttttgtttttgtttttggagacggagtctcgctctgtcgtccaggctggcgtgcagcgacgcgatctcggctcactgcaagctccgtctcccgggttcacgccattctcctgcctcagcctcccgagtagccggcactacaggcgcccgccaccacgcccagctaatttttttttttttttttgcatttttagtagagacaggagtaatggtcagtcagtgggaaaagaccctttcagtcccttcactacgggcatggtgcggtgtggggaggaggaggatggcagagggctcctgcgcttagggttctcatggcctggtgaccacgctgcacaagggaagtagataatcgggtggggaagccgacagcggggacgtgtcagtgctgtctgggcccaggaggagaggagagcagcagggtctctggaaccaccagaggtaaaacggggtttcctttttattcaaggacgatatattggttatagcaaatccaaaatcttaagtgaattttctcattacctagtatgtcttccgtctgtctttctcatcctttttgaaattttttttttttttcattaaaacgattcagctcctactttacttagactgatttctcccatttaaaatgtaaacattgtccggccgtgcggcctcatgcctgtaatcccagaattttgggaggctgaggagggcggatcacaagatcagaagatcaagaccatcctggacaacatggtgaaaccccgtctctaccaaaaatacaaaaattagccgggcacagtggtgggcgcctgtagtcccagctactccggaggctgaggcaagagaatcgcttgaactcgagaagtggagtttgcagtgagcagagattgcgccactgcacttcagcttggggaacagattgagactccatctcaaaaaagaaaaaatgtaaacataacccccagcagctaaaatgaaagcccttgccattgtgtttgatggcagcatggtagcttattgtaaagcagggccagaaattgttagtggaggtggatattcaggtttttctaatgtttcactcaaataatggtgatgaacgtccttgaagcctcatctttgtgcctgatgaattctcacaagcagaactactgggtcaaggttgtggttctgagctctaggatcagtgtctctggcccccgatcctgatcctctttcggcatcttcctgggatcaaagccttggtgagcctttcctgcctattgaatgggccatgagattgggacttaactctttcttattttgcatttcagctggcaaaactcaaggctcagaaactgcagggcccccaaaaaagaaaaggaagaaaacacaaaagaaattccggaagcgagaagagaaggctgctgagcacaaggccaagtccttgggggagaaatctccagcagcctctggggccaggaggcctgaggcagccaaagaggaagcagcttgggcttccagctcagcagggaaccctgcaggtgagaggcttcagggcatgttggttctgtgcagggcggggctggggctgggcttgggcttggtcccctttgctcttaagaaaaaaaaagcagcagcaggcgcacagggatagcacgagacttccccaagagcaaagatcacaggagtgctagggtggatgggaccgaaggaactgtgtggcattccaggccacatggctagcaggatgtcagggggcaaggctgtgtctctctgaggacctggagcagcttggcttgaagagcttccctgccctcaggtctctgcaggggccttgtgagagccaacttgttctggggcccaggctacaaaatttggaggaggtggtttggcttgcaccgtaggaagtgttttctcataccacggtgacctacctcgtgaggcactgagttacctgttctggaggatgttgtaggaaccagtccaggttgaagcggtggagtggaatttactggaattgccctgcagatccatgagtggccacagtgggacagggattcgtggccctagggagggagggggaggggaagagagggccccctgcagtcctgtctccttccctgcagatggcctggccactgagcctgagtctgtctttgctctggatgttctgcgacagcgactgcatgagaagatccaggaggcccggggccaggtaggcgggcaggtttgctggagtgccgtcactgctctgcctgtgttctccctggggtcagctgtcagcgaggggccgtagcccctgttctcccctctgcagcgagtctggcagggccccagcaggtgtgctctgggagagcagttattttcttggagaacctcagtccccaagctcatcagcctccttccttctgggaagctgcctttgctgaactgacactgggatgggcacctcctgtgtctgtttctctgaatgtcgtaatagtcctgtgagttgagtagggacttgagctgagtggccaggcacaggaagcaccaatgcagctctttgtgctgaatggtactgtctcccctgtgttggcccctacccacccttttcctggggcccttccttaaggcctcgtgctgtgtgggggacagtccccagctactctcctccgccatcccgaggtacagtgtgtggttcctaagaggtgagcaaggctctgggcccttgttcctgaagcacaggtctcgtttgggctggtgtagggctcttgttggcccggggatgggaaaggccattggggagggcttcgttgggtacctcgtgaacagaatgggcagcggtcaggacaggtgttcagacgccaactccaagttctaggcagtggtcttgaccctcctcatctataaaacgatgtatgacatttgaaaccatgtgcgtaatgtatcctggcacggggtaagcacccgggaattggaagctgtgattcttatttgggggtcccttctctcttttggggtcatttgctttttggggaacatcatggtggaacattgaactccgcgggccccttgtttgcgtgaggattttctcacctgccttccagccctgattcttctcgactatgggccaggctgggggaccctgggatcgagagaactttaatgagtgggtgcctctttcccccagggcagtgccaaggagctgtcccctgccgccttggagaaaaggcggcggagaaagcaggaacgggaccggaagaagaggaagcgaaaggagctgcgggcgaaagagaaggccaggaaggctgaggaggccacggaggcccaggaggtggtggaggcaaccccagagggggcctgcacggagccgcgggagccgcccgggctgatcttcaataaggtgagcgggagctgggtccttgggcgggctgggtcggcttcaggcctcagcgttgccccttgttagcttcatgatctctctccgaaccccatcatgtctgtaaggtggtgacggggacctcgcaggtcccttagggtactggccaaggctggggcctagtgcagggctggcatgagctgatgtcataccttcctcccaggtggaggtgagcgaagacgagccggccagcaaggcgcagcgcagaaaagagaagaggcagagggtgaaggggaacctcacgccgctgaccgggaggaactaccggcagctgctggagcgcctgcaggcacggcagagccggctggacgagctgcgcggccaggatgaggggaaggcgcaggagctggaggcgaagatgaagtggaccaacctcctctacaaggcggagggcgtgaagatccgtgacgacgaacgcctgctgcaggaggccctgaagcgcaaggagaagcgcagggcgcagcggcagcgccggtgggagaagcgcacggccggcgtggtggagaagatgcagcagcgccaggaccggcggcggcagaacctgcgcaggaagaaggcggcccgcgccgagcgccgcctgctcagagcccgcaagaagggccgcatcctgccgcaggacctggagcgcgcaggcctggtctgagtctttcccacctggggccgccgtcttccgtcctaggagactccaggacaccctctgagtccttgacgctggctctgtcccaggatctccacagacctcggcctctccatgtgagggggacacagtggtgctctgctgagttgtgagggcccagatcacagatcccatgtgagaaagagagagtttcagcgtcatccttgaacgcaggatccgggaccttcagacccagggaaagggtgagggagactggggcctggtctgctttcccgggcctgaaagcttccccgaggtttgcagggtcagggaggaggaacggtgggggtgggcagtcactgcctgttccccactgcctgtgttcgcaggagccacgggacagaagacggtggcctctgctgccgggccacgttagtccgcagctcacccgaacagaggacaaccctgaggtgtggcatatgggcacctggcactgggagtcgggggagcacgtccaggcgtggtgcatcctggggcagaacgccatggctcctccccgctctcttggcttctgcctgttggggtctcattcctttctgttccccagtgccccggggcggcattttactgctcagaatttggagggagggagcagtaccttcccggagtccacgcatgtgagttgggtcaagtgcattggacctagggaaagagaaagaaagaataaaagctggagagagagtgaagtgaatgcaagatacaaagtgggatggaagaattaaatccagagttccaggcaatcaaaatgagtgcaggttgaaagaaaacaggtgaattttagtggcatatggatgataaagctgtaaataaaattcttttgatgaaactctccggttacgagacaaagactgtaactgaacaggagctggtgtgactgttaccagacagaggcaactgatgaaaaagccctgtgaaagataggatgtgaggtgagcatgagcttgagctgagagacagacacaacagtatctgaaaagaatacatactctttccatgcatatatggaacatggatggaaactgaccacctactttgtccagaaaagaagtcttaagatatttcaaggaatcagtgtcgttatctgaccgtatcccaatgtcattaaaaaaaatttgagctatttttttttgttttttagatagagtcttgctctgtcactcaggctggagtgcagtggcatttcatatttggaatttttaaaacacacttataaattacctatgagttaaagaattccgaatggctattagaaatatttgggactaaaggataatgaaaatgctacgtattaaaatttgtggaacagggcctggcatggtggctcatgctgtcaatcccagctctttgggaggcgggtggatcacttgagatcaggagttcaaggctagcctggacaacatgataaaaccccatctctattaaaaataaaaaattagctgggtgtggtggtgcaaacctgtagtcccagctgcttgggaggctgaggcgggagaatcacttgaacccaggaggtagaggctgcagtgagccaagatcgagccgctgcactccagcctgggtgacagagcaagactgtctcaaaaagaaaaaatttaagatttgtggaacagagctaaagcagcacaaaaaaacatagcccctaaatgtatgtgcatctacagataaatagtgccatttatacacacatacgctgtatgtctgtatttttaaagctaaagaaaaataagcatgcagcttaagttggaacaactcaaagtaaatggaagaaaaatctccaaaactgactaaaagtaatagaaagcctgagttgtaatcactgatgaaattgagtcagtagttaagaatgttcccctagacggttttacagggaagttccacgatatagagaacaggtaattccagacgtagacaaattctaacagaatcaattgagagaacacttcattcgtgaacttagctttgatacc

SEQ ID NO: 15458 - DNA, 22071 bp, Human
tctatttctacgaatttgatgactccagtccctcagatatgtggaattgtggctgggcgcggtggttcacatctgtaatcccagcactttcagaggccaaggcaggcaaatcaccttaggtcaggagttctagaacagcctggccaacatggtgaaacccagtctctactaaaaatacaaaaataagccgggcatggtggcacacatctgtggtgccagctactcaggaggctgaggcgggagaatcgcttgaacctgggaggcagaggttgcagtgagctgagatctcaccactgcactccagcctgggagagagagcgagactctgccaaaaaaaaaaaaaaaaagttaatagaatcgcatggcatttttccttgttggactggattttacttagcataaggcatcaaggctcacccacgctgtagcaggtgtcagcgtctcctccctttctagggctgagaaacattccatctagagacagactcactccgtgcagccatgacgccttggtgaacaccacggctgcttccagcttttggctatggtgagttccgttgctaggaacacagatgtgcacatgtctcttccagacctcctttcaattccttgggtgtatacacaaaagcaggattgccagctcatacggtaataatatttttatttttatttttattttttgagaaggagtcttgctatgttgcccaggctggagtgcagtggtgcgattttggttcactgcaacctccacctcccaagttcaagcgattctcctgcctcagcgtcccaagtagctgggattacagactcgagccaccacgaccggctaatttttgtatttttagtggagatggaggattcaccatgttggccaggctggtctcgaacttctgacctcaagtgatccgcccgcctcggcctctgaaagtgctaggattgtaggcatgagccaccgcgcccggcctcgtacggtaattctgtgtgatgttttgaggaattgccacaattttttcctgcgcctgcaccagggacacgtctcggagctggcgaactggacttggggtgggagggaaaggaagcattaaagatgcccccagctttcacggagatgagaacggtgccccgggagggcgggacgggatcagggtcctgtgaacggggtatcagtgtaaactcctctgagagatatcaggaaaagcaggaagaagcctctgggacccttcgggaggtaactcctcttcgcagcggggcgcgctctcccagtccctgcagccgccgccgccctctcctgagcttcctcgagcggacgccaggcaagggcgggggtcgtagcggggcggagcggggctttgtccacggaccgcgcgaagaggcctcagggcccggcgcgggcgccggagggggactcgctcgcagggggaacgcgaaggttcctcagtctgcgggacgcagagctccgtggggccgcgagccggggccggggaagcgactctgcctagggggacgtcgcgggcgcggggcacagggtcctgcggggctggagggctacaggctgcggcgcgcgcgagccggaaggccggggatcgtgggttctggggccgcagcttcacgggttcgtctcccccgcctccccgggggagcaggatgtcagggggtcgcccccgcccgggagacagggtgtcaaggggcccccggggacggggcttcaggggcacccggagccgctcggccccagggcgggatgcggggacagggccccaaggtaccagggccacgaggggcgcgcgggtcccttggggatgcgcgcgaggaggcgccgtcccttcctagcaggggtccctggggacccgcggccgcctcccgcgcccctctgtcccctcccgtgttcggcctcgggaagtcggggcggcgggcggcgcgggccgggagggggcgcctcgggctcaccccgccccagggccgccgggcggaaggcggaggccgagaccagacgcggagccatggccgaggtgttgcggacgctggccggtgagtgcaggcctcggccccgggtgcccgcgagggagccgctaccgcagggaatgcggggtgcacccgacagccgggccggggtgggggcgcccagggctgcgaggcttcaggccggccgccgccccagcctccgagaccctgcgtcctggggagccggcgggcaggtgggctcggccgcgctgtgggtgcctgggacccgcagggaggatgggcgcggtggcgcggcctggcggggggctcgtctccggggtccccgggtcctggtgagagcggggtccctcgacgccgtggcggtctccagcctctcctcgcccctccacgctccccgccttccatgagctgctattttcagcacctaccgcccgaccctggactaggacaaggctctgggctgccctgcccgccccccagcccttccctcgggcacggcggccaggcgcccgggttgaccgggaacagcctccataccccaaacgcggaggcgcctcgggaaggcgaggtgggcaagttcaatgccaagcgtgacgggggaactgtgccccgggccctcaggtgatataggagttaagaagaaattattgaggcaaccagatgcggtgactcaggcctgtaaccccagcactttgggaggccgagggtggatcacctgtccttaattttcttggcgccagaagatgaattgagtatttacccagacaacaacgtcgcttcagagggagggatgcagaacgcagggccacggggcgcaggctgcaggccagtgaaccccaacgccaaaggccagggagagccgggtggggtacccagagccagcacacagccctttaatttagaggagtgctgtgtacacatctggggagagatgttttactttgatttggaatcaggtggcggataaggcatactgaggcctgacttggtgagggctcctgccccggaggtgcagccctggaggagcgggaggcagaggagtggaaaattcatgaagaaaaccgggtatggtgtaggtcgaggccctgccctcagtaatgctcaccatttgtcagtgtttactgtgaggcagcactgtgttcagtatcgctgagttctcaggaaggaacggtaaatacttcccgggtcattctttcacccacgggaaaacaggtttggagagatctgggacagtgctctggtcccaggcaggaagggctgagtggggcctgggactcaggtctgactgcaaacacctgcctcctccctgtgctgccagcgccttccgggttcttccctgtccctcctttgtggtctttgttttcccttttttgtcttaatatgtttcaacggatgtatacaataaaccgcacatgaaaggtacagctggatacatcttgacccagtcaagatgatgaacacagctgccaccccaggagtctgtcctgccccacgggttatgctgtcttagttggtctcatgtcagggagccttggaggaccagggtcgggcagttggtctctatactcctggggttctggcactggctctggcccatgaccgcacccaagacaaacgtcttgaagactaagaggttaggtctttgagaaacctggcaaatgagtgcccattctcaggttacccacattctgcatgttgatttagtcatccaaccaatgttggttgaacactgatgagaacaagcaggcctgtgctagaaggtgcctgcagccaggagctggtgagctggtgtccttagggacaccaatggcgagggacccagtgtgtggaaatctgggggacaagcatgccagggagaagagctcacatggggaaggcccggctccacaaatcagtcaggcttgttggggcgggcaggagagcagggtagtggagtcagagggagtgatcccccgaaaggcaggaagaggacatgagagagccttggagatgacggtgaggatgtggttggtgggcggtgagctgggtgtcatgtgctggctccttagagaatgctcagctccttcacacccatcataatccctggaggactgagaccacgtgcaggagttttggaagctggcagtgcacccagtcccggctctcctccattctggtgggtctcaccagagattggccaagaagagatcaaactgttcctggaccaaactgagggtggggctgctatctctcgtggcccaataacgagatgcagatgaactggggagaaagagactttttatttctgtaaccagttacaaggagaagacctggaaattatctccagaccaactcaaaattacaaagttttccagagcttatataccttctaagctatatgtctatgtgtaagtgtgcattcatctcaagacgtaagtaattgacttatgttaatctataactaaggtctgagtcctgaagaccttcctctggatcctcagtaaatttacttaatctaaaacccttatcttgtctcctaaatcatgggggtttgggaagttccttcagacccccagtaaacttatttgtggagtcctggggaatttcttcagatccccaataaaacttgtttaatcctaaatgggtcctgttaagaattccttcgttattttgtcatgcttgaaggcccaggaaaggtctaggcaaaactcttggtgggattttgttatattccagcctttttataagggcactggcttttaatatttaatttaaccactcagtcagtactgaaacagttgttagggaggcctgcgttagtgagacctgacctgccacaacacatcttactcggaatgctgcccataacttcaaaaaatcagctttgacggagccctactgaacacacctagcatctctcttccttcagcttagggtcaaggggctggggttgatggcaccattgaaagaaacagctttattgccgtgtcattgatatgccataaaattcacctgtttcaaatgaattattttcagttagtttacagagttgtgaaataaattttataacttttccatccccagcccaccaaaactccctggaactcctccgcagtcattccccattcccacctggcctcagacaatcactttctgtctctccagtcttgccttttctggacagttcctatgaatggagtcctgtgttacatggtcttttgcatctgacttccttcacttagaataatgattccgagattcatgtatgttgtagtatgtatcagtatttaattcctttttattactgaataatccattgtacagatagaccacattttgtttatccattcatcagctgaaggacatttcggctgtttctgcttttttagctattttaaactgcacgcagcactgctatgaacatttgtgtacaagactttgtgtgaacatgttttcatttctcttgggttgatacccagcagaggaattgctgggtcatacagaaagtctgatttaacattttaagaaactagcaaactgttttccaaagtgactgccccattttacattcccatcagcagtgtataacggttctaattttcttttcctttttcttttcttgagacaaggttttgctctgtcacccaggctggagtgcagtggcatgatcttggctcactgcagcctcaatctcttgggctcaattggtcctcccacctcagcctcctgagtagctgggactacaggtgagtaccaccacatccagctaatttttgtatttttggtagagatggggttttgccatgttgcccaggctgttctcaaactcctgggctcaagtgatctgcccacctcggcctccccaagtcctgggattataggtgtgagccgctgcgcctggctgagggttccactgtctgtacgtctgcagcaatacataccattcttgtgggtaaaaggtggtatctcattatagttttgatttgcatttccccaaggtcaaatgatggcaagtggcttttcttgtgctttttagccatttgtatatgtttttggtgaaatgcctattgaaatgttttgcctttttaaaaattgagttgtctcctttgttcagttttgagagttctttacatacacagtatcatatatatatatatatatatatatatatatatatatatatacacacaccagatatatgatttgcaaatattttcaaccatcaatagtttgtcttaacacttttttattggtgttttgaagtagaaaagttttacattttgatccattccaatttattaactttttcttttattgtgtatctggtatcatatctaagaaatcttaatccagtgtcacaaagatttaatcttatattttcttctaaccgctttctagtttatgtgtaagaatctgtccattttacctaagttgcataatttgttggcaaacagttgttcatagtatttccttgaaatccttttaatctctgtaagattggaattgctgtctcctcttttagtcctgattttagttatttgtgttctctctctctctggtcaatgtagctaaagctttgtcaattctcttgatcttttcagagaactgccatttgatatttttttactttatctttttctctctgttctctagttcattggtttcctttattaatttcccttcttctcactttgggtttaatttgttctgtcttttcttattgtagttacttacaatggaagcttacacacttgatttaagattttttttctaatgtagacatttacagctataaatttcccttgaaacacagctttagttatatctcataaattttggtatgttgtgtttacattttcattcagctcagtgtatcttttgattttcttctttgacccattgcttatttagaattatgttgtttaatttctatgtatttataggtttcccaaatttcttttgttaatttctgatttcattcccctgtggctagagaagaaactctgtggatatcagtcctttcgaatttctcagaattgttttatggtccagcatatgattgaccttggacactgttccatgtgcacttgaggagaacgtgacttcggctcttgccaggtggagtgttctagagatgtcagttggtgtccagtgatgtcaagtcatttgtatctactgattttctttctaattattctatccattactgagagtggggtaggattttggtgtccaattattgtttttttgtttttttttttttgtttgtttgtttttttttttgaggtggagtctcactttgtcacccaggctggagtgcagtggtatgatcacagctcactgcagcccccacctcccaaggcttaggtcacctcagcctcctgagtagctgcaactacaggcaagtaccatcatgcctagctgatttttgcattttttatagacagggttttgccatgttacttaggctggtcacgaactcctgggctcaagtgacccacccacctcggcctcccaaagtgctgggattacaagcgtgagtcaccatgcctggcccaaccattactggtgaattgactgtttcacccttcaattctgtgagtttttgcttcatgtattgctgcgggataattaaggaatcagagagaccgatggggttgaggaggaattatttaattatttaggcgcaccgacccaatcagattaacatccaaaggactgggccccaaacaaagagtcaagctaccttttaagcattttgtggggtggggggagatttgtgcagggggaagagtattacagaagcaagaaacaaagacagttattcagttaagacatgcattacattatttcttacttttcaaggaacaacacgttttatgactcaagattatctgtttagtgaccttgcagctgcacagctagagaaacagagtcttcgcaatgcctgggaaagggagagataaggctcactagccacagaaaaacagccagttaatttttaaaggactccagccctttctcttcctcaaggggaattggttttttacatacaactgagtttttgcttacacagtttttaatttcttttaattcctgttctagtattttggggctaggttgtcaggtatgtatatatttctgtttgttatattttcgtgatgtattcactttatatcatggcagaatgtttctctttagtaagatttttgatcttaaaaaagttggccagatggggtggctcatgcctgtaatcccagcactttgggaggccaaggcaggtggatcacctgaggtcaggagttcaagactagcctggcgaacatggtgaaaccccgtctctactgaaaatacaaaaaaattagccagccatgatggtgtgtgcctgtaatcccagctacttgggaggctgaggcacgagaattgcttgaacccgggaggctgaggttacagtcagccaagatcgtgccactgcactccaacctgggtgatagagtgagactctgtctcaaaaaaacaaaaaaattatttagtctgacgttagcatttctcctcaagctcccttacggttgtttgcatagcaaatctactatccttttgctttgacctatttgtatcttagtttctaaagtatgtatgtctctcacaggcagcatatagtcaaagcttaaaaaaaaaatccagtctaacgatctctgccttttgattggcatgttcattctattcccattcaatgttattattgctgtggttggatttccatctatcagttcacaatttgttttctatgttttatgcctttttgttcttctgttcatcttttactaccttcttttgtattaagtattttctagtgtagcatttaaattccctttttctttttaagtgtatattttaaagttattttgttagtgtttgctccagggattacaatatgcattttaatttatcaggatctacttcagattaatactaattttagtaaaatacaggaacttgactccagtataactccatttcctccctccttgcttgtggtttgtagtattattgtcgtatatgttcatctatatatgttataaactcaacaacatggtgttataattattgtttcacacaatcttatttcttttcaattcagtaagacaagtaaggagaaaaacacttttcaagtcttttatattacactgtatatttatcactgactttactcttgatttcttcctgtatattcaagttattgtctggtgacctttccttgctccagtatatataataacttcattgcctccttgctcctttatgctattattgtcatatatattatatatgtttatgctgtgagcccatcagctaagtcagcttagcaaggtctcaagatacaaagtcaatgaataaatcaggctgggtgtggtggctcacacctgcaatcccagcactttgggaggccaagataggtagatcacttgaggccaggagtttgagagcagcctggcccacatggcaagactccatctttacaaaaatacaaaaaaaaaaaaaaagttgagtgtggtggtgcgcctgtaatcccacctacttgggaggctgaggcatgagaattgcttgaacccaggagggagaggttgcagtgactggagatcacaccactgcactccagactgggcaacagggcaagacacagtctaaaaaaaaaaaaaaaagaaaaaagaaaaacaagaataaatcaattatttttctataatacttgccacaatcaattgaaccatgaaaaattttaaataccatttacagtagcatcataaaacatgaaatatttagagaataatttaccaaattaggagaaatgtctatacaattaaaactgcaatataaaccaggcaccatggctcatgcctgtaatcccagcactttgggaggtcaaggtggccagatcacttgagcccagaagtttgagaccagcctgggtgacatagtgagaccctgtctctacaaaaaaaaaaaaaaattagctgggcatggtggcatgcacctgtagcccctgctactcaggaggctgaggtgagaggatgacttgagcccagtaggcagagattgcagtgcattccagcctgggctacacagcaagaccctgacaaaaaaaaaaaaaaaaagaaaaagaaggtcacaaaaaaacagaaaactgcaaaatattgatgacaaaaattaaagaagacataaataaatggagaaatataccatgctcatggattggaagacttacattgctaaactgtcacttctccccagatggatctacagagtccacataatctcacttaaaactccagaagaaatttttgtaaagttgacagctgattctaaaattttacatagtaatcagaataggttgatattaggatagacagatagttcaatggaatagaatgcagagtttagaaatagacctacacagaaatagtccattgattttttaagagttgctttttgataagggtgctaaggtaatgtgatagagaaaggaaagtattttcaattcaaatggctgaaatgactggatatccattgagggaagaaagggactttagcctttcacacaatacacaaaaattatggaattctgaagaaaataagagaaaatgttcatgaacttggggtaggcaaaaatttaatagatgaggcaaaaaaaaaaaaaggcccaaaccataaaaatggtttcatttttataaggataaattagagtttataaaaattaacacttcccttcaaaagaaaaattaaggaaaaatgaataaataagccaccgactgagagaaaatatttgttttctaagaagtattttgtttttcattttatgggttcatagtaggtgtatatatttatggggtccctgagatattgtggttcagtcatacaatggaaaattcacatcatggagaactggtatccatcctcttgagcaattatcctttgtgttacaaacaatccaactatactcttttagttatttttattctttttttttttttttttttgagatggagtctcgctctgtcacccaggctggagtgtggtggcgccatctcaactcactgcaacctccgcctcccaggtttaagtgattctcctgcctcagtttcctgagtagctgggactacaggcacccaccaccacgcccggctagtttttgtatttttaaactttttttttcttttttctttttcttcttttttttttttttgagatggagtctcgctctgtcgcccgggctggagtgcagtggtgcaatctcggctcactgcaacctccgtctcccaggttcaggagattctcctgcctcagcctcccaagtagctgggattacaggcatgcgccaccacacccagctaattttttgtatttttagtagaggcaggatttcaccgtgttggtcaggctagactcgaatgcctgacctcgtgatccacccacctcggcctcccaaagtgctggggttacgggcgtgagccaccacgcctggccttagtttttgtatttttagtagagatgaggtttcaccatgttggccaggctggtcttgaactcctgatctcaggtgatccacctgcctcggcctcccaaagtgctgagattacaggcatgagccactgtgcccgacctctcttttagttatttttaaatgtgcaattaaattattattgactatagtctccctgttatgctatcaaatactgggtcttattcattctttctatttatttgtacacattaaccatccctacataccctctcacccctgccactacccttccaagtctctgcgaaccatccttctattctctatctccatgagtttaattgtttcgatgttttgatactacagataagtgagaacatgcagtgtctgtctctctgtgcctggcgagaaaatatttgtaatatttgtatttggcaaaggacttgtatccaaaatatagaaataaattctgctcaataataaaaagagaaacaacttaatgagacccagtgtctacaaaaagtagaataattagccgggcatgttggtgcatgtctgtagtcccacctaatcaggaggctgagggggaaagatcacttaagctcaggagttcgaggttgcagcgagctgtgatcgtgccactgcactccagcctgggtgacagagtaagatcctgtctaaaaaaaataaaaatagagggccaggtgaggtggcttatgcctgtaatcccagcacattgggaggctgaggcaggtggattgcttaagcccaggagttcaagaccagcctgggcaacatggtgaaaccccatctctaccaaaaccacaaaaaatcagctagatgtggtgcatgcctatagtctcagctactcaaaaggctgaggtgggaggatcacctgagcccaggaagtcgaggctgtagtgagccatgatcatgccaccacactccagcctgggcaactggagtgggactgtgccccccaaaaatatatataagtaaataaataaataaataaataataaaatgagctaaagatctggacaggcttcataagaagcaagcaaatggccaataaatacatgaaaagatgatttacctccttagtcattggacacacttagataccactcctcatccactagcatggctaaaggataaaagagtgaccatcaagtgttggcaaggactgtggttctcgtacattcctggcgggaatggaaaattcagtcaccactttggaacacagtttggcagtttcttacaaagttaaacatacacttaccatatgacccatcttttccattccttggtatttactcaagggaaatgaaaacacaggtccacaaatacctgcacatgagtgtttacagaagctttgttgctagtggccccgaacagtgaaaaaaccacagtgtctgtcaataggagacagaataaatgaattgtggcggattaacaatggcgtgcttctcagaaatgaaaaagaacgaacgattgatacacgtgacaatataggtgaatcttcaaaacagcatgcggtgtgatgcggccagacataaaagagcatgtatcagaggattccgtgtatgggaaacgccagggaatcagatccatggttgtcagggtcaggagggaccttactggggtgattacatgtgtacatacattgtgtgaaactcatcaaaaccgtatacctaaagtgggcacattttattggatgtaagttatccctcaaattaaattaattttcaaagttttaaaaaatggaaccatttttgccacattgaaggaaaattatttccaccaagatttccctacagccaaacgatctaccaactacaaaaatggaaaaaataatttaggacatgtaaagttcaaatgttttgcctcccacgtttcggtttcaagaagctattcgagataaatcgctccgtggtcacaggacttagaaaggtggaggtaaacacacacaagcattataagataagaagtaacagatgaattagttgaaagggactgatttcgggggaaggaataggaactgggccaggagatagacgcctttcaggcttgcccttgtgaaaacgatagtcccctcttacctgcgggggataggttccgagatccccagtggatgtctgaaaccacagatagtaccaaaccctacagagagtatgttttctcctgtacacacatacctatgatagggtttaatttataaattaggcaccgggtgggattaacaaccataattaatagtaaaatagaacaattataacaatatactgtccgaggcgggtggatcacttgaagtcaggagatcgagaccagcctggccaacatggtgaaacctgtctctactaaaaatacaaaaaattagccaggcgtagtggtgggcgcctgtaaacccagctactcgggaggctgaggcaggagaattgcttgaacccgggaggcggaggctgtagtgagccgaaggtgcccctttgcactccagcctgggcaacgagcaaaactccatctcaaaaacaacaacaaaacaacaacaacaacaaaaacaatatactgtaataaaggttacgtgaatgtggtctctctaaaaaaaaatgtgtatatatcttagtttgtgggttttttgttgttgtagttttgtttattattaagagacagggtcttgctctgttacccaggctggagtgcagtggtgtgatcatggcttactgcagccttcacctcctaggctcaagtgatccttccacctcagcctcctgggaccagaggcatgcaccactatgcccagctaattgttttttttttttttttcttgatagaaatgagttctcactatgttgcccaggctggtctagaactcctggcttccagcaattctgctggctcagcctcccaaagtcctgggattataggcacgagccacgatgcctgtcctcaaaatattttactgtactgtactcacctattattggcctttggttgaccatgggtaactgaaactccagcaagcgaaggtgtggataagggaactactgtacgtgactttaatatacataaaatcaccttaaagacaatgattgtttccagaacatgagcctctgagacagcagggagatactaggggaagttggtggctcctctccctggcaggaactggtctgggctcctggctcagcctggccatgaggctgtcctggcctccctcggtgggttcgacagtgacctcgacgtgctcatttcagtgtggttcattccggtctcccaggggaagggggtgctgagtggaaggaggtcaatgggaagccggggtggctctcagagtctgcaggagcagtcgggctgatgagctgggaggagcagaccgcctccctcttctctgagtgggaggagggccagatctggactgggtttggagatgctcaggtggggctcagagcatcacctgtggggcagagggaccatcttggcagatgaaggcccgtcgcagggtgtgatgcctgaattacaaggcgggacaggtaaagtggggcaggtgagagaaggagggtgagtgatgtgatttttctactcctgttttccaggaaaaccaaaatgccacgcacttcgacctatgatccttttcctaataatgcttgtcttggtcttgtttgggtaagacacatttgaccatcgaggctggcctggtttggggagaagtgaccacagcagccaatcagacccatggggcctccctgagctccccaagtatcacagttatcagggtcctaaggacagttattgcctgcgtccagctctggcggagggtgtgcttacttgctcccttattttagcctcacctgggcaacaggctcatctcactcccatttaaaattttcctaagtgtggagtctggggctgggagagcaagccccttgcccacaattgcgtggctgggggtggggaaggcaattctgggtcccaagctgttagtcgcttccagacacagaaggtcccagaaccaagagtgaagtcacctgtcacctctactggggcatctctggacacggcctggaaacactccctgacgtggcctcagggactgcactgatcaaggcactggtggcggggggtgagggagctggggctctggagctccagcaggtgcccatacgtgagcaatatcccagggaccaccctcctgcccacctcccggtgtgggacgtggcgaggcgcctgagctttgctgagaacttgccctacctgcctcgaggccttgcagcttcaccgggaactcttgtgctcacgctgctggccgcaccatgcactttttggaggaagggaccaacaggcagtcttcgttctgtgtcctgagtcttggcacacttcctttctgcagttacggggtcctaagccccagaagtctaatgccaggaagcctggaacgggggttctggtgagtgcagggaagagcaggtggagcatccatgctggccggggtgctggctgtgggcgggggtcccactctgggaactccccctccccttcctgggcccgctctctatgctctgcccagtgtagacatgctcaactctgtggccttgaagggtcacctggatacctctggagtcagccttgacctcccttctgacctccagtccccaactccaggcttacccagagttcccatgcatggtctctgctcccccatccccacccctcctccaccagccatcctcaactctccctttgctctcacccctacactgggttcccaaatcctgccagccctgctcttcagcagctcgcgtgcccactggcctccctgccttcgacgtcctgctccagggctccggtggggctgccctcatctctgtgacagcctcagacttgtctccccatccccatcagccctgtcccccttcttctcacagcagctggagtgatctttccagaacataaggtaggaggctctccatgatctgatcctgccttcctgacctccccagcctcatctctccctcctctgccctcgccctctgtgctccagccaacgtggcctgtcactcgtccacctgccatactgtcctgactccaggcctttgcctgtgctatggcctctgttgggaccactcttgtctctcccctgctgtgtctgctaattcccactcgtgtcagtgatccatggctgcagaacacaccactccatccatggaaaacaatcacaatcattgattactatctctccctgggcttcctggggtggactgggctcagctgggtggttcactttggggcctcagcagtcatgggcagacagtggctggggtcactgcaaagacttccctgcatctctggcagttgatgctggctgtcatctgagacacctacccagggcctctccctggggcctgggctcctgcttagcttggttgggaggctccaagaccaacatcccaagaaagatgagacagaagccagatcacctttttgggcctggcttcagaagtcacccagcatcacttctgctgcatttatttcttagaaacacagaatatcagaccccatctcttgatgggagggggcctcatggtttgtagacatgttctgaaactccactctgcccggccttggcttcgacgtgtctggtgaatgtgtgggctgtgaggctccccgaacgtagacctcagactgcaacgctggccgttacagggtctggcacacgggcccacgtcaggcccatcgccacagtgatggttgttctgtgactgtttctggtggcctctgctccacactccaggctgacgctgtgccccttccactgggaccctcgggtggcttccatgcacttgtgccctaaatcctgctcctagactaaacttcatctcctgtgttctcattctgcagcatggctgttagggaacctgaccatctgcagcgcgtctcgttgccaaggtataatgtcagtgcctcccttcagtggctcccatgtcacagaattgtcctgcagccctggcacatgtgtgccatgtgggagctggggcaggtcctctttcctcctgtggctccgagggagggggccgctccttccccagtctctaccctgacttggccctcgtcctgcagccactcagagagcacgatggagctggagcttcagttttgaccaaatgcgtgtcgccggcttttgtgtgtgtgtgtgtgtgatggagtctcgctctgtcgcccaggctggagtgcattggcaccatctctgcccactgcaacctctgcctcctgggctcaagtgattctcctgcctcagcctcctgagtagctgggattacaggcgcccaccaccacacctggctaatttttgtatttttagcagagacagcgtttcaccatgttggccaggctagtcttgaactcctgacttcaaatgatccgcccgcctcagcctcccaaagtgctgggattacaggcatgagccccggcacctggccttcaaattggcttttaaagaagatgaccagctggtctgttctgtctggggccttggagggctgtttcccaggatgtgggcctttatcagtgctgacctaggcaatcaaggccaagctggccacactgcttttgattttttttaaattgtgatgaaatacgcttaacataaaatttgccatcttagtcattttggagtgttcagtagctttaagtccattcacattgctgtgcagccatcaccaccatccatctccagaactcttttcatcttgccaacctgaagctctgtccccataaaatagcaactccattttccctcccccagctcaccattccatggtctgttgttatgagtctgctactccaactaccttttataagtggagtcaatggtacctgtgtttttatgtcgggctcaaatcactgagcgtgatgtcctcacggtccatccaggttgtaccaagtgtcagaatttccttcctgttttctgctgactccctgcttttaaaggccatcttggacattcaaattgtggccattactgacagttaaaatggccccggctcatgtctcctgagcctctacaatcctttaggtggggacagtactgcggcccacacgtccccacaggctgcgtgtgacacctgacagtgctttgtgccactgtggagcaggtgtcactctcccacttctcagagaggaagccgggctctggaagccagcagcccacaaggaggcccagcaggcttcgggcccaggtggggaggtctgcacatctcagggcctttccctgggaacaaccagggacagaggccacacacccagcctcctctctgcccacagtgaattgagacacaaccccttacgtccctcccagccttaagtcaagtggaaagcaatggcccctgaggtcacttagtccctcttgccagtttgtaagtgctgaatcagagactctgagctttggccctttcccgagttcccgggattatgagctgacacagcccccaagcaaccacagtgattccagcctgggagtgtggccttggcgggagggtcaatgcccagtcatggttcagcggctgtgcacacccctgcttacctgcatcccacgctttccatgcaaactcacgtggcggcgctttgtgcttgcaggatggtctacccccagccaaaggtgctgacaccgtggtgagtaaagttactgacactgaaactgaacgcagctcaaggggctgttctgaaggtattagagggcggtttccttgatgtaaatctcagttggggctgcttcgttctctcctctcagattctcctgacatctgaattcagaggcccacatggctgtcctctttccctttgctttctctgacttgcgtctcttgtttcctgtccctttgttctccaaagcccctgcaaaggcctgataggtacctcctacctggggaggggcagcgggggttgggtgctggggagggtttgttcctatctctttgccagcaaagctcagcttgctgtgtgttcccgcaggtccaatgttgagggagggctgggaatgatttgcccggttggagtcgcatttgcctctggttggtttcccggggaagggcggctgcctctggaagggtggtcagaggaggcagaagctgagtggagtttccaggtgggggcggccgtgtgccagaggcgcatgtgggtggcaccctgccagctccatgtgaccgcacgcctctctccatgtgcagtaggaaggatgtcctcgtggtgaccccttggctggctcccattgtctgggagggcacattcaacatcgacatcctcaacgagcagttcaggctccagaacaccaccattgggttaactgtgtttgccatcaagaagtaagtcagtgaggtggccgagggtagagacccaggcagtggcgagtgactgtggacattgaggtctctccttgtgttcaagacagagtggggtggcggccagccttgtcctcccagagggtagatgggaaaggtcattcatgcagcatcttactgagctcatgtgggctcgtgggctcgtgggctcgccaggtcggtaaaacccagctccttctccagaggctgcgtctcacccagggatggtggcttctgctgccccctcctctctgtaactgtggccggccgtcatgctgagccaccccctcaatacaaggctccagatgtttcctgctcactgaccagagatagcaggagggggacacctgtttgctgtccttggaccctagaaagaggatgctggcagagccgtggtcacttctctgtcagatgtaggtggggcaggcaaagcagttggccccagacaccaaaggaagtggctgacccacaaggccctgggactctgggccaggccagagagggagctagccaggcaaccgcagacacatacttgacttctcggcagctgtgggcagctgggccagcgacagtggcggaggccaggaatgacttactcttaggaataggtgcagttcaagcctggagggaggaagctctagggtgcagaggcgggtgtgtggaggcctcgcgtgcagcttataatgagggagcacgtggccggcctggccataagaggggcagctgcgtggggaggcgtggctcaggccaggctgagggggagtgagcgggcgccagcctgcggcctgctaccagcctccagccacctgccctcagccctccttagtaagagggggtgctggtggtcccccatcgctgggaagaggatgaagtgagtcgcagcccgaggactcgctcaggacagggcaggagaacgtggtgcatctgctgctctaagccttccaatggccgctggcgggcgggtgcaggacgggcctcctgcagcccaggggtgcacggccggcggctcccccagcccccgtccgcctgccttgcagatacgtggctttcctgaagctgttcctggagacggcggagaagcacttcatggtgggccaccgtgtccactactatgtcttcaccgaccagccggccgcggtgccccgcgtgacgctggggaccggtcggcagctgtcagtgctggaggtgcgcgcctacaagcgctggcaggacgtgtccatgcgccgcatggagatgatcagtgacttctgcgagcggcgcttcctcagcgaggtggattacctggtgtgcgtggacgtggacatggagttccgcgaccacgtgggcgtggagatcctgactccgctgttcggcaccctgcaccccggcttctacggaagcagccgggaggccttcacctacgagcgccggccccagtcccaggcctacatccccaaggacgagggcgatttctactacctgggggggttcttcggggggtcggtgcaagaggtgcagcggctcaccagggcctgccaccaggccatgatggtcgaccaggccaacggcatcgaggccgtgtggcacgacgagagccacctgaacaagtacctgctgcgccacaaacccaccaaggtgctctcccccgagtacttgtgggaccagcagctgctgggctggcccgccgtcctgaggaagctgaggttcactgcggtgcccaagaaccaccaggcggtcccggaacccgtgagcggctgccaggggctctgggagggctgccggcagccccgtccccctcccgcccttggttttagcagaacgggtaaactctgtttcctttgtccgtcctgttgtgagtaactgaagcctaggccccgtccccacctcaaatcacacacaccccctccccaccacagagacaccattacatacacagacacacacagaaagacacacacagacacaaaatcacacacacaccctccccgccacagagacaccattacatacacagacacacacagaaagacacagacacaaaatcacacacacaccctccccgccacagagacacaccattacatacacagacacgcaatcgcagatacgcccttccggccacagaaacacaccattacacacacatacacagaaagacacacacagacacacaatcacacgcagcccctccccgccacagagacacaccattacatacacagacacacacagaaagacacacacagacacaaaatcacacacaca

SEQ ID NO: 15459 - DNA, 26423 bp, Human
caatggtcttgaagtaatggctcatctctgacctggggtcccttcttctacaggtgctcctggattttactctccagcttccagttcttggcctccaggctcctcattctgtccaggtaggaggccaggcagttgttcaggttttgcacggtctccttcttgttctggatgcctctcattcctgccagacccctggccatccccgcggccaggcccccggaacccatgctgctcaggtagctggtggagcgggacatggagatccgggaaccagagcccccgtgcctgtacagacgctggctatgctgctgaccagccggacaccgtagctgggtgcctggacagaacccagggaccggtagttggtggagaaggtggagcgagtggtgaagcttatgctgtccagggaggagagtgagaggacaggactcaggctttgccgacgactttaatttttttttgagacaagatgttattgtgttgcccaggctggagtgtagtggtgccatcacagctcactgcagccttgacctcctgagatgggttcttgttacattgcccaggttggtcttgaactcctggtctcaagcaatcctcctgtgttggcctcccaaagggctgggattacagacatgagccactgcaccttgccaattattattattttttaatagtgacagggtctcactgtgttgcctcagcttgtcttgaactcatgacctcaagtcatcctcctgccttggcctcccaaactgttgagattacaggtgtgaaccactgtgcccagcctagtttttaattttaatgaagtccagctttttttcttttgttgcttgtgcttttgatgttatggaatttgaaatagtttcacctgggcaagattgatgggtagggagaaagaaggatctgaggggaagggagatggggatggcttgagattctatctccaattcaacctaagatttcagcaggtaactgctttatacgaggttttgcagctttatgtatatatgaccgataaattagaacactgaattgtgtttctgaaaggttaaccattgaacattagtgggaaacatcagtgtgtgaggttgtctttctaaaagccagtcctaaatggtacatgtagtaattagaagttaatgttttctggtttcaattaagcattatttgtaacaaagggaaagcatacatttttgggaaagcctgctatgtttcttttgttacactagccacacttttgggaagtcaggatatttggcccagatccaaacccactgtctacctggcagtagctcatcctcactgaaggaatattccatgggaaagatagccaaccttatgcatatcagccttggagcaagtcctgcatttgcctgaggtcacacagcaagttaactgggagtttcaacccaggtcttctcattttaaatctaaggctgtgtctctaggccgtgtatccaacataaaatcaggactatcatctgttgggctctatgactggcactactactactcactgttaccattttttgaggtcttctacgtgccaggttattgtcctggcaatctaatcctcccaaagactcggtaaatggttccataattatcctcattttaccactgaagaaactgaactctggttaaataacttgcccaaggtcacacagactttaactgtcaagagctcagacttaacccaggcctgactccaaagcctatactctgaatcaccaagcgagacctattttaaaggtgaccaggtcgtgagatatgatctcagcacggacccttctcccggatgacaagagagcaggtagttaggcgggtactccgtgtccgcgcatacccagactccgcccagcgcccgggcaggccaccccgagccccttaactgcgcaggcgctctcactcagaaaggccgctgggtgcggggagcgcagaggcggtgcagggcggctggctcgcctcggcgtgcagtgcgcgtgcgtggagctgggagctaggtcctcggagtgggccggagatggcggcggccgacggggctttgccggaggcggcggctttagagcaacccgcggagctgcctgcctcggtgcgggcgagtatcgagcggaagcggcagcgggcactgatgctgcgccaggcccggctggctgcccggccctactcggcgacggcggctgcggctactggaggtttgggccgcgtccgcgctttccccttccctctccccgcctccccggtccccagactggctcgtgcaagccgagtcccggggcccgggggtcgcgtcaactccgctggcgtatgtgtgcagattctccccgagtcggagagggaatccgcccagccagccgccttgtcaaagcgtcctgtccacgaccacagagcgttcctctgtcgcacgcgggcctcctgacccccagccccgggccttcttcgctgcacctcggctgctggcagcttcgatttttcgtttagggatgcagccgccccggccgggaggtgtcagccactgccaggtgtcagggcctcagctgtcccggaaagaggagttagactagttcttgattctggcctctatacctagaactagttgatggaagaggcagatcttggtgtttgttagggagagctttcaacaattagagttgccaaaagtgcaatggattgcttctcatgagcttcccgttactagaagcgctcaaataggaactggaagaacgcttacttatgtggaggagaggagattcagcaatcagaatctcctactcagcaatcagaagaagggactggatagtaaacctttaagattctaatccatagattccatgagtctatttcttggacatgtgacctctgcgatttcttggcaaaaactagttgctcaaaacgtgtttattgattgaagtaaattaaggactgatctctcattgcagattattctcttatagaatttgccactggggtcaactaataatctttaacaggatacttaaaatatagtttggttgacaggcagttcttcagggctgcctctataacatgaagtacatgtgttcctaaagctctatactgccctttgtcgagcacagtttagagctgtattactcttttttatcagccagatgtagtgagagtgagaagagtctgaggctggcagcatgtcttgatgttcatactaacaccgaaactgcaaattccagctacttttgatggtactggtctcatcctttctactttatagtggttaccttttattcctttctaaacttgaggcacgctagagtcagacagaaagttcatttgcactgattaattcatagtcatgattccataaaggtttccaggtctacgacatggctgtggaacggaaggtgcaaaatagcaaaaactgacattaaattaaacttttgatcatggaaagcaaggtagaatgaacattctttaagatttcttaggcagttccccaagaactgaactgtattgtagcattgtgtacaacccaccatgtttcaagagttaggtaagtgctgagatttttatctttgtgacacttttatttcatggtactatacaattttctttttctctgtgtgccatgacatatgccatgaaagactgaaaaaacttgcttagaatacgaagagtggtgctaaggtcctggggaaacagcaaggcatagcagcagagagaaatcggactttgttttgggcatgagttagcattgtttaggatcctgctcaagtcatgggctcgactactccagctttccctcttcttaattctcattgtgtttactgtcattccattcatttactttgctatttatattacatattctggtaggttcattcatttctatccatccagttggtactcatggaatgtttactatttgtcagaagtatacaagtaaaggcactcagtctaatgaagggatacagagagatgaacaggcattatagtgtgagaattgctgttaacagtggaaacaagtttataatctaatcctttcatttaatagagggagaaattgaggccagagaaggggagtgactgtagcagaataaaacatattaatctgtcttaataaatggaggtgtaacatactgtaaaatgtactcatctgaattttacctatgtgaatgcttgtgtaaacaccatcgtgatcaagacatgtacacttccggaaccttagaagttttcctattgcgccttcctagtcggtgtccactctctactctcagaagtaatactcttctgaccatttgattggtattacctatttccaaacttcatgtacattgagtcatacagtatctggctttttttgcgcaacatagtatctgagagattcacacattttgttgcgtgcattggtagtttgtgcatttagatgttgtatagattcttttgtattatgccacaattttttccattttccttttggtggctatttgggttgtttccactttggggctgttacgaatgaaacctctgtacacattcttttttatgtattttagtggacatacacactcacttctcttgtgtatatgcctggagatggaattgctgggtcataggagaggtgtagttatgttaagctttagtagatattgccaaacggtgattatatcagtttccaatctcaccagcaaaatggcagttctggttgttccacatcctcacacttggtattgtcagtctttttcattttagacattctggtgagagtctaatgatacttcattatggttttaatttgtattttcctaatgattagagataatgagaaccttttcatgtgctttttggccgtttggatatcctcatttgtgaagtgcctgttcaaatcttttgcctgtttttaaaagttgggttgtcttttactgacttagaggattttattatgtattctgaatgtgagtcctttgtcagatatgcatacgttagacctcccttttccaaggtttcactttctgtggctttagttacccacaatcaaccatggcccaaaatatgaaatggaaatttccgggtgcacacgtgcgcacgcacacacacacaacgcaccccactgctggagttctagctgagatcaccttgcatctttagataaatttgtgaagaattgacgtttttataatattgaggcttaaaatccatacacagtatatttctccatttaagtcctttttgatttctcttagtgttttgtagttttcagggcagaggttgtacacatctcttcctaggttgttatttcttaattctaattgtagattcttgtggatattttacacacataattacatcatctgtgaatagatgctgttttacttctttcttttcatcctttatgcctttttggttttcttgctctgttagactagctgggaccttcagtataatgttgaatagaagtagtgattgtggacatccttgtgttgtttgagatatattgaattcaaaggaattttctatttatgaacaaggtaacatacaggcttacctacttcaattgttgactgcttttacttacttttgtaggcatggctaatgtaaaagcagccccaaagataattgacacaggaggaggcttcattttagaagaggaagaagaagaagaacagaaaattggaaaagttgttcatcaaccaggtaaagtgagtttttcaaaaataagtatctagattggttattttgagtaacatgcataattctatgcaaagtgatgctaaataatgccataactactttaatcagtgagtacattatctttataaaagtgataaagtttggcagttttgctagtagattaaaaaaacaatcaaagaaacagccatgcatatggaaatgattatttaacttgtggctgatgtacttaggggttgctgctctctgttgttttataataggcagggttagccagtatattgattggtagaataaatactcaaaattatcttgataggctgaaatgaggcaccagaatccaagagataacatttaggacattcttttatttatctgtggagaaagaaagcagcttacaaagtataagatagaccagcataaaaagaaggatgtaactatgatctaaggttagtgctttggtaaatcacttatatgtacacatatcttcacagtgagggtactttcacactctttgggaaaaagatagaaacactttatttgttcataagtttggcagccaacagtgcaatataacagctttttattaaaaaaaaaaaaaaaagacctattccagtctttagttgcagctacagaagtgttgtgcattcatcaatgtaggtggttgctctgctttgatctatgtgtgtctatattgttgtttgcagaagctgagacttgaaggattaaaatatttgtttttatttgcatcagggactggttttgtggaagacaaaacccagggtggggttggggggtggctggggatggtttcaggatgattcaagcatattacattttattgtgtactttatttccattattattacattgtaatatataatgaaataattacacaactcttgcttatggtagactgccagtttctgagtggtaaatgtaaaagggagtgacagtttgaaaattatcattgtgtttatttaggaattcccattataaagaatattttaaattagaaaactgcacattttaaatgttttgattaataatgctatgtaatagcttcctaattggtatttctaccacactttctcttcattctaatgcatcctggtaaatttttcaaagataccactttgactatcactagccttgttccaaagtttttagttttccttttgtctatagatatgcttctctaatattctacaaaaaaagcatgatttttttgtttgtttgttttcttaaagtttggagattagtgtgttataatgaaggaggtaagggaaggcagtgataggaatattttgaaacaaacaattaatgacataatgacaattccccttttcttttttttttctttgagacagagtttcactctcgttgcccaggctggagtgtaatggtgcgatctcagctcaccgcaacctctgcctcctgggttcaagcgattctcctgcctcagcctcccgagtagctgggattataggcatgcaccaccaggcccagctaattttgtacttttagtagagacggggtttctccatgttggtcagctggtcttgagcacccaatctcaggtgatccaccctcctcggcctcccaaagtgctgggattacaggcgtgagccactgcacctggccgacaactccttttttcttcttgttggaaattgtggcagttctgagagttggagcattcagcctaaagacttcttagtaaaatttatttatttacatatatatatatatatatatatatatatatttatttagaaagagccttgctctgtcgccagcctggagtgcagtggcatgatcttggcttactgcaacctccacctcctgggttcaagcgattctcttacctcagcctcccaagtagctgggactacaggcacacactaccatgcctggctaattttttttgtttttgtttttgagacggagtttcactcttgttgcccaggctggaatgcagtggggcaatcttggcttgctgcaacctccacctcatgggcacaagcgattctcctgcccagcctccagagtagctggaattacaggtgcccgccacccagctaattgacacctggctaatttttggattttttttgtagagacagggctttgccatgttgaccaggctggtgtcgaactcctggactcaagtgatccacccaccttggcctcccaaagtgctgggattataggtgtgagccactgtgccagccttactagtaaaatttaaagacttgctgggagaaacagttcttacaggattaagttccttagctaggcatttgaagtccttaaataatctagctttaccttacctagagtggtttttctgtgctgggagttgaggatacatggctgaatacagcctctccccttaaagagtttataatccacaaggtgagacagttgaagaagctatttgctttgttggtaggggatagaatggagggagacaaaatttttttccatttggaagtgaattctgttgttgtctctcttctattaccatgctgtttattgctttttcttgtgcaatgttggtgccctgtctgtaagcagatccctttttgccctaccactctgggactaatctcttttgtactttcagcagtgctgtggtgggcagaataatggcccccaaagatgtccatgccttaatcaccctggaacctgtgaatatattatccttatcatagcaaaaaggactttgcagatatgattaaggttaaagaccttgacatagggagaatatcctgggttattcaggtagacccaatgtaagcacacaggtttccttaaaagtggaagaggggccaggcacggtggctcacgcctgtaatcccagtactctgggaggccaaggcaggtggatcacctgcggtcaggagttcaagaccaacctggccaacatggcaaaactctgtctctactaaaaatacaaaaattagggctgggtacagtggctcatgcctgtaatcccagcactttgggaggctgaggtgggtggatcacgaggttaggagatcgagaccagcctggccaacatggtaaaaccccatctctactaaaaatacaagaattaactgggcatggtggtgcgtgcctgtaatcccagctacttgggaggctgaggcaggagaatcgcttgaacccaggaggtgaaggttgcagtgagctgagattgcaccactgcactaaaacctgagcaacagagcgagattccatctcaaaaaacaaaacaaaacaaaaacaaaaattatccgggcatggtggcttgcacctgtaatcccagctacttgggaggctaaggcaggagaatcgcttgaacccgagaggtggaggttacactgagctgagatcgtgccactgcactccagcctgggtggcagagcaagactccatttcaaaaaaacaaaaaaagtagaagaggaaagccaagagtcagagggacatgtgattatggaagaagtgggtgatgccatgtgagaagccaccattgctggctatgaagatggaggaaggggtcatgagtcaaggaatgcaggcagcctatagaagctggaaaaggcaaggagatggattcttgcctagagcctccagaaaggaacacagccctgccaacaccttgattttagcctgctgagacccatgtcagaataaactagagatccgtgtgataataaatgtgtgttgttttaagtcactctgtctgtggtagtttcttataactaatgtagcactaatacaagtaccttgtacatggctgggattcagaaatatttgtggaattgctacgtttttttctttatgttacttccttttcttttttcctctttaatttttttttttagataaacataaggtcttattttgtcttttacttaaatgtatttatgtcaggcattgcatacatgctgataagctaataaaatagaggaaaatatattgttctagtcataaaaaaggaaactagagttcattttccttttcttaggacctgttatggaatttgattatgtaatatgcgaagaatgtgggaaagaatttatggattcttatcttatgaaccactttgatttgccaacttgtgataactgcaggtacttattttagatggtgttcttaattgctaatgtttatgtgtaggtttagggcaaaacaagttatatctgtttggatttgatattttcttagtaattatgaatttcattttgggtgtttcctaaaatttctatggtttctattttgccaaatactgtaaatctgtgcttattaaagcttatgatataccccataaaataggaaggatgccgatggttctgccatagaaatttccttttctttttctgctggcctgagtttttttttgtttttgttttttaacgtctctcagtagtaggctgctaacccttctcttcacccagccctaatgatccctctatttcttaattattccagggtgtgttacatcttggtcagaggagtggggccttcagtgaaaggacagtagctccgaatacctttttcattcatcttttgctaccctcatagagagaatagatgaggaagaactatattcttccattctttttcttcttctagactttatcctttttttttatatcacccagaataacctttctcacttcacgtggttctcctatcactactgtttactcagccaaatgctgtgttgatatcttttgcacattgaaggtcttatcttggaatcttagttggccctcttacctgttccctgtgcttactttgtccctacagtcctaaatcaactcctcacctgcctgaaggacctgccctttcagagtccctgctgcagacattgggagccatcatgattggcttgttgctgagcagaatccttggtagatagagagggagatgtggtccctggtctcatgatcagatacatggctgggaatgctctggcaccacagctggaactatagattacaaactcatttcccaccgacacagtggttaaagtccacagtattgtcgtcattcttaaaggccagtatagcttttgggaactgaaacactacatagaattttatttccaagagaaaatggaagcaactcttgtaccagtttaaagaaagttgtgaatatattaccttgccatagcaaaaggactttgcagatatgattaaggttaaagacctcgagatggggagattatcctgggttatccaggtagaccgaatacaagcacatgagctttcttagaagtggaagaggaaagctgagagtcagagggacatgcgattagtgaagaagtgagtgatgcaatgtgagaagccatcatcactgcctgtcaaagtggaaggagggggtcgtgttcaggaatgcaggtggcctctagaagctagaaaaggcaaggagatggattcttacctagtgcctccagaaaggaacgtggtcctgccaacaccttgaaaagtctggaaacattacacttttatatttaatcataatcaggaacacagtcctccattctttttcaacatcatcaaagatgatagttttagtaccatatagtctacatgtctcctgttagtttatacttctgaattatttagcttttgtatagctcttcccagttttaacttttatgtttttgtgatagaatcctctgatagaacctttgatttctcccctccctgatctgtacctgctctttagtgtttaccatttcagtaaagccagcttcattcgctggctatgtctccactctcctgtgtgtattaattccaaacctgtttggctctaggttcaccatatcctgaattcatcggcatctcatcctctcccactgctgccttagtctaggccaccatcagctcttgcctggaccaccgcagtagtgttctaactggtctctcccccattacccctttcgcacccctagggtctccttttcatatagtattttgctcaaaaccttctagtggtttctaaccattgtcttcaccattgcttgcaaggtcctgactgtctctgactgtatctcccaccactcctcaccatcgcttacttcaggtcttctagttacactggtcctcttgctgtaagctctctttgcaaaatacacccctgccctagagccttttcccttgctgttccctttgctaggaatgtttttttctctagataatgtaacttaccagaataagtaaaagataaagtatttttctgttagaattcttatgttgctaatttaaccatgagagttgcaggaaaaagtattttatatgtcctttttgctgtgtgtgcccctaagttgctgggctatttgcaaacttagcttatttaaaataactaatttatataatggacttaatctgttttcagagatgctgatgataaacacaagcttataaccaaaacagaggcaaaacaagaatatcttctgaaagactgtgatttagaaaaaagagagccacctcttaaatttattgtgaagaagaatccacatcattcacaatggggtgatatgaaactctacttaaagttacaggtctctaataagttgtatttattatttttcactctggtaaattcttaataacaaactagtcataattggtttggcttttgcttacagagtgtggaaaaactcttttccctagttttgcatatgcttcacagtcatgtataatgacatttaataacatgttttctcattttgcttttttcttttcttttttcaaacaataaggtctcactctgtcactcaggctggagtgcagtggtgagatcatggctcactgcagccttgacctcccgggctcaggtaatccttccacctcagccttctgagtagcacctggctagttttttgtattttttgtagagatggggttttaccatattgcccaggctggtctcgaactccagggctcaagtgatcctcctgctttggcctcgcaaagtgctgggattacaggcatgagccgccacgcctggcctcattttgcttctaatatggcactttgaaagaaacctgttgctattgggtgatgttaagagtacaatttggaaactaaaaaaggttggaatgggagtcaggccctgtttccttaccctctttcacctccatctcccaccaaaaaagaaatattttaaaaaaagaaaaatttcaagaatttcataaatacctaaaatctaactctacccatctggaatgctagcgagtgtccatatagctctataatctcagagcagatcgtctcaactccacttgctgcagatgggttataggtgtgccaagacggtgatccacttagtggctaggactgctagtgcccaggccagtttctttgagtcacaagcagcctcttgtatctacctcagagtggtacaaatattgtaatattctttttgtgctgttagcttaaaatattgggaggcattgctttagagcacagtttgaatatatactatactagaaaatcccatatctccaaataaaattaagaagccatattgtaaaacaaaacgtgtactgaatttcattaaatactaagattctgttgattagaacattcactattgttttatgtaccattaaatatttttaaatgccgctgattaaaatcaacatatgctttcttatcacttgatgctttttatacttggtgaaatagtgccattagactttattatagtttgtcatatatcacgacttttgcacacataaaagggaaaatgcaagtgcaaaagacttatgaaggtattcctaaactttacattcagagtccaattcttctgcaccactttttgactcacagttgttaaagtaccattaagtgcattggtgatgcagcattttcagggatgttaaattgcggaaaacgtgatgtctcagaatatacgaaatatgagtgtatcacttgattatgttaaatttgagtttggctatgctgattaatattatggtccttttaacatattgtgagaggtatcctgagcataattcttagtgtgtaaattctcttaaaatctaagtaaatactataaagagtaaaggtatataatgtaaagttttaaaagtagaatgaagactttttacatcatcttggtaccaaaattaaaaaaaaatatatcctgcagatcagaagtcaagtcgatagagacaattattgatcttgaaggagatgagtagtagtaattggtaatttcctgcggttggagatttttggagatgacctcatatttaggtctgatgtggctaatctgtcaacaaactgtttctttggtgagcccaccacagttgatcaaactcactgaccacgtgtacttttgattcctgtgacaatacagtcagaggacaacttttctatttataatctaattcagcatacgtttactgacagtttcataggtttagatagatgttttattagagttgtttctgatcattaatatttaaaatctttaaatttctaataagtatttataaatttatacttgagttagatcattctttggtacctttggatttgacagttataactataatatttcgcaagtctgaatcacaacttatttaaatatggattttgtgttgtagattgtgaagaggtctcttgaagtttggggtagtcaagaagcattagaagaagcaaaggaagtccgacaggaaaaccgagaaaaaatgaaacagaagaaatttgataaaaaagtaaaaggtagatggccacattttatatcgtgaaggattgtgttttaccattttgcaaaaagcctttagctagattcttcctgtttaatgtcaccaatagattggaatgtgttttttagaggttgaaaaaaatgacttacagtttgccctcagtatgttggtcttcaaggcactaagctcaaacctcacagtacgacatttctgaaaagcatgtacgtcatcatcttaaagtgaatcatgtttttatataggaacaatgtgaggatcaggagtggtatcactggtcaaggatttggcatcaattaaatcttaagtatgatcaacaggtgtgttataaaaaacacacctaccaacaatcccctctaattgcttaaaatgaaaagccatgccctaagtcttagtcatctaattcagcagctagaaggaacttttattttatatatgaccaaaagacccagaaaggtggagtgacttgttatgtagatagttattggcagagttgggactggaagcagggttttttgactgaaagtctccatgaagtagtcatttctctatccatgcatctgtctttgcatgcattcccttgtccatctatcgctgcattaatttgtccctgttatccatccaggtatgtatgtctgttaagtctgtctgtatgttcatccatccatccatccatcaatacatccagtatttactaagtgtcagctatgtgccaggcactgtgctaacataaattctggagtcagagtttgtcaggagagaaacttaaaatcgtgcaagtgtgctaggtaccatgatagtgatgaacgtgcggtgctgcaggagcacagaggtcactttgtgctctatcacagaatccctaaaagagtcttaaaaaaggaaacatacatgttcttcatgcagtaattatgcagagtcccattgtagtgtacagtgtgtagagataacacatactttatgtatatattcggttttatatatatactaaattaattcattgaaagtgaacgtcctatccatataattttgctcatgtttttaggattcataagtggttttggagagtgaataaggtcagatgtcttaaaaacaaaaaagcaaaaccaaaaattgaatgtaagccttccttgttgtgaggaacacaagttgttgtaatccttctcattgtgaggatttgtttttcctttgtcattacaagtgtaattcagttacagtgcagaaaagagaattacaaagagctcttattgcatgattttcctactcagagacaatcatcagcaacattttaatttttgctcttcctgttcttttctatcctaagatccttaaattttttttttaaataaaaatggaagcactgtttgacacgaagttaagcaactccatgatcaacatccttatacacatctttttatatagttacttagcaattcctgaatcacaaggtaaggcacacattcatggctttgtagagaggtttcctgtaataagctgtgccatataagagcatttcattaaagaaccttcccaaaattagccactgctgtattgagaggatttggaaagagttctgatgaatttggccctttaatcttttcagtgctttacaccagtccttcctctgtagtagcaaggagaaccctgaaagataaagtagtgaaaaggcattttaagaggtgcgaaagggaggacagagtgatagattagttatatactagcctagggttttttgttaactccagctacctgaaatcacctcaactcttacctctttgctgcctccttaaaccatttccaggtggtattttggtgcagataataatacatggataaaataataagtattaattaaaaacctgtatctgcaaagtgatgaaatattttttaaaacgagggctgtctgtactttcttagatactaattctgtaatttggtcagtgtcatctaatggtaactaaattcctgtaatttgacaaacagattgaaagatgatggcatccatttcatcacatgctttttttaataagaattctatgtggcatatatattagtagtatgaacagaactcttaaaagatttagttttcactggtattactttttaaagaaatataaactttaatataattagctttttttctcattacattaaattgctgctgttaatcaccagataagctactgtcaattgtcctcattttcgaagagtttgaatttgccctgaagtttttcatagagttagacctcttgggtctggtttctttttcagttcgcttgttatttgaatgaaggatgtcttttgaggacattttccaaagtggttacatgagtgatatattttccaagtgtctctgtaaatagaaatgttttactgcttttgtgcatatgaatacctaagttctgtaacattactccactgtcttctggtgtttaatgtgcagagaggtcagtgtgatgccttctttaattatggcttcttgttgatttactttagaggttgttcccgccttcctgaataggccacaaagggctgagactggagtagacactgtagagattagacacaaggagcttactgtgcagttttctcagaaggctcagaacagagaggaataaaagcaagtctaaaagtattttagttgaaaagaaattggaacctggttcctcttggtcttctgattttgatccacaaagaagctgacacagtttacttctttatgggaaggtaagagattatatttacctgctttgagaatatgatcttctactttagcagtttgagaattgatcttactaccaaaaagaattttacagtttaaatagtataaggtgtgtatagatagatagatagatagataaaaataaggtgaaagacaagaaagtgttttcttgttagtgaattcaaattgttctgccttgttagatacaaggcagaaactgctgttcagtttttttaactggtatcaaaactctgtatcaaaatattcaaaggaccgatagagagtatttggagagttcttttgaatttggccttttaatcttttcagtgccctacaccagtccttcctctcttcagtagcaaggagagccttgaaggataaagtagtgaacaggcatcttaaggagtctgaaagagaggactgttacacattacagaaatcagttacagaatatagaaatgttttgatttcaaaacttcaggatgcacaggccttaatattagatgggaacgttcagctggttcaaatgtacagaacgttttgggtttgcatgtctactctataaataaggtagagataaggcatttctttagttataccagctttctcttattccatactggtagaggttacccttctaaaaaaaggaaaataaattcattttcattatttattactatgtactttcctcccaaaagaggtaggtaagaaatctcttatgggggtcccaagtttgtggacattgtacattgtgggcctgtggttatatttatgactctggagtcatctctcaagagagttcgggagactcagttctctgttactctgctttagtttatggaggactaaagaagaccaaagcatcatattgtcattgtgtcttttccttgtaattttttttcctcctgttaacaaggggcaccatgagtcaatacttactgtcctaccataaagtatttagaagtatcttgtctctcgcagctagttgtcttttaaatttacctcagaagcagcattgggtttccatgaatacagaccacctcttttgcaaaaccaagatgttaaactgaatacaagttttagattggtataaaataacattttcatttaaaaaaggatttaggagaattttttcgtctgtaaaaagtataagcagtccctgaatatatcagtaacaagactgcttacactgaaaattgttataaatttccatgaaaggcagtccttagttaatagcttccagcattgtgaaattctaggccaatggaactaggaggttggaacgtggtaaaccactgttttgtctccagcttcaattaggccttcagtactgcgtaggacctgcacccaccccaggtttcctcagctccccgaaagtcgatttcagacctacagaccttttttcactcttctaaagccttaccttgtttttaaaactacctccttctcattctcagcagtaggtagttgatttctgctttcctaagttttaagttgttaaatgaagtaatgtgaaaaaagtatttatcttaaattttttttatttacctgatgttgacatttgccatatttactttttctttcacacacacatattttgccaagccatttaagttgcagacattgtgattcttataaacacttcagcatgtttctcctcagaacaatggcattcggctgggagcagtggcttatgcctgtaatcccaacacttctgtaatcccaacacttcaggaggccgaggcgggtagatcacctgaggccaggagtttgagaccagcctggccaacatggtgaaatcttgtctctactacaaatacaaaaattagctgggcatgatggtgtgtgcctgtagtcccagctactcaggaggctgaggcaagagaattgcttgaacctgggaagtggaggttgcagtgagctgagatccccccattgcactccagcctgggcaacaagagtgaaaccctgtctcaaaaaacaaaaaacaatggtgttcttctacatagctaaagaacaacgatcatactcaagaaacttagcattaatataatgctgctaccttgtgtataatttaatattctccagttgttttggtgtcctttacagctttttgtcggatccaggtgttattcaaggatgatgcatattgatagctgcttttaaactagtccctcagccttttttgtctttcacgacattgacattttgcagtgcccaggccagctgctgttcagtgtgtccctccattcagatttgttagctgcttgtttcctcagttagactcaggtcgaatgtttttggtaggaatactttcaaggtgatgtgtttgagcatttatcagtagacacatggtaccagctctgtcttttaagggagtggtagtttgactgcttagttaaggtggtgtctgccaggtttttccattgtaaaggtaccctttatcctttgtaattagtgagaaatctaatactatgtgaatatctcattccttacctttcactcagtggttttagtacacagggctgagtcttactttagttattatattggatataaatggtgattttctatttctttcactttctgtaattgttatttggcttttggaaagaagagcttttcttctcttagaaactgatttttttttaagcatcagctggactgattgtttcttattctgaagtcaatgtattatagtccattccagtcatgattcattttggtgttgaaattgtccaaaatttgcccagtagaatccccttcaaggtagctcctgtctttttaaactattttgtttggaaatatttcaaacttataaaaaattgcaaggataataatacaaagggccactcatatatcctttttccagattacctactgttaacactttatgctatttgcatcatcatttgcatgctctttctatacatacacagtatttatttttttccgaaccatttaagactaagttgtatacatcaccaccctttacccttaagtattacagtgtatatttcctaatagggatatattttgttacataaccaaagtatattgttaacttgagtaaatttaacattgatttagtatttatgtctaatctgccctccatattctagttttgttagttgatctaatgttctttttagtaattcctttctagaacagaatccagtctaggattgggtattggctttaggtaccaagtctttctaaacttttctgggatatttacacagctcgtattttttatgacattgacatttttgaagaaaagtctgcttcccctgccctgcccttcaaaacatgcttctcacttggggcagtttctggtgtgtcctgctggttggatgcagggtatgcatttcaggctagggacagtaagtgatgtgcttttctccgggcctcatatctggaggcactgatgtctatcagccctcagtggtaattctgattttgatttgataagcaaaaagaaattgtatccccctagatttagtgtccatccattgatggtgcttgctagaaccagtctttagtatgatggttataagaactgtcttctaattccagcattccttctgcatttaagcaattggcagtcagcattctgcagcatcctttgccccatttacttatcattggtatgaattcattaatttctgtttttctccagtggctttggttcatttctgtccttactttgttgctcaaatggtctgatttggcctagtgactagcttttgtatcttttgacatgtcatttccttactttttttatttacttatttacttttgagacctagtattgctctgtcacccaggttggagtgcagtggcgcaacctcagctcactgcaaccttcacctcccgggttcatgcgattctcctgtctcagcctcccaagtagctgagattacaggcatatgccaccatgtccagctaatttttgtgttttcagtagagatggggtttcaccatattggccaagctggtctcgaactcctgacctcaggtgatccacctgcctcggcctcccaaagtgctagaattataggcgtgagccaccgtgcccagccttatgtcatcatttcttgagcactcctttctgctttctagcacaacacatgtatctgtatttctatgtctctgtctataaatatatgtaaaccttgagtttacactgatacatccagttttaaaatttcatggttcattttagttttacttatactggctttttggatgatgagaaacctggtggctcccatgatccttaatatagtgacttgatcaaagccctatgtgtgactaattcccattactgttgctgcctcctcttctggagggagccctttttcttgggctctctcaccctcctatggatgcttgcttgctccataggactggattgttcagaaagggaaagaagggtaaaaaaaaaagaaaaacccaaacctatccatttttaaatactttcttatgttctgttgtttttttctttgagacagtcttgctctgtcacctaggctggagtgcagtggtgcaatcatggctcactgcaggctcaaactcctcggcttaagcaatcctcccacttcagcctcccaagtagctgggactacaggctcatgtcaccgtggctagctaattaaaaaaatttttttaattttttatttatttattttaagagattggggtttcactgtgttgcccaggctggtcttgaactcccaggctcaggtaatcctcccaaagtgctgggattacaggcatgagccattgcacctggccccgaatactttcttactttctggcacaagtttttctaggaatgtctagtaagtattaaagatatggctttattctcaccattatatagcctgacatactggctgaagagtggggagaaaaagtcaaagtcaatgtaaaaccttaggttcaattatggctagacagacagacttttactacaagtatttttttttagtattcagaaaatttttctttggtacctctttttaagtacacataatattcaaattaggcagagaagttagtttagcatgattgcgctgcagtaaaattttgtaggattttcagtgggataaggtggccagatgtcttacgtgagaaccaagttgaaaagcaggtattagaattcaagtaggcaacatcttccttacattatctgaaaccagagggcatctgtggagttctggttagcatatcattttttatttagaaaatatcctaagtaaaatttaaaggaaggagggcattccagatctatatctagaaaaaccaaggtcttcagaatatgagaggatgctgaaagaaatgaagagtttggatgaacatttttttcttccagaccaaaaactatctagaggtatatgcactaaaataatgtcaaagtacttttcatgctagaggtatccatcaactatataaccttgagcaacttataacttctctgtgccttggttttctcatctgtaaaattggagtaattctacttatcttaaagggttgtgaggattaaatgcatttaaagtggtaagaacactgccttatacatagccctgtgttttcatcctcataaaagctgaaaataaggttcaagtagtattttgatactacttatagatctaaaatggatcagggaaaatatgtgattacttgatgtatgttatttttatagctgagattatacaagacagctatcataatctcccttaggtaatgccactgtcaaagataatgaagaactgggtggatcactggtgagaatagaagtgtaaagtgttgctttttattaaaatatgatttacttggttgctttcaaagaacccaatataattttctttgtaaaatgattttgacacgaagtagcagaaaaagctccaaacattagaatatgaccagtgtcctggcttcacagttaaactatctttgctcagtttccctacttgcaaaataaagtgaagtaaaatcaaaactctgtggttctttccagctcttaacattctgtgattcttatttttagccctctcctaaaataatgctgtcatcttataagaacttcaacagacttgaggtcttattgcacaagcactttttctaagatgaaaacataccagcatagtggtagagttctctactttctagttttcttgcaaagcttgacttgatgcttattgacgtagctcctaacaggaacttaaaaacactcctttttcttaattatttcagctgactccttttcctactgtggcattctgttatctgaagtcaaacgtacctgaatgtgtcctattgtgttactcaactcacttctgaatatggttctgttttgcataccaccaacccacataaccatttctgaatctcttgtttcacactgctccagtgacaacttgattcacaggccgaactagtgaggtaagaaagtaagtttgccaagtttgtataatcaactttgttataaaattaaggtaaactatatatggtttaaatacacatagacacacacacatgtacatggctgaaagcttgatggagttggatttttggattcacctgaatagcaccactgaaaagatgactttaaaatttttttttcagaattgcggcgagcagtaagaagcagcgtgtggaaaagggagacgattgttcatcaacatgagtatggaccagaagaaaacctagaagatgacatgtaccgtaagacttgtactatgtgtggccatgaactgacatatgaaaaaatgtgattttttagttcagtgacctgttttatagaattttatatttaaataaaggaaatttagattggtccttttcaaaattcaaaaaaaaaagcaacatcttcatagatgaatgaaacccttgtataagtaatacttcagtaataattatgtatgttatggcttaaaagcaagtttcagtgaaggtcacctggcctggttgtgtgcacaatgtcatgtctgtgattgccttcttacaacagagatgggagctgagtgctagagtaggtgcagaagtggtaggtcagctacaaatttgaggacaagataccaaggcaaaccctagattggggtagagggaaaagggttcaacaaaggctgaactggattcttaaccaagaaacaaataatagcaatggtggtgcaccactgtaccccaggttctagtcatgtgttttttaggacgatttctgtctccacgatggtggaaacagtggggaactactgctggaaaaagccctaatagcagaaataaacattgagttgtacgagtctgatcatgttttctgtactcttggggcctctattgtgggacttaacattagtctagatagctttttaaatgctggattaaaatggaaaagagctgttttcatggttgactatctgattgttgatcaaagaaggcactgatgtttattttaagtagtgctaacatttactgagcatttaccaaccaggtgccaggcatgcacctaagtgccttaggagtatgttcatttagtcccaggcttgcttccatgctgctttcagacttctaaggaaaggaaggtgaagtctcacatcaccgcaggcatctgcatcaactttagtgaaattttcctgtagcttgtcaaaagaattattgggtctatgcattattttttgacaaaaacaaattccagttagttaaaataacctgatattttcaaattgtttgacatgacattttatcctactgtacaaatagaataggaagtttaaacatttccatttttttttctttaatggagattatgcttggagaaaggctaagtcaaaacaagtcatgtccaaataattcagactacacagaaatgtttgtgtatttttcaagtttgatttttttttaaacaccttcacactcaatgactaatacgtgctatgctaaatattacagcttagtaaaaattgattctgaatgggcagcaagatgtctctggggaaaaaagctttcagcttgatgacaacagatgatgacaacagaataactaggggttcaggttgttgtaagagcattatgggggcggggaaggagctcttgggccaactggatctaggttcaaattccacttactagctgtggaccgtgggtaaattactccaaaacctgtttttatctgtaaaggcataatcatctcaaaggactgtttgaagtagttaatagggtgaacctatagcacctggcacataataaccactagttaatgagcatgtattaccaaggccactatgttacagaaaatagatttgtctagttaagggatgcttctattcaccctctacacccttaccagtttaagacaatcctggtatccagaaatcactaacagctaaacctgctctacataggttggcaaggtcccttcctcatctttcattttcaagtacagttataaattaggaaaacagtatgtttactttgacaaaagcatgttaaattgcaccagcacaatttaacagaatatttattgcaaggtatgatgtacagtgacatgccatcttttgtctgtatgaacttcattactggggacagcaactgttgaatgtttgctcttacacctttatttcttcaaaactcaattcctagttcaatttttccatacactaaagctgctagactgggacagagcaggaccacatcagcgaacagctgttaaaagcaaccattatacatgaagagaggaccaagagaaaagaaattaaaacctacaaatttctctagaatgtggatcaaacataactagccacacttttcagtacattgtgaaaagattacaaagcagttttgagtcaaagttaccaatcccttaaaggttatcctttggttttttgagacaggagtcattttaaactacagttgacccttgaacaacatggggttagggatgctgacaccccgcacagtaaaaaatttgcatgtaacttttgactcccccaaaacttaaccaccaatagcccactgctgacttaccaataacaaacagttgataaactcattttgtatgttatatgctatatattttttttcttttttgagacagagcctcgctccatcacccaggctggagtgcagtggcacaatcttggctcactgaaacctccacctcccaggttcaagcgattctcctgtctcagcctcccaagtagctgggactacagccatgtaccaccacgcctggctaagtttttgtgtttttagtagagacagggtttcactgtgttagccaggatggtctcaatctcctgaccttgtgat

SEQ ID NO: 15460 - DNA, 41754 bp, Human
aaaatcatactccaatgacttctcaattcacttggataatgtccaaagtcctcacagagcaccttccccctacctctctgatctcatctaccactctcccgttgctcactacctatgatggcactatttgtgggtattcctgaatgggtcgttagaatatatcagcgccaagagagcaggggttttcctttgttcacctctacatcctcagcattcagaactctgcctggcacctaggaggtgctaaatgctaataaatataatattcgttgaatgaaataaaacagtgattgggtaaccaaagaaggcctcactaaggacctgacatttgagctgagacctaagtgaccaagagccagccacgcagatttagaaccagagaccttcaggtaaaggaaatagtataagttcctaaaataagaacaagcttgacttattgtaagaacagaaagagtggttggagtacagtgaggagaagtagaaccccacaggccatggcatggagtgtgcaatggaaagtcgtaggagactttttttttttgacacggtctcactttgttgcccaggctggagtgcagtgtgcgatcaccgctcactgcattctcgacctcctgggctcaagggatcctcccacctcggcccccaaccctcccctcgagtaactgggactacaggcgccaaacactaggctcagctaattttttttttttttcctgtaaagacggtgttcgccttgttgcccaggtgggtcttgaactcctaggctcaagcggatccgcccgcgtcggcctcccataagtgttaggattacaagcgttagctaccccgcccggccgtcataggagacttttaaacaaagcagtaacacgatctgattctggatttgtgttgaaagcagagcaggcagggtttacagataattgttatgtaaaaagagggaaaagagctaagaaagactctaaatttttggattaagcggccgacggatgacgtcatttactgaaatgggtaagaccgaaggagaattaggccgggagagtgaaatttcagatggccatggacaaagcagataagccagtatggtgctcataaagacatcaggggaggggacgctcacacacaggcatataggtacccaataacccttgaaaacagattactaaaacaatcatttgttccttcctaagcaaacaacttaaggaaaatgacggccagccggcaagcccggagccgcacgctcgcgtcagggccggcctttccataccaaggggcggcacgtgcggcaccgcctcccgcccaggccccaccccgcatgccgagcttggcccaacctctcctcccacttttcccaaggcggcaaaagccggaaagtgggagtagatgagcacatacccgccagtcctgatcctttctaaggtctctcttccctgcactgtctccgcctagcaattgtcactgctcaccgccctcgagcctattcccccgccgcgtatttgggtagaaaagctcgctcgtgacgtcaccaagctccggaagtctcctggcgtcggcgcaagggccgccgggaaaaccattgagaggccaccgggaaaccattgagaagccccggaggaccggcctgagcggaggcggagactagagcggccgccggcacgacccgccttcaggcgtacgacgaccgcggcccgggggctctgagtggccaaagcggcggcactttctgcgtggccccggaaggacatagagcggaaggcgggagaaagaagtagccggcaggcggaggcagcccgagggggcggttgcatgtgtgccagacgttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgagtgcctgcggcccggccacggaggccgctcccggttgggagccgaggctcggcgtctttgggtgtccacggaagagactggaagctcttctccccgggaacgtgcggggagccgcggagggaaagaggagaatatggtggcggtgtggtcgggcggcttctagaaagcgacttctcccccgccccagttctttgagtcaagggccgatcctcgggaaagaaggcctggtgaaccccatgggtagacccttggtctctaaggatgcttcagaatttcgtccgtaaaaccacggagcagggaagcacacctgtgtctgtgctgccgcctcttagggacccactggtcctagtgtctcgttttaaccttcaaagctgcacctgaaaagggctcggaagaattcactgaaggaaaggactgagagatctcatgagttgcagtctgaactctgttccggtagtggttatccgttgatttcacttctttcaagctgcagggaaagaatattgtcttacctgcgcccaagaggtccctaataaacagacacaggttactgcagattttgaactggccgtaagcgcatttcccttgtgtgagagagagtgctagaaaactaacttcaggcctctgagagagttagaacaggggttcccatctccgtttggatgattgtgctcgtggagatcagtgttgccttcataaagatggaataattctagttttaacaacaacaaaaaaaagatgcttatattacacataagccttacaatcggtcaaaaacacaaatccacacaccaaaaaagtaaaacttagagtaattctattgttaacattttagtgtattgttttttgaagagagtgtatagtagtggttaagagatgagactttggaaccagagggtttaggttcaaagccagaccctaccatttacttggtgatcttgtccaggttatgaaatctccttaaactttagtctgtaatacagaagtaatgatatttatatcttctggtttttgtgaaggttaaatgaggtaatacacatcagcaacaatgatgttttatcatttgccaacgcttaagaggcggtaaacgttagcagatgctgtcaatgtaagaaaaaaacccataacagacattttaaattgagtaaattttatctactaacgtttgtctctccttgagtgttgtggcagttgaggtggaggcagaatcgcatgcatttagttttaatagtgaaacaccagatttctacgaaggaatggcttgagaggatattctagtccagctttctatctgacacctaagggtctagagactgagcataactaagatggagggacagctgtcagttcccaaacaccagcaagagcgaatccagtccggggctctcttcactacacaggtataaattaaataactatgctgcgtgctttgatttctaacacgaggtttcttgtgtaacctctgtacaaggcacagaaaatacaattccctcccttttttttttttttctgagacggagtgtcattctttgtcaggctggagtgcagtggcgcgatctcggcttactgcaacctccgcctctcaggctcaagtgatcctcccacctcagcctcctaagtaactgggaccacaggcgcgggccaccacgcccggctaattttttttttgtttttgtattttttgtagagacggggtttcgccacgttgcccaggctgatcttgaactcctgagctcaggtgatccacccgcctcggccttccaaagtgccgggattacagatgtgagctactgcgcccgccgataatacaattttcatatgctttgtaattgactagtcaaaaactaatatacttctcaagtcattacttgggggctggagaacttgagtcttttgttcttttctttgttgttctaatgcttcctttttctcacttagaggtaatccctaaagagagaggaaatgtcattgtagggcatcctagagaattggaatgctaatatgtagaaaaataacttttgctttggttattgggagacttacataactttcttggagttggcttgtttttaacaccagctggcagccaaatcactgtccatttgggtcttgccgcgagaacctcagagtaaataagacaagtaaaacaaagcattcattaagcaaaggtttttatggttgatattttagtgtgggagaggcagatacaattcatgtttgataatacagcaaatctgaaatttttgtcagttgccacaatttggataacgatcgctggagtttaccctacacagtgatctgaatcagattattttggatgctttccttttagttaaaaatctattttttaaaaaataaatcttagaagcttaaggattatagaaggctattttaaaatagggtaggaattattacagtcagaattaaatagatgcatctgagcatttctggacaattgtcagctgctgtcagtcactgccctgactttccgtatgcttgactctctatatatagagtgtgtgtatatatataaactataatagaatgtattatatatatttatatttatatattataaatttatatttatatattatataagtttgtttattataagttttatataaatatatactctaatatatattttacatataattatatactgtatatatagaagcaagcatatggaaagtaatacatatatatatatatatatatatatatatatatatatataaaatcatttattcaacaaatacttaacagtgccaagctctgtcctaattacttgccatacagcagtggacaatataaagatagagcctcccctctagagtagagagaagacagtcaagtaaagtatagtgtatcatatagtgacaggcgctatggagtgataccaggtaaagaggggagagatttctgtgagggagaagttactattttatgtaagttgattagagaaggcttcggtgtgaatggcatttgaacaaagacttgccggaggtaaggtagcagccatatagctgtatggggaaaagctgtgatccaaaggtaaccatgggcacaaaagcctgaagactatagggttcctgtcatgttaacagaagagcaaggaggccagtggtgctggagcagagtgagtgagggggaagttgtaggagataagattagagagatagcagagggttgcatcttatagggagattataaaattatacttctgtgttgagactcgactatcaaagattaaggggggtaggattaggaggctataccaatgaagttcatgtagtagtccatttataaacaaggaaaaggaaatgctaaatggaaagtaatgtgtatggatactagtccagtgctaaatcttaactaattgcttagacttgctttaaaaatgtctctgaagctttttagttactatgggatatgcagtccattgtttgttcttttaagaaagtatttagattgttcaaaatcttagctagaaacaatacgaatacaattttgggaatttgggcaatttacaaaaatttcagatttgctgtattagccccatttaagcttcttagaattaggtccttgtcttttggactgtggctgatttttttacttaactaaagaaaaaaatagaagtgaaaggatttgttattttgagagagtatagtttatttcagaagtgatggttgcctgttttaagtctgcgggctcaaggcatgttatctttcaagttgttcaatatcaaaatagatgagccaaaaagaagggaacagtgtgcttaaggtttaaaaacgtaatgttgaagttgttggttttagttactttacttttctattttacagggttggtttttgttttccattttgtgggtctaaaatttcttgtaaggctataagatgtacagtgtacccatataaaattaggattgacttatagaggggaaatttatttggtttattaagatcctttcagatggattttatacctgcttctctatactagccaagtctgtctgagtgaagtggtaatgttatctttaatttacattttaaaacttttacatagttaaattttaataaaaaatctgttcttgccttgggaactaccatagatacgttttcttcagggtacattgagcgaattccccaaattgtattcgtattgttttatttcatttccctgttcccttacccaggttgtcttatgagttcaatatcatgtttctgttcgtaagttcagattttgtctgtagtcttcacccctttatagtctctcaactatcaggtgaaagtggaacatttcttacctcttaatactttctgcctcctcccattctccagacaaatattgtcctttaatatagccaaaatgaacaaagggtttgcagttcagagatgtgactatgtacatgtattttctagttgtttctcagaaatcataccttctcttcccacagcactattttccccttttcaagcttataagagggcctaggagggttgctttaaaggctgtggtatgattccaaactggaacaagccagctggaaagttaagttaggaagactgtagaggtggaataaagggttggcaaaatagatgagccagaaagaagggaacagtgtgcttaaggtttaaaaaacagcaacaaaaaataactgctctcattcagctagtttttcagcatctgcattctcccaacctcactgaaatttggttctgaggagctctgctttctagaatacggtttcttaacatcagcactattgacattcttggccagttatttgttttgggagatgccctatgcaacgtgagatatttagcagcatgcctggcccctacccactagatgccagttgcttcccctagttttgactactaaaaatgtctccaaggtttgccagatgaccactgggggcaaaatctacaccctgttgagaactactgctgtagaagaaggctatttgaatgtcctagctggcagcttgcgtaaatattacatcaattatgctttttttcaataagtgaatcctggaaatgaaagacctttgtgtgaaatttggcactttgggtggtggaaccttgataggtcctgtgacttaggtttgatctatacttaagaatcaaggtccctgaacctctgtgccacacatgtctacaactttacacaggcagatatctccaggaataaatacatctcagctctcatgctgcatgcgtattatactttttgtggcattatcctttcaaaattatagtcagtggacattcagtcaggttatcatggtaattaatgggttgggaagttgacgtacagagtgtcttaccctgtaacctttataataccccccctcagatcctatgtggatagtaatagattcgttttattcagcttcagttcatgtggtatctgaagatcatttcagtcattcaatagatttaacattccaagcttagaatagccaggtgctgtgttttatgagaatcaccatacatcattttcaagccaagtgttccataggcaagtaagtgattatgaactttgtaacaataattcctttggctgttcagatctgaagattgaagttatatgtaacttgctactgtgtaaccatatatccaactgcagattttcattattaataccgattccctgcacagttacaggctcttgctttcttgtccatatgccgaccaaataattgaatcaatggaagtcgaaaattggattgtattagactagccaaagtgtttagcagcagcatcaggttccatacttaacactattattttaattttttaagctttatgttataccacaaaaggacttaggtgagtgtgttaaggctttaaacaaagtggtaagagatacaaacagcaagggtcttaatagacaggtgtttgaggttaatttttagcacaccttcattcaacttgaattgttgagcaatcaaaaagacagatgcttggtaatgattttagaatggtagatttaaaaaacatagagattattcgaatgatatggtttttaaataaagcagttatcagtaattcagttaataaaagctagttaaagcaggaattgtaaaacgtggtccttttttccaccaattttttgatatagtgctcaggacttttctttgaatatacgtatactgactgtcgttcccattatttaggataaactataccgttgtgctgcatcatatgcagaactgaaattgttaattgaagacttgagattagagcttagaaacatgtgaagcaagtgagaaatcctaatgttttatgctcctttttcccatcttttgaagctttcctctttatagctgatatgacagcttttttttctgatcaagtctttccaaagcattcgacttggttttgcacccttattttgtcatttacataatacattattagactaatgaatactactggtactaacaggtttcggaacaagcaactgaggatcagtaaacaactcaagttaaaagaatgggagtagcggtacatgagtattctaactactagtgtttaacatgttgttggcagctttccagcttgtccacagaaatggacagggctgctgattgcatagctccatgggcactactcacacaaaatttaacataaataatgcctcctggagttattgtatatagtggctctgggaatgggaggctgttggttaatctagcttagtctgagaaatggagggtctgtgaagagcttctactctgtaaaaacatagggcctggtagaaaagagattataacctaaaaaggttaaataaaatttgtgatagcagatttatcatgtaatgttaattttttatgttgctgaaataggtgggcagcctcacaaaaggagaaagacctctgatgcaaatgaaactgaagatcatttggaatctttaatatgtaaagtaggagaaaaggtatgtcacacaataggcacaggctgtgatgggtttaagaatgtggttaactgtgctttgattaatttttgcagctgaaaagttggactacattttggcaaagctggtattaccatgcatctgtatcccaaattgaatccatgttgaagcccctgggatgtagataattgatcatttttagtactttagtaattaataattttcatagaagatgagcccttagaagggacctagggtatagaccccttaatttatgcatgaactaaatcagccctgaatacttgaggtaatttgcccagagtaagagagtgaattagtaaaagaggtaaaatggagcccatggtgtcctcccatttctaatacttattctgttatcatagactgcttagtttttaaatttcactcgtccacttttcatggatttctgaagaacaataactatctgaattgatttatactaaacccattatagctctgtatgcatgtaagactattttaatgatcatgcagaagtttttattttagttcactaaaatagcaattgaaaggacagatgattggtaatgattttaaaatgatagattttaaaatatgtatatatttacatttaaatagatttttaaaaataaatttatgttgctgagtacttgacagatatttaatgtgatgtcctctacagagtgcctgctctttggagagcaacctagaaggcttggctggtgttttggaagctgatcttcctaactacaagagcaagatcttaaggcttctttgtacagtgtatgtatgcaaaagatttatgaatccaggtgataatgtattatctactcttaaatgctttgggaaatgttcaaaatacatgtttatgttctatatgtccttggctttacttctatggggaaatttgtacaaatgagccaacctttggcgctttggcgaactctttttcttagggataaaactaaaattgaacattttccttgtatgttcttacaaccttagaatcattttagttgactttttatagagatagtagatactgtctcattcagatatatatttttaagcatgtacatttaaatgtatgatacttacatttttaaattagtaccagacaaatttgggaattggtaactcaggtaatagcccttcttggaagactgaagatgctttggaagccactgttaataggcatactctctggataaatgggagtctttgtagttacatgaaattgtaatgtatccatgaggtgtttttaaattatgaaggtgatgtttatcacttctcagccttttagtttagatcaagtgaaggtaactttaagaaactactaaggaaatcttctgaaatcctttattaaaatggagtagtatttacacttaaactgttggaagccttgtttgtttaaggctgaacttgtattgcttcgcagtgttcttttttaatttttggttttgggagggtttcagggaccacagttaccatcaacacaggtattttttttgaagaccttgattgtccctgatgttctgctaggtactttaggaaaacaagtcaaagagaatctcttgcccacttaatgattatgaattcttattgctttttgagctaattctaaaggctgcctaaattaggaaaaattgctttttctaaaggtttattgtaatcctttcccatacttttaaaataactttaatgaaatcagcacacttggagtaagcaactgagacgtaaacaaatcttaactatatcagagtatgtttttaaaaaattcaataattaaactggtaggaacttagatgaaactcgttttaattgtgcatcttttctaaacaactagaatagtgtttctcaaagtagaattctagttccatgacatttggttagctaagtttagaaattctgaatgctgcacgcccccccttaatgattctgtattaaagaggcttgtttcacccaggatttctgagctattttaccatggaaaccatgttctgtggaaatgctattcagttccactaagcacacttgaagaaaaactgttgtagcattagttttatttatttcagtatgataactttacaattaaatcatttactttcttaactcttagattaactgatgaattaaaatgaaaaattacgggactatgtctgtaacatttctcaatgacatgctttttctgaagtatttttaaagacatagctaaaagtaatcctgttccaaagttaatggaatgataaaaagattcacataaaattcagcaacttaacgccattgttttggggttttcttgttatactgggttcttaaatcagtgcacgcctattacctgagaagctgacaatttatacaacattagttggactactgaatgccaggaattacaattttggtggagaatttgtagaagccatgattcgtcaacttaaagaatcattgaaagcaaacaattataatgaagccgtgtatttggtaagttagtttgtttgttggtatgttatgactactgttgggatggagggaaaaggtgaactacaaccaaataatttaaaatgctctcctaaaacattctcattcactttcatagcttcataagccacctttattttgacgatacccccaaatctgtaactgtatctccaacctttctcctgagctccagtccagtattccagatgctagctgcatagccttcagataccttactaggaagtgcctaaattaatgcatcattcatacctccttttttctgccctctccccagctcatacagtggccactgtgtactgaataacccatctagaaagctgagcattaatttttgtcttccctttgccctctcgtaccataggtgttcccaatccctgtcaattctgtctccctaatttctctcaagtctgtcctttcttagtctccagggcctctagcatagtttatgccttcctccagatgttcttaatagcctcttaactgatctttttgcatctagattctctgcttttcactttgtgttctacagtggcaccagactggtctttctataactaggctctgcacatgttggttactggttaaaaaaaccttagttccttcccattgtctacagtgagtggtcttaaaagcctggtgcacaagatgattccttgggtttcaggaagtgaatattaagaactcttatttatcttaagtggaaatgaaattaaaccttactaataatacatagattaatggtgatccagtgtatatcataaatacatatgtatgtgttgaagatatgtgatcaaattcttttttactgagtacacaatcaaaaaagtttggacacccatcaggctataggattaaagtccagactctttagcctgaccctttatggtttccccagtctgtttctctattcttgtctcccatatgctccccagcaatatcaaaataacttgcagatccctaaacacaccttgtttttgaacctctatgcctagactgccctccttgctcactacttgaggctgttgctatcctttatgacctagcctaattgttacctcctttgtgatgctttccccaactccctttgtcattgttcctaaaaaatgcttaatttgccttttagtgtgggagtcattcctttgtattgagattgtgcttgttccactagaatgggtcccctaacagtgacttttagtagtgtttagcaatagcacactaagcacacccaataaatatgtgttctgtaatttccatttctgtaattcagtgaaaattacagccaaacagaaaaggagattataggttgaagtagctagaatattttacaatctggattcttgatgtagtatagcatagaaacgtatgaactcacagattactgtcctttatatagtctttgttacaacttctcaattctgccattgtagcacaaaagcaaccatagacaatatgtaactgaatgagcgtggctattccactaagtttacttatgggcactgaaacttgaatttcatgtaatttgtatatgtcataaaatactcttgatttttttttcacgcatttaaaaatgtaaaaaccatttttagttcccagctatgcaaaaaacaggtagtaggctagattcagcccttaggctatagttttttagaccaatagtttagcctatacaagattgcttattttgtagttattataaagaacatttaggtttaatagcagaaattgtttgccccaacaggtccgttttttatctgatcttgtgaattgtcatgtgattgccgccccatcaatggttgctatgtttgaaaattttgtaagcgtaactcaggaagaagatgtacctcaggtaagagaacccctcatgctgaatcttgaggggttcttgaggggttactgaatcctggtacttccatatagtaccaggaatttttcgctgataacccattagcaataaagaaaaaaataacagcagactatcacactttaagttcttactatctaaaaattaagctgactggcacactggtgggttctcataatatctgtatgttgatttaaatgatgctgtctagtaagattagaactaatatatctagaaatgctctgtataaaccagatgtcttatttaagtcctattaaatagcttccataggatttcattcaagaataaataaaatatgaatgaatataattaaagcatattttaaacttaactttttaaaaatcctttaggtgcgacgagattggtatgtgtatgcatttctgtcatctttgccctgggttggaaaggagttgtacgaaaagaaagatgcagagatggaccgcatctttgccaacactgaaagctatcttaagtaagggcacagctcatagtactctttgttgcttaggtaaaggatatcttatatcagtgataccatttgagtttctcaaaaataagctgtagagttcctgaaggtattttctaggtaatcctgttctcctgctgttttaactcactgagacctcaaagtagtcagatatggtttgcttacttttgccagtgcaaaggacagttggcaatatagcttcttttaagctgcttttatatgtttgtttataaaagacataaaacaccctagtgcaatagttcctcaaatattagtgtggataagaattacctgtggtacttaaaatactcagaccccaacccccagacctgataaattatacaatttgagagagaggtttggacatctgtattattaacacatttcacaagtggagaaccactgtcctagcacatacagtatatttagttcatgtaaattaatcttaaatcaagctcttaaaacagtggtccttaaccctccatccagccagtacttcttaagtaatatgacacatttcaattaaaatagtcacatgtcttcccattactcatctctcctaagccaatgtaaaagcttggtttatattgttagatacaataataataaataggtctttttagtaaatttatgcttaactatccagcaacatggtaatggttatgtggcccttaggtttttacagattgattttgttgttaagtttcattttctcttttttaagtgctttttttggataactgttaatagctacttagttggttattaagtaaagttaaaagaagcttaaaaaataagaatcttttggccgggcgcagtggctcacgcctgtaatcccagcactttaggaggccaaggcaggtggatcacccgaggtcaggagtttgagaccagcctggccaacatggtgaaaacccatctctactaaaaaatacaaaaattagccgagcgtggtggtgggtgcctgtaatcccagctactcgggaggctgaggcaggagaattgcttgaacccaggagacggaggttgcagtgagccgacatggtgccgccactgcactccagcctgggcaacagagtgagactccgtctcaaaaaaaaaaaaaaaaaaaaaaagaatcgtgtgtgtgtgtatacatatcctttctcttttttattcaaatgatagcccaatatacacactgttcttcacttggctttttttttttttcttactataacttggatttgttgcataaaaatacttaactctacttcattctttttaacagttgtagggtatttcactttttaatgtaccatgatttccgtagtctcctgttggtggacgtttaggttattttcaatcttttgctcttataaacaatgtttcagtgaatatctttgtgtatatgtttttatgtacatgtgcaaatatatttatgggggatataaatttttagaaatggcattgccgagttgagggttctaaacaattttgatagatttagtcaaattaccttccaaagagattatactttcccaaagagattatatcagttaacctctttgtcaacaatgtttgagactgaatcttgacctgcatcttgatgatacacagtacattatcaaaacagttgatatctgccactccagtaggtaaaatgttatttcattgctttaatttgcattttaataactgtgagggtgactgagcatctcttgtttttaaaagcctaaatgtagattttcatttttatctttagaagacgccaaaagactcatgtacccatgttacaggtatggactgctgataaaccacatccacaagaagaggtaaatggatttcagtcccttgtgatacaaacacagtcagctcttgaatagattcttatctctgtaagatactcagaccattccattttaccctttgactgtgtttctacatttcatgatagttccttctcatagctcaaggtgtatggtaggtctttaatagatgatagaatgtaattgaaatattcccttgttctttggaatgccagctattacagagttgacatatatttatttaaatgcttaatttgaaaaatgtcaaaacagacagttccaaacaggtagactttgtaagtaaaataaaaacaaaaacttagcacctttttttgtaccatcttacaagttagcttacttttgtatcctgtattttaaagggtagtgattttttcattttgtctagtcaaaatgttaattatattaatgattaaaaattaatctgtctttagtatttagattgcctgtgggcccagattcagaaattgaaaaaggatcgctggcaggaacggcacatcctaagaccttatcttgcctttgacagcatcctgtgtgaagcactgcagcacaatctgcctccttttacaccacctcctcacactgaagattcagtgtacccaatgccaagggtcatcttcagaatgtttgattacacagatgatcccgaggtaagtgaccgactaaaagtcctagatattgacctgtgttgcattgtgcttgtgggttaatcccgcttgaattatgcctgtggtatgttttaattttgagttgtttttatctaagaaggtcagtagcaatgaagttaactttttaattcagtgaatgatatcacctcattatgcaagaaattatatttggcatgtgtaaatagattacagagacgtgcacagtttgcaggctaagagtgtgggttttgggtttttagagctacgttggtttgtgttttaatcttggtttagccaaatactagctgtgttaatttgggaaggttatttacctccctgtgctttcatttcctgaaggtaataataatagtatacatctcataatagtagtatatatctcatgttatgaggattaaattattcacatgtaaaatgcatagaacaagaacagtgtctgtcacatgatgaatgctcagtcattctggcaatttttctttcttatttttttcttttcgaaatggggtcttactttgttgcccaggctgcaggtgagatctaagctcactgcaacctctgcctcctgtgctcaagcgatccttccacttcagcctcctgagtagctgggaccacaggcatgtgtcacctagcctggcaaattttttgtagagttgagatttcgccatgttgccctggttggtctcaaactcctgggctcaagcaattcgtccgcttcgttttcccaaagtgttgggcttacaggcatgagccactgcacctgtccataattatacttaataaggttatttctcagtaaaagtacctagttttaggtatggtccctctctaggcaacacagcctgtcttgtgattattcatattgtatgattatttgaaaacaaatgttggaagtatttttaattaaaaaattccaaagattagtctaagctgactttatcatttttaatatacatgttctttatttcaaagtcaagtttcctggcagccattgtactgttataattgtatattgtacaattaagaaaatttataattttcattgtgggtactatcctgtgtattgtaagatgctcagcggtgtccctgatctctaccctctaaatgtcaatagcactctccctgcctcagttttgacaaccaaaaatatctccagagagtgcaatatgtcccctcaagagcaaaattgcccccagttgaaaactattgccataaaaattaatattaccacctaagtcaaatttgagtttcttctattgtctcttttctgttctatggtaaagtgctaatgaccagtaggaatttagtatatatgtaatctattttggaataaaaatttctcagataatcagttacatatacaaaattatcagcttgctgccgtctttgctatattccatatgtaaccaaatactttagtcaaaattatgtaatgatctacttagatatgtctaactgaaaatctggtttacatttaagactgctaatgtttgtggtcgggtatttttttttttttgtgcaggggaaactagaatgggacctcaaaatttgtttctcctgaatttgtatttaattggtatcacctctgtaaggtgcatatccatcccttgctagaagagtataaatatataaaatacatattactcccaaaacgaacaggattttgtttctgttctggccttttacaagttgtttattaaaaaacattagaaattgtaaaaaaaagattagaatcatccaaaagtcattattaaaggtttattttgtgtgttttgaacctgtttgctatgaatatacttaagaataaaataatgccatgtagggaatatgttttgagcttagacagtatattatgggcatttttcaattcatgcatgactttttatggctatgtggtgtttgaatagaattttctctctgcatagttattaatggaaataattcactctcggtttaaaaaataaactctgtaagacttgtattatccaaaattatttagtttcatataataattggtgtgtaaagtaggcagtggttgtatggttaggtatgagatgtggtagaaaaaacactacagctgatactctggggtataagtgaacatgacaatggaatttcctgaaatatagagctttaacacttcagaacttttatccccatcacccagtttagtgcttggaacataatagtctctcaaatatttgttgaataagtaaaagaaatctgttttctaggcctgtagtgtacacatttggttttctttccagggtcctgtcatgccagggagtcattcagtggaaagatttgtaatagaagagaatcttcactgcatcattaagtcccactggaaggaaaggaagacttggtaagattcttttcatggtacttttagaagggagagaagcagcaattttgataattcagtaagagcaaaatatatgttgagagtgtaagaaaattttatcctcctgactccctgtcttgctaaaatcaatttctaaaaacacttgctttactttctcaaggctcttcacccttgtatagtacttttcgaggtgctttatagtaataagcgtatgatgccagtgtgtttggtgtggatatttagtatatgctatggagagcttgaatggcaagttattttgggtttggataccaatagttttgctctgttttctagcatttagacacccaagctttggaatttttttttttaaataaaattttcttaaactttgggaagtttggtttagattttaaggtggaaatgaatatagtattatgagagtgatctactctattaaaacttctttaagttagtacatctgaatatgcttccttagtattattacctagactccttttgagctttcaagaaattttggatgcagtaaagattttccttgtggtagacagaataatttatgccatagttaaatgaagtaactgaaatctaggacatttcaaaaaagatttttctttgcttatatctaaacacattgcttttgaaactgcttatttgacttttcttgtgtcttcgtatacttattaaacttaaattacactttttatagtgctgcacagttagtgagctatccagggaagaacaagatccccttgaactaccacatagttgaggtatgaattccatgtggagcgtgtttctgagtttcagaatctttctgttggctttaaagtatgatctactcttggcttatttatttatttatttatttattgctacttgtccagcattcagaattaatagaagcaaggaaattgctgtcggttttggtgctctattagccatgttagtaaagagaaaaaagattggaaccagtagccaaatggaattttgaattgcctataagttatttatatagtatgtcttcattcatggatagttgttgtggataatgtaagttacctctagctctgtcaatacattgtccacttaacagacgtataagtgatttaaatactttaaaatatcattttagacagataacatatctttaattgtgtttatctggcctctcagtactagcataaacttagttagtgtattatttcctgtaacacaaagtgtagatgaatcatcatttattcttagaaatctaaagagccaagcagtttagaaatagagtagcaacacttttgacttcatattaactcatacaaaaggttgatgttagtatacagttgaatacattatagagatttatatcaaaaaacagtgttcacttgacacgtgagtcaaactgttaactgcattttttttttttccaaatggagccttgctctgtcgcccaggctggagggcagtagcgtgatcttggctcactgcagcctccgcctccggggttcaagcaattcttctgcctcagcctcctgagtagctggaactacaggtgcacaccaccacgcccggctaatttttgtatttttagtagagacagggtttcaccatattggccaggctggtcttgaactcctgacctcgtgatctgcctgccttgggctcccaaggtgctgggattacaggcatgagccactgtgcccagcccactgcattatgtctttatattaaagtattcatgggccaggcttagtggctcatacctataattccagcaatttgggggctcaggcaggctgatagcttgagctcaggagttcgagaccagcctgggcaacatggcaaaatcctgtctccactaaaaatacaagaaaaaaaagaaagagccagccatggtggcacgcacctgtggtgccagctacttaggggtgggaggatcacttgagcctaggaggtcaaggctgcagtgagctgaaattgtgcctctgcactccagcctgggtgacagagtgagagtccgtctcaaaataaataaatagtgttcatgaaagagacagcataggatgtattaagagtcgtatcctctaccgactgagctagctgggcctgataggatgtattaaggttcatattttgttaatattgcactttggtgcctttttaaaaaaagtactgtgtatttcctatctttacaaaacttggatatacttaatgctgtgaacttggctcaatgacatgtctgaaatgcaaaatgtcatttttaaatctgcaaaatgtatagaaattcatcagaccgaagtgtagaagtgtgagagataggtaagagtaaaggatgcagactagggctttagaattctagacaggtggtccaccaattatacagagagagtaggaaggaagtttctgaataagaggcatggcaaagaagtcttggactgccagaaagatctgagcatctatttcaagtaacagtgtggaatgacttgattttcttgtttcctgaccccaaagtctaaaagaattctttttttttttttttttttgagatggagtctcgctctgtcgcctaggctggagtacagtgacacgacctcaactcagtgcaacctccgcctcctgggttcaagcagttctcctgcctcaggctctcaagttgctgggactataggtgcccaccaccacacctggctaatttttgtattttttgtagagacagagtttcaccgtgttggccaggctggtcttgaactcctgacctcaagtaatctgcctgcctcagcctcccaaagtgctgggattacaggcgtgagccactgcgcccagcctaagagttcttgttatttataggaatgaaactgtcatggatcttttgagcccctcaaaaagctgtacatcctggctcagctgtggtgctttcaaagttggaatttaattgcatagttctctgggaggagtgtagatcgaataagcattagtgtcgtgtgtttttatttgatcgaattatagagagaagaaattttcattacagttttcagttttagatttttgtgtttgaaagagcataattttaaatattaaaaagtaattccattttcatatgaatgccatggagttagagctcagatttagaatgttaaggtctttctaatagaagtgcaaagatagcagttggattgaattgtgactcatgattcttttgtaggtgatctttgcagagctgtttcaacttccagcaccccctcacattgatgtgatgtacacaacactcctcattgaactgtgcaaacttcaacctggctctctaccccaagttgtatccttttctttatttttaaacttaatctctttggcctggtcttaaaagattattaaatatttctgcttgtgggtttaaattttgtaggtaaaaaatgtggcttttgaagtgtgttgtgtgtgtgtattacatgtatgtacttgtatgtctgtaaatacatatgtacctatacatatgtagatacatccttcactatttgggtcagggagttcaaaaatagacaacaataaaatttgttgcctagattgacttttcctctcacaatagatttctctgaagcatgtgatgcttgctgtttgatacagcattttacccacagtagaacttctttcagagttggaattaatcttcccaaaccctgccactgctttattagctaagtttctatgatattctaaatccttcgttgtcattcagcagtgttcacaaggagttgattccatctcaaaaaaacactttctttgctcatacatagaaagcatcttcttattttttaaagttttattatgggattgcagcaattaataatggaaaagcttgttttattgtaaaaattaccagtatgtgacacagagacaagaagcaagcagatgccattggaaaaatggtgccagtagacttgcttgttgcagggttgccacaaaccttcagttaaaaaaaaaaaaaagaagcaatttctgctaagcacaatgaaacaatgtatgcctgtgcgtatggaggggcatggggaaatttgggaggtgatgaaaatattatcttgatttcacgagtgtatgcaggtcagattcattatacatcactgatatttcaaagctgtaagaaaaaacaaaaacaagattgattgtgtgaaaagatgttcagcattattaatcattataaagacttgaaatgttttatttctattcttgtctattacaacttatttgggataaaagtggagaatagttttccttatcctaaattcacagcttgcacaggcaactgaaatgctatacatgcgtttggacacaatgaacactacctgtgtagacaggtacagtaatcgctttactgctgagctgagttagcagcttttacttcctgtacttcataaaggaatttgagaaagacatttttaagaatttccatgtttagtttttttcttgcctcccaaaataacctttgtataataaccagactcatacttaatgtaacattacgttttttgatgtccatgctatgattttctttaatttcattctctagtcaagtatcaaagactatactttggctctgccatttataaaatgttttatctgcaatttcttttttttatttgagacagggtcttgctctgtcacccaggctggagtgcagtgggatgagcatagctcattgtaaccttgaacttatgggctcaagcaatcctcctgccttagtctccatcccgagtagctgggattacaggcatgagccactgcacctggcctacaatttcataaaatttttttttttcttgcttcagtttcatcatcttttatatggagaaaataatatgtaccttggaagttgtgagaattaaataataaacatgttaggtgcccgcacaaaacaggtactagaattatatctgtcattgacctaaaaaggataaagagagttggcagaagatacaactgcatgtaggggaatatgcttttcattaactctgtaaagtcgggttttatctgtttgaaggcttatataagtttctgttctaaatcccagttattcttcctttttctctgcctacctcccccttctctacgtaggtttattaattggttttctcatcatctaagtaacttccagttccgttggagctgggaagattggtaagtgatggtttgttttatctttttctgtagtcaaaaaactactaatgtttaaaactgtaacataaaagtgtctgaaatatttaatttcttggaaactatttgtagttaagtacaaatagttacaagtgcaattataacttaacaaaacttgtaagttgttataagttaacagataattatagtacaaatgggtgtaagtgcagattatatgtaagcattgataaaactacatttcctccttaggtcagattgtcttagtcaagatcctgaaagtcccaaaccgaagtttgtaagagaagttctagaaaaatgtatgaggtaagttttttgtgttttctccttttaacttctttgggaggatttctttctcttctctgcacttgtgatgtgtgttcagaatattggattcaaaatccacttactcatcttccatcccatttttaatcaagacttaggctaagaaaaattaggcaaccatgccatatagattccatgtgaatttaagccaataagttcttttaaagatgtcacaggccgggcgcagtggctcacgcctgtaatcccagcactttgggaggccaaagcgggtggatcacatgatgtgaggagttcaggctagcatggccaacatggggaaaccccctctctactaaaaataaaaatttgcgaggcgtgttggcgaacgtctataatcccagctacttgggaggttgagggagagtcctttgagccaagatggcgccactgcactccaatctggccgacagagcgacactcttatctcaaaaaaataaaataaaaaaggtgttatatatgaaatgaattcagatttatagaaaagttggcacaacattacaaagaattctgtatcctcttcacctagattccatagctattaacattttatcatgtttgctctcatgctcactcccttttcgtctctccctagagacccattacgttggttttcctttgagaataagctgcatacccagctgatgtaatggcccattatcctttaatgttccattacatatcttcccaaaacaaaaccactctcctacctagccagcatacaaccttttagatcagaaaattagctgtggtacaatcctaccacataattcacaggtgctgctgaaattttgccagccgtcccaacacctgtatttcctgtctggtctggagtgttttttttgttttgttttgttttgtttttgagttggagtctcgctctgtcacccaggctggagtgcagtggcacgatctcggctcactgcaagcgccacctccgggttcacgccattctcctgcctcagcctcctggtagctgggactacaggcgcccgccaccacgcctggctaattttttgtagttttagtagagacggggtttcactgtgttagctgggatgatctcgatctcctgacctcgtgatccgcccgcctcggcctcccaaagtgctgagattacaggcatgagccaccgtgcccagcctggtctgaaatcttatccaggtacatatatagtgttgagttgtcattctcttcagattccttcagtcttgaacacttaactcttttttctatctttgtgtttttaccagtttgaaagagtctagaccttacttggattgctctgatatttctcatgagcagactgaggtcttaaattgttaatgctcttggtgtgtcacttctagaggcacatgattcccaccactggtgatgttaatcctgatccacctggtcatgtcaatatctgccagctttctctaccttaacctcaccatttttccctttagtagaattgataagtattttagatattctgaagttttactcttactctgttcttcatcagatctccatcctgcttttagcagctaccactaagatggttgccaagtgatgattttctcattccattattttttctacatttattagtgggccttctgtaagagctgtcctttctcccccatttatttattcctttatttatatatcagtagggactaattaatttatatttcattcgatgggttataaactatgaggattatttattttgatgcccaaattgtccctgatatgtacatgaggagccccggtaagctctctctctctctctctctctctatatatatatatatatttttttttttttttttaacgtccccagccattcattgagcattcccttattttctagaacaacatatttaggatcatcttgcgttttcttgccctatcactggaatcatctatttattcatggagccctagtttctagtaaagtagtaatggaatatggtatttaggagccaagatctgggcacttgatatgctcattgccattggggtgtcattggttctaagcctcttggtggacacacatccatccatccataactgtttttatgtccacctgtgtgtatatatgcctccaattccaactcaataccttatttctacacttcttctctaccatgatttgtaaacaccttctcaggcagtaacaaacttggcttccattatcctcaatatttatttatttgatagaatatagccagtttccaaagcgtgcagtcatctccaccatgccccatcatcaccccacatacttggccaccaggctcatgagctcactcacccgcacctcagtgcaagccagtgagttttgcagtatgcctgagatttggtgtgctggcttagacaaaaactcaaaggatttttttttccctttcacttcttggttgtcagctgagttcaagttgttggagatcatgactttccaggtaagtcgggtgttaccgaagaatgggactgataaaagatattttctgaggctgttatttgtattgtaggttgtcttaccatcagcgtatattagatattgttcctcctaccttctcagctctgtgtcctgcaaacccaacctgcatttacaagtatggagatgaaagtagcagtaagtaatgaaactaatccctctgtctttaaaaggtaccagttcaagtatatctgaagttagttgtttaaagtggagaaattgaactttttcttttcttggggtttatatttcctgtatttgaaaggtggtctatcattagccactgttttatttgccctgtcatcattttgaggatttggttgtgataaaattaattactactggcttatcattttttctcttttgaatgtgttaagtatagcaagatgaatttatagttagaacttactaaactgaaaacgtgtatttgtcatggtgatggaggttacttgaattcattatcttgttcaggtgtggtattgagaacatagatgcacatatttgtggcagtatgcctttaaaagtaaattcttaattatgattttcttaccttttggtcacataatctctgaaattgcaccataaatcagggagtgtaatttgatgtgccattttgccctttgcatagtatttacacttaatgaaggtaaagtattatacattgttgatcactggtagagttaggtgtggagtttttccaacttgttctttgcagattacacttaacacagcccctccatgatccttccattttgtgttgtgtagaggttctttgtatctcacaactttctgctgttctttgcttttcatactgtgtgcctgtttctccacctctgtctctgactgtacctgttttccttgaaatgaactgtgtcggtcctggtacatttcctatttcattatgtcaactctgaagaatagatatgattatcaaaactacaatgaggaaatgacttccaagaggtcaagctagaatgagattgcttttgagtggtggagcccaaattcaggcgtaggtgcactaactgagtggccatgctgttagccactgtgctttttggcagatcaaaggtttatgcagtacttagaagtgctgggttttgagttttgtcctgtactggttccgagaatgataaggtatagtctttgctatcagaaagctcaggcttttgttgaagattaagctttctttttgccccataggaataactccgcctaacattcaaggccttcataaccattgttcctactttgttatttttcacttctccccacatggacctctatttctgccaggtccatgtacttttttattttttccatactccctgttcttgactttgccattaccccagtctggaaagccctttctagctccacttccttttctccttctagattctagcccaagctcaatagctgtaaatattttttaaccgttagcaagccagttttgtattgcttcctggctgtgtctaatgtgaatatcttggttccccagctagaatgtagactggtgacaggggattctgtttttcttcgccttcttttttttagagaaaaagctcacagcaggtgtaatatgactgtcctcacatgactgttgtaatttactttattcattccagtaactcatactctataacaggattgccttttttgttacctctttgtctaccttacattaaaagcagatttcttgttgctctggtgatgccttacggtgtatattagcacaaatttttataataaggactcaactgataccaaccaatagtaaatacaaggagtcccatcacgtgagcatctgacttacgtagattcaagcttgtggactcagcaaaaaagaaaagtacaaaaacaaaacctctctgaagttggcagccattaccttgttgagactcagacttcatttccacggtcccgaggaaagaaagaggaagtgggtgttggcaaaatgaaagagaagtacgttggttctgggattttgagcccaggagagttgagggcattaaaagacagtttaactgtgtccacttttctccttaccattcatcttgaggatgatcagcaccttgtgctctaaattttacttagctaagtgtccttaatgaattgttgaaatgagaattgtccctttttaggtgaaaaaccattaacctattagaaaaagctttcacatacggtatttatatgtgattaaatattgaccttgggataaagagcatcctattttgaaaggaagaatttaaaaaaaatttttctcagttatttaactgttcattagaatagtcttgaaacctgatctgtcattccccttacccccaattctgtgtttagattctcttcctggacattctgttgccctctgtttagctgttgcctttaaaagtaaggcaaccaatgatgaaatcttcagcattctgaaagatgtaccaaatcctaaccaggatgatgacgacggtaagtggaattcagtatttcttaagtggaactatgtataggccaacttaaagcataaacataactctggcaacatgatgctcttaaagcaatatatctatatctgtttgacctgttcagactgttgttcttagcaccccaggtattttccccttatataaaaagagatcctaacatttctgtgatatagcttacttaagaatataaacttcatcgtaaatacaaagtgaaatatgttaccattcaaggatttttaacccctgctttcaccatagagaagttcctgaatagaaagacttggtgtgttataaagttggatgttttctccaagttaagctattagaataataatgtttaacatttactcagttatataccatgtaattccaaccagaatcctaggagtttttctgggcaagagtgggaaaattgacaaaataatttatacagttgcctgaatcaataaatggatatgcacatagaaaaactactgaatcaaaataagatattagtggcctttgggtatttattactgggattttgtttggatatctctaagaaatttgtattatgatattagagaaaatgagtttagaaagaataagccaaaatgatggcattaaattcagatgttgtcagacatcttaagacataagcttaagtgttttttttttttttttttggtattaatataatagaggctatgaataaggaaacctgtgtgatttttttttttcaaggaatggatgatagaattaagacagtcacataaaactaagacttaaaattacaagtggtttcatattttcagtgtttgaaatcagtgacggtcttttattgtttattagaaccaaaaaacattacacaaatatctgtgtatagatgtgagcaaccatctatttagcatttgaggtaaggcaccaaggaattgctgtgcttacatttttctgttttactataaaatatttttcagatgaaggattcagttttaacccattgaaaatagaagtctttgtacagactctgctacacttggcagccaaatcattcagccactccttcagtgctcttgcaaagtatgtatgagtacagagccttgcttgagagtttggaattttgcttggtgaacaccagtggtatggtaatttttacctaagattgttgaatatgaagatcttaatagtgtataattggacacagtgggtttgggtttgtggtagctgaaatccatatcctaaggcttccgtcagtctgtttgtacagttggcatatgtacatggtaagtgctttttttcatatagacatttaaagaaactagtgaaaaacctaggtttttgggacagtcatatgcagttggaagttcccacgctaaatatctttccaaagcaatgtaagaagaaattagaatcagctacactgttgggagtcacgcaaaggttggcatctgaagacaggtatttttaacttgtcagacagggtccaaaggaagaaagagcacatagattttccttctgccaagcagagaaactggacatctcaccccatctctgtctccaaggctttatattacttgcagggttcccacagaagatgcagtttgaatatttcaccatgtttgaagacagttccttagtccttacctattcttttaaactgtagccctgggctaacggtagtatattgtaaatgtcttgagattttgtgacagcttccttaaaaactatcaatctgtgatcacactttttgcatccttaatggttaatacttagttattttgcatttatatattgcattataaattgagtaacattgaaaaggctttgaaaacactaaaatgtttaatgaataagtatatatggtatttttttcccatcattatcaaaaggtttcatgaagtcttcaaaaccctagctgaaagtgatgaaggaaagttacatgtgctaagagttatgtttgaggtctggaggaaccatccacaggtaaaaattatttaattagacatgttgaagctctgattgtatgggtataaaaataaggccgttaattgccattgttttgtttgtaaaacatgaaatttgactctgcctagataatggtttttagatctaattctttcagtgctatgggagtaatgatgtttcattcattcttgaaagagtaagcattattatgatttggttttgaactataatatctcaatatgttttaaatgttcaggaaaaggtttatctagtctatccagtttctaaatgcaagctccagatttctcaaaccttgatatatattgtgtatgacaaagaaacatttaaataaatttcataaaacagtgagtgtgtaatgataaaacattgttttacatttaacttctggggttcattgaaattatgtatttttttgaatacgtattagtacctgaaatttaaatttttttttggagacagagtctcactctgtcacccaggctggagtgcagtggcgcaatcttggctcactgcaacctccgcctcccgggttcaagtgattcccctgcctcagcctcccgagtagctgggattacaggcgtccaccaccacacctggctgatttttgtatttttagtagagatggggtttcaccatgttggccaggctggtctggaactcctgacctcaggtgatctgcccacctcggcctcccaaagtgtgctagattacaggtgtgagccaccgcgcctggccagttttttcaaattttaactgttaccattcagagtttttgtttagtcaacctgtttcttgtagtgctagagcaaagcaaagggagaataaatcttaagacctaatgatcaggccaggcgtggtggctcttacctgtaatcctagcactttgggaggccgagatggatggatcacttgaagccaggagttcgagaccagcctaggcaatacagtgaaaccccgtctatactaaaattacaaaaattagccaggcatggtggtgcacacctgtaatctgagctgctcaggaggttgaggcaggagaattgcttgaacctaggaggtggaggttgcagtgagctgagatcgtgccactccactcccgcctaggtgacagagcaactctgtctcccaaaaaaaagacctaatggtcagattgatcaatcaattccatagccaccaaaactaaattttatagccctcctattttacttttatagcagcagtgtggtggcacatatatatgtgtgtgtatgtgtgtgtgtgatttacttgaataattctctcattgtagatgattgctgtactagtggataagatgattcgtacacaaatagttgattgtgctgccgtagcaaattggatcttctcttcagaactatctcgtgactttaccaggtaatataaattattttatgaaacttgtgttccctaagaattgatatatgtgtggtctcttatacataagcttcaaattctggtccaaaccaggttgatattaatatactaatggtccaatctggtaggattggacatggcaaaaattcctagacagtggaaacatacacagcctatcaggttgcagcgtctcttagcagggacactcttaagttgaatcaaggctaagccagtgaagtagaaatcctgttgaaggatccagactgttgggagagaaaactagcaagagccagctatgtgcagagtctcagctagtccagatggaactcgggaagggttccagcttcagtggggatggcacctagaatgcacaccaggaagtaggagaaatcaaagtcaaagtagagtaaatcatggagggatccaggaaagcttggtgattaacaagacacctgagggatgggggaaaggggttctcaccacagtcataatcttaggtttaatgcagaagattcattctgccctcattccccctaacggaaagaaagtttttgctgtttggttcttatttatgaagttcacggactttacagctgataggaccagggcagcaggagttgacacaaagcaggaaactaaagcaaattacttgtaaaaacataaaagtccatcacaacctttaacttttccactgtatctgttactgccagaggacactgatcagaaatatactgaattgttagggtgatagggtgtgatctaaggttgtcataccggccaggttggccttcataaacaaagacaacagaagaaccttttcagatttgtaaactctcagaaaactaaccacccgagtatgttttaaccattgtcctgagtgatttacgttttcaattcattttatccttaccgcatcaccgtagagaaggttccattattgtccacattttacagaatagggaagtgtcacagagtgctttatcctgcccaaagtcacacaactaagtgcagagccagcattcaaacccaggcattctggaatctgtatagtgctcaacagctccatctgttctttaacacctagctcaaatatttgtaactctgcaaacctttccctgactatagtccaccccctccagagttaaagtgctctgctcttttgtcctgtttcctaacattctagacttggagttttatgaacagattgttttattatcttccacttaaactattatttgggtcaaaatttgtagaaggaagtacagttcacccttgaacaacaacaggggttagagacaccgacttcgccccacccaccccaccccacacagtcaaaaatctgcatagaacttttaactgcatggaaaatttaactagtagcctactgttgaccagaagccttagtgataacgtagtcaattaacacatatttgtgttgtatgtgttatatcctgtattcttacaataaatcataagagaggaaacattcatgaagtgagagtggatcatcataaaggtcatcttcattatcttcacattgagtaggctgaggaagaggaggggttggtcttattgactcaggtggaagaaaacccatgtgtaaatggacctgcacagttcaaacctgtattgttcaagggccaactgtactattctgtgctgggttaggagacctagtttatagacacaaaagtagctgagaagttactttttaaaagaaaaacacttatgcaacaaacatttcaaagcacctacaaagtgatcttagtatgtatttgctagtaagaaagctgacatataattatctcattcttagagcccatcagttgatacctattatcaactaatgagtttcttaaacattccaagagaataattggctgagtgtgtgctagttaaataatataaagcatgggaaataagtctcaggttaggtcaccattttgagaaaatttctacacataatgtttacatttaggagaggaaaaatgtatttccatttttaatgttaatgtccatcatagtttgccatttcaattcagtaagtatgtacctctggtaagggatggaaataagaaaaatgactacacagtgctgccctcagggggctcgcctgaatctaatgggtgtgaagatagatacttgcacaatttacaataaaagaccaatttgtaagtattgctggagaaagatgactaattcagccccaaggacagaaggctgtatcagctgttaagaatgaaattacaaaagttgaaagattttattttctgtaaccatagcttgacatacagtaaccaaatgccatatttctttaagattgtttgtttgggaaattttgcactctacaattcgtaagatgaacaaacatgtcctgaagatccagaaagagctggaagaagctaaagagaaacttgctaggcaacacaaacgggtaagttttgtgtaaacttgtaagtagttaaagaaaatataccagaaactctggagaggattcagagttcattatcttgatgatatttcattttttctgagcccaaattaatgcagagcagaaatttttctgagcccaatttaatgcagaagcagaagaggaggaaggagcaggtagtgtgttgtgtgctgttacactgcatgatgaaccagttcaggaagccacaaacttcacttcccatagttcactatctctgggtcggcctcacgtttgcacaagggaagtagcagaagggaagaggacacttgtatttctgtaggagtctctgggggaagagggagaggactatagatacttaacactttccccgtactgtgaggaggaatggggcagtcattcccaagttaacggaatacttctcatagtattaatttagtattttagccattttggagggaagcagtgagtgacttaacatgatactactattcattatgaaagtattttccagtgttatgcatatttaccatagtagaaggtgaaaaaaagttgagtttagtgccctataggaacctttcgcaagtttgagtaccagtctccatgtagacatacctgtatacatatatggatataaacactcagacctgaaatactgtaaggtaaatggtgtcatctcattttgtagatgttataaagtgagacatagagaagttaagtaacatagctagtaggttgcatagctggtaaatgaccagagctaggttctgacacaggtctgtcagactccagagacttttctctcatgccacactgtttctagaagtgtgctgtccaacacagtagccactagctgcacgtgactattttagttaaatacaatttaacattcagttctttggtcacacaaccatatttcaggtgctcagtagtaacgtgtggttgcggtcgtaacaggctgcacatatttatataacattggccccattgaagaaaggtctatctattaggtagtagtgctctagaaccttacctttgagtggtgttaggaaaggacagtcgtgtacccacgtgtctagaacatagagcagacctcataaatgggctgtgtttatagagagaaaagcaagattctgtgatatccgagagcagggttctgataattttgcttaaagtggagagatcagtagatggggccttagcagttaagtattaacctcgaagaattaccaggctttctagattcagtgatgccaccttcttgctgaaagtaccttggtatgtaacaccttagagccacgttctggctctgccactttctgactgggtgatgctgggaaagtcatctaacctctcagccttttttctctgtaaaatggaaataaaccatgccttgtttttcttttcctttaaaaagaaaaaattaaattctataaactcttcagagtgagctgggggcagggattattaaagctttacaggagtatattgagcccatcattgccagcagaaagtcttaaacagcccactttgaattattatatgtcggctggagccatttctaaattataacaagaatgagcagccttggcccataggacttgcccagtttttctgtatggcccattagcagatgaatgattagcaagctgtctccctgttgttactgctcaaatggtcaaatagtgataaattgtagccaagtccccccatgttgttaccaagacaagtgccactaaatttccctggcctagataagaacccatggaatttctgaatgagaagacagtgtctctgaaccacaacaggactttgaggtatatatgtgtgggtggcggggtgggggggtactttcactatagaatataagtcttaacatttggccagacacagtaaaatgcttcccctggaggagatttaacacactggaatctaaatggtattttccttttgttcatttgccttctatagcgaagtgatgatgacgacagaagcagtgacaggaaagacggggttcttgaggaacaaatagaacgacttcaggaaaaagtggaatctgctcagagtgaacaaaagaatcttttcctcgttatatttcaggtatcttggcttgggacatttatacataaaaggaaacaatacatttctttagttttagtttttaaaaatgttatttttcattgtaaaaggaatacacattcatttatagaagagattaaaaatacaaaaatttaggaaggaaataaaagttcactactcagaggcaaccatgtatgtctgagtttctctgctgtttacttagtattctcgcatgagcatttctccatgcttgaaaaaaaattgtgggttgctttttttatatatgtctcgtttaattattcctcattgctgatcattttccttccatgaacattttaatgcatagattcctgttaaaatttctgattacttcgttagaatagattccaggaagtaatattactaggataagtaatttaagacattaaaggtctttatgtattgccaggaagaatgtaccaactcatgttattaccagtctgcccttctaggttgacttcatgaataatggaagctaggcacacacaccacaaagacagggtggaacaggcaatactttggggtttctttgtcatgaatttttttccaaagtataagattctgtctgtagtactaccttaacttcttctccctttccagcggtttatcatgatcttgaccgagcacctagtacgatgcgaaactgatgggaccagtgtattaacaccatggtataagaactgtatagagaggctgcagcagatcttcctacaggtatgtggggaacttcgattaggtaataacactattctcagccacaaagatttttcattaaaaaaaatccttgtcaaatttgttaggaggttatatagtacctgttagaccctttagttcatgtccatttgctgctaccattgctcatcagaatatttaggcttaaactgattctgtaccacttagattcctaattgccacccccccaacaaccccccgccccaccttttttttgagatggcatctcactctgttgcccaggctggagttcagtgacacgatctcagctcactgcaacctccacctcctaggtttaagcaattcttctgcctcagcctcccatattgctgggattacaggcacccgtcactactcctgcctgatttttgtatttttagtagggacagagtttcaccatgttggccaggctagtctcaaactcctgacctcaggaggcctccgcctcccaaagtgctgctgggattataggcgtgagccacggtgcccagtctcctaattatcattttctatgctggggatcctagctgtaatataaaatgtagaggacaaaaatatcaagaggacagtaattggatttataagtccctaaaaagccagtgttatccaatgtgcaggtggtaaactgtccacagaatcaaggtaagctccctggggtctctctgcaaaagcaaaatgccggcacctattctcacctagatttaagttaaaggtatataggagagtggagctaattcattgtatcttcggacactactcccctaaatcttcatttgttcattctagaagaatgattaatgtagaagtcactctaagttcaattctttgagcctccaaataggaattccctctgattttatagttactgccagttttaaaagctttaacagtctctagtcctataagaatctctgagagtattcatggcttatagaggaacacatagacaagagtatttcgttttctgactgtttatcttcctgtcagtccgtctggctgctttttaaaaagttacaatgtattatgccctgactggggagagagctagctgagcctagtccgtaatagtactaggagcaagcaggcactgctgccactgccttgaatcatgaattctgtttacatagaagttggtaagaactggattttttaaaaagctattgagcatccatttttttcatttccctttttatttttttaatgttggggattttcaggggtccattattcctatcagcacttttttttccccttcctcttttcatcattctgcagcatgggtgggctgctgaaggaaatgttccacaagattgcttatatgctttttcctgacctaactacccccttttgtgtgtccacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttttttgatatcttaaaataatttgtcttattttttgatggtttgaatgcttgctttcttgtagtatcctttcacttcttaaaggaaacaaaggggaagaggacagtgaatgaacatggcattacttttaattgccctgaaaagcaaatacttcctaacggcagtaatgtgactatgaccatgatatattatatatgtgacagatacaaattctctgtgatcagtttgttattttttttctccttaaggcacaaaataattggtttgaggtatgtgaaacactagaggtcaaccttacatagtatatagaactgatgggtttacccagctacccagtagcataacttttcacagctcggggatgaattaacatggctgaaataaaactaaaagtatggtttttaaactttggcatttcatgatttatcatctcactctactctaaaactggtggtttcttactgaaggtgttctccatttgaaattttatcttcaaagtatttttaagtagtatctttaagacatgacttgttagtaataaaagtgttactagttggaagagtagctctcaaatttgtcttaatgtaaatcacctgggaatctttcaagttattttgaaatttaaaccaccgtctgggggtggaacgcagacatcctcagtaatccttaaagtttccccaggtgattccaggtttggtcaccattatcttagagcatctactcacttcctctagccttggggttatttgtccaaggtcttgtagtgagttacagaatactaaagtggatgtagaagtggtcagattgactgaaactataccctgaattagatgtgagtttagattttgtttatatggaacctgatccaaaaaactacgaagtcctgagcttgtttcctgtatagtactgatgctgaaataagatgacagcagtttgtaaaataatacacaaatatgaggaattgtctgacattccaaatttcgaggatttttagacttttttcattaaaccttagaaaaaaattaccagtaatcctacaactactggtagtgttgttgtgcatttgcacaaaataggtataattttttcttattacatcccaagtttatgatgcattaagcgttttgcatattttgatatatttttgctttggtttaccatacattttagtggctacagaatgtagtctgcttaataaatgggaattcctagaatgtttaaataccatactatttaagacaaaatacaaaatatccagaaaaatccaggttgcgtggctggttagtaaaggactaaaacccaggttcttggctaaatgttttcgtttatactgtttatctttcccattgcttaagcacagcacaaactatgtaattatatataattacagttgacccttgaacaacatgggtttgaactgtgtgagtctccttacacacaggttttcttccacccctgagatggcaagaccagccccttgtcttcctcagcctgctcaacgtgaagatgatgaggatgaagacctttatgatgatccacttctacttattaaatagtaaatatatttttttcttatgattttattttcttttctctagcttcataagaatatagcatatgggctgggcgcagtggctcacgcctgtaatcccagcactttgggaggctgaggcgggcggatcacaaggtcaggagattgagaccatcctggctaacacagtgaaaccctgtctctactaaaaacacaaaaacttagccaggcgtggtggtacatggctgtagtcccagctacttgggaggctgagacaggagaatcgcttgaacctgggaggtggaggtttcagtgagccaagattgtgccactgcactccagcctgggtgatggagcgaggctctgtctcaaaaaagaaaaaaaatatatagcatataacatacaaaatgagtttatcaactgtttgttattggtaagtcagcagtgggctattggtggttaagttttgggggagtcaaaagttacatgcaaattttttactgtgcggggtgtcagcatccctaaccccatgttgttcaagggtcaactgtagtttaaaatgactcctgtctcaaaaaaccaaaggataacctttaagggattggtaactttgactcaaaactgctttgtaatcttttcacaatgtactgaaaagtgtggctagttatgtttgatccacattctagagaaatttgtaggttttaatttcttttctcttggtcctctcttcatgtataatggttgcttttaacagctgttcgctgatgtggtcctgctctgtcccagtctagcagctttagtgtatggaaaaattgaactaggaattgagttttgaagaaataaaggtgtaagagcaaacattcaac

SEQ ID NO: 15461 - DNA, 23276 bp, Human
  misc_feature (1)...(23276): n = A,T,C or G
gctccctggggctcttaactagtcacactgggagtcatgaatgtctttccaataattcagggaattctagagatcctcaaactgtaaggtctattcatactcaacacaaggaaaaaacctcattaaaattaatgactaatcaggaggcaacgtaaccaaaagcacagtgaatgaaagttttcatggtaggttcaacatgggtttattgctagaaagatccaggggatagctttaggtttaacttcggctcaccaacgtaactttctaatcatttatttcagtaatagctagaagtgggtctgaatgttttcccagagtctgatacgtgtttttttttgccagaagagaggtcttcaggagacttcatttaaattctgattattaaactgaggctttaattgatgttaatgccttatgtcaaatgtaaagttagaatttgctagggctgggatagggagtgatatttctaggacttagacattgaaaactaattcagcctgtagtaacctggatggttttcaatggcatggttagtcaaattcatggttttaaacttagaagcagctttcgggggagagggtaggttggagcatttattacatattttactgtttaatgtcttaaccgtgggccttttaatttgtaaacactgaaatgattgttgggctgtggaaaacatttacctatttaccttggaagttttaaaagacagtccactttttagcatgtgtgttgtgtccagcctgtggtcgtcttaactaataaatgtgatttttctccccattctctctttttatttatttgcgtataggccttttacctggtgtgagttcctgaatgtggaaaacacctggcagtagtacccagctttgcagttaattactatctagctggcctttttttaaacccttgtatacacttgtaaagaagaactatttcctgaacctggtacagcactttactaatgataaaactttactcctgaattacattaactcaattgctaagctgttacccctcttaatcaggtagtagtttggtagtctcacagtgaaatgtagattgttcctttttccctgaacctctttaaaggttttcgtaactgaggctggtataagaaatcatggactttggaatcaaacttcctcagtctgggtataccacttttccactttctgggtaggtcttaaggtctcgacctatttaaatagaaactgcaaaatcagaaacctgcaatttaatcatgagtctcttaataataacagtcacaagtctcattgttttgatgaacccatagaaggggcccctggaagaaattgcacgtacgtggttttctctgacaccaggagggtttaagacatgtcagggccccttggtttatttctagtgcattcccaggtgaggcagatgctgctggctggggactgccctttggaagccactgcaatatttaaagtgaccataccactaccctagtcacgaagcctatcgcccccctccccggaagcttaagcgtcaagacaacggctctggggttaggcctaggccacctggcggcagcatttgcctagttaagaaggcctgggcttacaaatcaccgtaaaggactaaaactgtttaaagggaaaccaaatgccaaatttagtccaagtgcttgattgaggtgtatatagaaggtgatttggataatactgaagtattttaattttctggactgcaaaacagtggcagaaggaagtgactcaagtggctacaccacggttataaataggtgggaataacctttactggtgcttacgaggaaagaaaaaagtcaatctgaagggaggggcgcgacgcgaacggcaagctagcagagaaccatccgagccggcgtccgccatggtgggcgggggacggctgcggccggaacgcagacatgcgcttccggggtggggcctgccgcccgcaagcacgctcacctccgttgcgcctgcgccgtggcctctccggattctgttaacggtagtggtggcttgttgggatccgttgagtgatgggagagtgtgctctttaacttcggagagagatgcgctctcgtgtagccgtcagggcctgccataaggtctgcaggtgcctgttgtctgggtttgggggtcgagtagatgcggggcagccggagctgttgacggaaaggagtagccccaaaggagggcatgtgaagtcgcacgcggagctcgaggggaacggcgagcacccagaagcccccgggtctggagagggaagcgaggcgctgttagagatctgtcagagaaggcatttcctaagtggaagcaagcagcagcttagccgggattctcttctgagtgggtgccaccccggcttcggacccttgggcgtagagttgcggaagaacctggccgcagaatggtggacctcggtggtggtgttcagggagcaggtattcccggtggacgccctccaccacaaaccaggccctttgctacccggggacagtgccttcaggttagtttctgcagaaactctacgcgaaatcttgcaagacaaagagctgagtaaggaacagctagtagcatttcttgagaacgtattaaaaacttctgggaaactacgggagaaccttcttcacggtatgcttcacgatttcatgcttcaaaacaggtgtcgggtggaaaggcgaggcagtcttgctggatcttggggattgcaactggccctgtattcccatgcaaggaagttagttagttctcatctttttgaagtagtcggatatattaacagtgctctaccctggagaaaactggtccatggaatcattgctgttccttaaacaatctgtccgaaggacctgggaacgctctcaatttcacggggcaacttctgaacacagtgctgtcatttagtgcaatgtagtctaagtgcataaggaactacacagacattttgaacttttcttagatttattctaagtaaaaatgttgaaattataattctgaaactatttcatgtatatcataggataaatcaaggccaggcgcagtggctcacgcctgtaatcccagcattttgcaaggcagaggcgggtggatcacctgaggtcaggagttcgagactagcctggccaacatggtgaaaccccgtctctactaaaaagacaaaaattagccggccgtgacggcgagcgcctgtaatcccagctacttgggaggctgaggcaggagaatcgcttgaacccaggaggcagaggttgcagtgagccgagatcacgccactgcactccagcttgggtgacaagagcaaaactccgtcttaaaaaaaaaaaattcaaatagttgggttagttgttattaggaaccaagatattcattgtaaaagaagagataatatgtaaaagaaggtacgtataaactaatgttaaatatggattggtaaattaaatatgaattggtaaattaaaattgaatatgggtctcactctgtcacccagactcgagtgcagtggtgtgatcatggctcactgcagcctcgacctcgggctcaagtgaacctcccacctcagcctcccaagtagctggactacaggcacatgccaccacacccagctaatttttgtgttttttgtagagatgaggttttgccatgttgtccaggctggtcttgaactcctgagcttaagcaatccgcccatcttggccccccaaagtgctgggattacaggtgtgagccacagtgcccagcctcatgatttttaaaaatatatttcctaactttcttcgtttaaagttcctagaagcaatgaccctcagtagcaatgagcacacctagtgcccagatcctggttcctttttttttttttttttgagacagagtctcgctctgccgcccaggctggagtgcagtggcacaatctcggctcactgcaagctccatctcccaggttcacgccattctcctgcctcagcctcccgagtagctgggactagactacaggcacttgccaccacgcctggctaattttttgtatttttagtagagacggggtttcaccttgttagccaggatggtctctatctcctgaccttgtgatccgcccgcctcggcctcccaaagtgctgggattacaggcgtgagccactgcgcccggcctccagatcttggtttctaagatgaaccagtactgggagaaatggctgattccgggtctggggttagggaaagtacaaggtgagtttgaaacactttatggtgctaaaaagcaaagaattgcttgaagactaatgggtcatataaaaaggtcacagatgctggcttgaggagggttgtcactggccacatctaggacaaattgaacattaagatacatattaatggtaatggatcataacacattgactaaaatctaagagtcaatagtattaatcaaaaacaaataattgaccctagaggtcgggggcggggggaagaggtagagaaagcttatgtttttacagaagctatggaataaatgtagaaggaaagatacattagaaaattcaccatttcatgatattgcaaaccccgatatcattgattcaagcaacagtcatcaatggattctaaaatactgggtgaaatactgttggggagcaggatattattggggagtggatatttactaccttaaccaagtaatcaaatttggtgtcttcagtagtggaataatttgataacatgttcctcatgttatgatgcaataagatacacacatctactatgtagtattttgctaaaaatgattagccgaaattaaatcataaggaaacaatcagacaaatcccaaatgtgagacaatctatgactaacctggactcacatcaaaagtcagtgtcattaatagcaaaattaagggggaaaggaggcaagggaaatgttctagattcaaatggatgaaagaaacctactcagaatgcagtacatgaatcttaactggaaagagaacagtaaaagatatttggggtgaaaattggaacaactaaaatatcaccatatgttagattatattgtggtattatggttaactttttatggtgttataatggtatataggaaatatttttatttttagaagatgtatgcggcagtatttgggagtgaacaagaaaaaaatgtggcaaaatgttgataattgatgaatctaggtaaagggtatacaagtgttcattgtatatggatgtttattattttttcaactttcttatagatttgaaaatctttgnnnnnnnnnnnnnnnnnnnnaggccgggtgcagtggctcactcctgtaatcccagcactttgggaggccgagcagggcggatcatgaggtcaggagatcgcgaccaacctggctaacacggtgaaaccccgtctctactaaaaatacagaaaaaattagccgggcgtggtggcgggcgcctgtagtcccagctactcgggaggctgaggcaggagaatggcatgaacccgggaggcggaggttgcaatgagccgagaccctgccactgcactccagcctgggcgacagagcgagactccatctcaaaaaaaaaagaaaatcttcaaactaaaaactcagggtgaaactacctagaattaagtggtgatctgtctttttttgtttttttttaagacagggtttcactctgttgcccaggctggagcacagtggcaccatcccagctcactgcaaccttggcctcccagactaaagtgatccacctcccagctttccaagtagctgggactacaaggcacacaccaccatgcctggcttatttttgtatatttttagagatggggttttgctgtgttgcccagtctggtctcagaactcctgagctcaagcaatctgcccacctcgacctcccaaagtgctgggattataggcgtgagccaccaagcttagccaacatctgtctttatgctgtgttaacgttattactactattaatgtgtctattgacaaaaatgatttgggtttgtggactagatgtatacaatgattgatttatcttttgacaggtgccttggaacactatgttaattgcctggatctggtaaacaagaggctaccttatggccttgctcagattggagtgtgttttcatcctgtttttgacactaagcagatacgaaatggtgttaaaaggtataaaaagtggcaaataacttggccttgtatttaaatagtcaaaaaccagtcatttccacttgggataaattatataattttcagataagctaacttcctgatacgttttatatctaaagtattggtgagaagactgaagcttcgttagtatggtttactcctccgagaacttcaaaccagtggcttgatttctggttacgtcatcgactccagtggtggagaaaggtactgcaataattacctttaatttaatagttaatacataaattgtcttaatgtgtcagtggtaattcttctgacatacaagaaattatatttgatgtatgtagctattaatatattatacaaatacaaaaactctttgtaacaattttcattgttctagattacaaagttactttggtaaaaacatttgttgggctcagatgtgtttgttaattagcctttctgtgtaaggtaaaattcaaagccctcacctagcattcctggctgatgtagagtttgacccttgaccattgtcacagcttcagcttttgctacctacctccatgaactttccatattagtcaaaatggctctgtaattgatgatcaagttttagtactcactgaaaaaaaaagagttgaagtaagcatttttgtcttgccatgtgttatgttaccatttcccgactcaaacatccccaaatacccatttaaactgtatgaaataatcacgagtcatcaagaacttcgcagaagggtaagaatgaggactatgtgatactttcttctttatcccactttagtcatggttaacttcccctcttcattggccataaaagtctggataacatcaacagttttttctctgtagttctttcctactaaaaaacaatatgttaagcaatatactcagtattttcactttttattttattttatttttgttgtctgtttttggttttttttttgttttttttttttcacaagtaccagtcatcttttatttggaggttaattcccattaggatatgaaaggattcagcaacaatcgagattgtgttgcttatggaggggttgcagccaagaaggttgctgggggagtgcagagcatgtcttcttcagtggtacttgcatagccgctcgtgcttgagctccttgtaggaaaggcagtagatgaagagcatgtaccctgccagcaccatggtaaaccccgagatgctccccttcttcacgttgatgtacttgttgtagtaccagtagtaacctctttgaaacgctccatcaaggccactagggctgaagtcccacatcaagatccagcttggcagctcccctagtttgacctccagaagtttcttgtccttcactggtacaactgactccatcttggtttttttagagacatagtctcactcttttgcccgggctggactgccgttgcacaatcacagctcactgcaacttcttttattatttgtagagatgaagtcttgctctgttacccaggctggtctcgaagtcctaagctcaagtgatccccctgcctcagcctcccaaagagctggcataacaggcgtgagccactgtgcctggccagtattttcactttttaaaaattaaatttcagcaacctgtggtcccagctactctgaatcctgaggcaggaggattgcttgaggccagcagtaggaggcagcagtgagctatgattgtacctgtgactagccactgcactctaacctgggcaacagaatgagacacatctcaaaaaaaaatgtaaattagaataaactttaaaatttgtattcgggacttgactagtttcgcacatttgctgaataaaaagtatcggacaatttaaattcttacagataattatgggagttaaattagtgtttatttaaatatgttaagacaaacttaaattttcttttccagtttgccatgagtccatctaacttcagcagcagtgactgtcaggatgaagaaggccggaaaggaaacaaactttactacaattttccctggggaaaggagttaatagaaaccctgtggaacctaggagatcacgaacttttacacatgtatcctggcaatgtgtctaaattacatgtatgttttacctggagctcctatgtattttttacccagattctctataatcatttccgaaccatttgagaataaggtgcaaacgtggtgtcttaacacttcattgtgtatttttcagatgcagagacactcacctacataactacaatccagtcatcaaaatcaggaaattaacagtaatccactattgccacagagccctacaaattgaactgattatctcaataatggcatttataggtccaagatcttgtctttcatgtagttgtcatatgcctttacactccttcaaatgaacaattcctcttgtcttgcgtgaccttgacatttttgaagagtacagtctagttaatctgtagaatatgccttggctgggatctgtctgctgtttccacgtgatttatgtatttttgtcgggagtactacagaagtggtagtactgagaagctctcttctcagtgtgtcatatgaggagtgttactggtgatgttaacttttatcatttagttaagatggtttctactagatttctccagtgtaaagctaataaatagtttgtatttattaattaacggccaggcgcagtggctcacgcctgtaatcccagcactttgtgaggccgaagtgggaggatcatgaggtcaagagattgagaccatcctggccaatgtggtgaaaccccatctctactaaaaatacaaaaattagctggatgtggtggcttgcccttatagtctcagctacttgggaggctgaggcaggagaatcgcttgaacccgggaggtggaggttgcgatgagccaagatcgtgccactgcactgcagcctggcgacagaacgagactctgtctcaaaaaaaaaaaacaaaaaaattaactagtaattaataagtgttgtgggcagatactttaagatgatgcagacaatttctttgtcaccaaattttgccttactggttgcagcatccattgatgattcttgcccagatcagttactaatgtgaggtttgccaaatggtgatttttttttttctttatttgagacaggatctcactctatcactcaggctgaaacacagtggtatggtgatagctcactgcaacctcaaactcttgagctcaagcaatcctgcctcagcctcccaagtagctaggactacaagcatgtatcaccatgcccgactgatggtttaatatttgtagagacggggtctagctttgttgcccgggctggtctcgaactcctgggatgaaacaatccccctgcctcagcctcccaaaatgcttggattataagaatgagtcaccatgtttggccatgtcaccaaattttgccttactggttgcagcatcccttgatgattcttgctcaaatcagttactacgatgaggtttgccaatggtgtttttttccccttcccttttttttttttttaaaaaaaaacaaattccatcattccttctagatttactggtcagcaatatactgtagagcttttccttctcctccattttttttttaaattggtatttcacagattactttctcagggggttacagtgtgttactgtcattatttattttgatggtcaaattgtcctagacttggccagtgtccttttgacatatttccatcattgtcttgacgagcacttccttaccttttgtagcaatatattgttccaggatcatcagtgagccaagactgtgctgctgcactccagcctgtgcaacaggatgagaccatgtctcaaaaaaaaaaaaaaagaaaaagaaaaaatatatagcaaaaacataggagtttatatataatgagtagaaagtagattaatttttatttttttattttttgagacagcatctcactctgttgcccaggctggagtgcagtgtcgcgattcccaggttcaagcagttcttctgcctcagcctcctgagtagctaggactataggtgtgcgccaccacgcccggttaatttttgtatttttagtagagacagggtttcaccatattgaccaggctggaatttttaaatatgaataactaatgaaaaactagaaggcttattaactggtgaacattttcctttaactccaccaccatcacacttcattttggggtactcagctctcaaatgaaacttattggttattatcatagttaacgaacagctcaaccttgtgactagggatttaaagatgatttttgtattgtggctattagtgtcttattttgttcttttttttcttttgtatgaagaatggggtctcgctatgttgcccagtctggtcttgaattcctgggctcaagctgttctcctgcctctgcctttctgagtgctaagattacaggtgtgaactaccatgcccagattattttgttcttttattggtatcattttcactaatgaagagttttcctattgcagaaatttttctcttccatgacattgttccttttctgtttccagagttcacaaaattatttatcattagttgaacatgttataaaatattaagtagaatttctgtcatttagtatgctttcttgaaatgtttctgaggccatttctttctttttttaaaattatttaatagagatggggtctcgctgtgttgctcaggctggtcttgaactcctgggctcaagcaatcctcctgccttagcctcccaaagtgctgggattataggcgtaaaccactgcacccagcctcttaggccattttgtatctgtttttagttgattttatggttaatgtccaaatatattttttagagaacagtgaagcagaccaataaaggctgaagaacagttaggatagaaaagaatttattctggatagtgtgagaaatcagatattgttggaagagttgccaccagatatcctgacattgttggatatccaattttcaaaaaattagaaaacaataaacaatcttttttgtttgttttaaatagggatgggatcttgccatgttgcccaggctagtctcaaactcctgggctcaagtgatcctcctgccctggcctcccaaagtgctaggattacaggagtgagtcactgtgcccagcctaaagcattcttcataaagattcagatttagattttgtttgattcaaagcgcaccacagaatctttcagtacttgagtttgtctttttttttttttttttttttttgagatggtgtctcactctgtcacccaggctggagtatagtggcacaatgtctgctcactgcagcctccacctcctgggttcaagtgattctcatgcctcagcctgctgagtagctgggattacaagcatgcaccaccatgcccagctaatttttgtctttttagtagaggtggggttttaccatgttggccaggctggtctcgaactcctgaactcaagtgattcgtccaccatggcctcccgatgtgctgggattacaggcatgagccactgctcccagcccagtttatcttattaactatcagttcgacgataactgtgtgaaatacaactggtagaatagagtcccaggtatcagaaagtttactgcctttgagggcaaattcttgtgaatctttaaagtatcatatgcaattcaaataggtttaaaatgtcagtacatatatgtattaatgaagactgtggttgatcatgaataattaacagaagctgaggatttaaatttgtggggttttctctcttttttttttgttctgtgactctagctaaaggtggttatttaagtatttttaaaaattacatgaatatccaggtgaacaatgatttacaaaaaaagaaagatgaaagtggaactgtttttatccaaaacttaagaaatttctaggattgaaatttttaagaagtttgaaatgattcctcttcagtttagagaagaagtaagtctgtttatcaatacttaattcatatcatgtactatgtgtagtttgttttcataattatggctttaatgcaaaaagtaagtttttgaaagatttcttttttatgaaaataactttacgtttcagaaaattatactccaaacccctttccctaaagcacaccatttttttccctaaggcctcttttgaataatcagcaaacaatttttacttaaaagtgttacctttcgaggtagggcgcagtggctcacgcctgtaatcccagcactttgggaggctgaggtgggctgatcacctgaggtgaggagtttgagaacaacctggccaacatggtgaaaccccgtccctactaaaaatagaaaaaaattagccagacatggtggtgtgtgcctgtagtcctagctactcaggagactgaggcaagagaatcacttgaacccgggtggcagaggttggcaatgaggtgagatcatgccattgcactccagcctgggtgacagagcgagactctgtctgtattaaaaaaaaaaaaagtgttacctttctgaatactaactctgagctcggaagcattaaagaaatagtctgtagggctattgaaaaaattgatgcctaagtccctctccagttgagttcgttcagaatctctgggatagagcccaaccaagcaccatagttttaaaattcacatttgggcctcgctgatgaaacactgagctcagtgagagcagagaatgcatctttatcgtcttcgtgggcccagtgcctaccacaggcctggtacagagtgggtgctttgtaaaatgaaactttacttttgtattctgattgtgtaagtctaaaatatgtactcaggaggctgaggcaggagaatcacttgaacctgggaggcagaggttgcagggagctgagatcatgccactgcactccagcctggccaggtgacagagtgagactccgtctcaaaaacaaacaaacaaaaaaagttctgtgaaatgattatttttcttctgtttttctgtgaagggccgagatggacgaaaaaatgtggttccttgtgttctctctgtaaatggggacctagaccgaggcatgctggcctacctctatgattctttccagctgacagagaactcctttacaagaaagaaaaatcttcatagaaaggtgctgttgatatttcagagatagacttgggaaactaaaaatatgggtttgtttgttcttaatgttagtgtgctcggtttctaacataaactctaaataataaatttagtgcatgtagtctaagtatttttcagtttttttagaatctggccacaggaataagaatcaggttctcacagaatagaacaaggcatccctaataagtaatcccaaaggcatttctgtttaattgtgaacagacagctatctctatgactcctagcccctgaacctttccactgtgggcttccatttgtatcagaagctgaagcattggtacataggaggaagaaagacccggatcagggagacctgtgctattgacctctctgccccaggtgtctggcttctggtcttgtgccacatggctggttcctggatcagaggagctagatgtgggcctggaaaggctgattttagtgcatgaacatgcacttggagcatgtttatgggtcaaagaaaatcgagaggagaagttgaagttataggagagaaaagaaatgattaatggggcaagatgaaggaaaccggaggggtcaggatgggatcaagagcccaagtagaagaatgtatcttgaaaaggagatatttgaaacagcagggaagaagaaaaaggatagtgagatataaaaaggctactgggctttttggtctttgaaggacattttactgatgccctctattttctcagggagttaggaggcactattagtttaaatgtggaagagtgggggtttaaatggcacgagtggggaatagtcatataccctttgaacataaaaggaagctgccccaaatcaaaagttttaacaaataatgttgagtgttcagctgggattgggaaccatgagtttgtaggaaaccactcttcttagttaagtgatttattatacagtgttcatttagcctgctataaccatagagaagtctgattatagaattattctggggaatggggtttataaatggtttgtagctaacaaaaaaaggaatcctttctttttcttacactccacttccaaaccatcagcaaatcctgtttgactctaacttcaaaacgtatcctgagtctgaccacttcctagcctgtctactgctaccaccctgctataagccaccgccactcctcctcccctgatagagtggccctgttaaaaggtgcatgttgtgttgctcctttgctcagaacactccaggaaagcttctcatctcactcaggaaaaaccgaagccctctttttgatctgctgttctccacctcactcagtctgctccagcagcactgaccttgctatttctagaacatgctggagatgctgccagctcagagccctgtcatttgtattccccattgcctagagtgctctttcttcatcatccatgtctcgtccccccaccttctttcgagtgtttgctcaagtgtcaccatagggagagaaccttttctgaccaccttaaagttgctgaaaacctcccccagcctgcctcttgccagcatgttccatcttcttccttttttagcacctaccaccttcacatatattatttacttatttttattgtctgtttctccctgccacgagagacggagatttttacccctagcacctggaactgttcctggtatcagaggcattaaaatgtttgttggatggactaatgaatgagaagagaaggctgggctgaatggctcacgcctataatcccagcactttgggaagccaaggtgggtggatcattcaggtcaggagttcgagaccagtctgtctgggcaacatggcaaaacttcatctctacaaaaaaatactaaaactagctgggcgtggtggcgtgcacctgtagtccctgctacttaggaggctgaagtgggaggatggcttgagcccagaggtgggggttgcagtgaggcagtgagtggagcattctagcctgggcaacagagccagaccctttaaaaaaaaaaaaaaagcaaatttcatttaaaaatttttttcattcaaaaaaatatatataaaaagagaagaacagtaggttttgacaagagagagaaagttgaaatggtaagccacgtggcccaggctggtagggtccaaagtgatgctgaaagaagcattttgactgagggagttgtcagaaaatgggagggtctcaagttaatttgtttttttttttttttgagacaggatctcactctgtcgcccagactagagtgcagtggcacgatcttggctcactgcagccttgacctcccgggtcaagcattcttcccacctcagccgcctgagtagctgggactacaggtatgcgccatacctagctaatttttttgtatttttttggtagagagaagttttcaccgtgttgcccaggctggtctcaaactcctgagctcaaggaatccacctgcctcagcctcccaaagtgctggaattataggcatgtaccaccatgcctggccaaattaatttctttctgccaaacatctaagtggagaaatctggggggcagctgaatatgttactacatggtgtttttatgacctcagctaacttctgttttcacacagaaaattataactgttaagaaactgtttgttaatacttgtgttatatttaaacttgtgttatatttaaacaaactatgctttttcccctttcctgtcttctccctcccccatttaattgccttaggtacttaaacttcacccttgtttagcccctattaaggttgctttggatgtaggaagaggccccacattggaactaagacaggtgagttaaatgagtttaaatgtcattttaattacagattgagtattatccaaaaacgctttggaccaggaccattttggatctcggatttttttggtatatttgcatctctaatccaaaaatccaaaatcttaaatgttctgatgagcatttcctttgaactcaaggtttcaggttttggagcattttggatttcggattttctgattagggatgctcaacctaacccttactctaagtaaacttgatagcttgccatttaaaattttattttgattcatttgctttttaaaatgttttaggtcgggcgtggtggctcacgcctgtaatcccagcactttgggaggccaaagcgggtggatcacgaggtcaagagatcgagaccatcctggccaatatggtgaaaccccatctactaaaaatacaaaaattagctgggcgtggtggcacgcacctgtagtcccagatactcaggaggctaaggcaggagaatcacttgaacctaggaggcagaggttgcagtgagctgagatagcaccactgcactccagcctgggcgacagagactccgtctcaaaaaaaaaaaaaaaagtttttaatttgcctggccaatatggcaaaacctggtctctactgaaaatacaaaaattagccgagcataatggtatgtgcctgtaattccagctattcaggaggctaaggcacaagaatcacttgaacctgggaggtggaggttgcagtgagccgagatcgcagcactgcactccagcctgggtgacagagcaagaccctgcttcagaaaaaaaaaaaaaaaaaaaaaaagctttaattaaataatgaactgtgggtaagtactgtgattatatataattttgaagtgtgttaaagaagctgaatacagttcattgggtttgctgttcatgcccattcatagtttcactttttagtgagtagacatagtaattaaaatatttgtacacatgttagtgaatgtgacttatttctttcccctttgaactttttatttatttatttatttattttgagacggagtcttgctctgttacccaggctggagtgcagtggcacgatctcggctcactgcaacctctgcctcccaggttcaagcaattctcctgcctcagcctccctagtagatgggattacaggtacacaccgccacacctggctaattttttagtatttttagtagagacagggtttcaccatgttggccaggctggtctccaactcctgacctcaagtgatccgcccacctcggcctcccaacgtgctgggattacaggcgtgagccaccgtgcgcagcctttcccctttgaacttaacacttttggtaactgactatattcagatattctagatctataattttattttgatttttctaatttgttctaatgattaaatactcttaagaaaggccatgggggatggctttcatttcgttccagagactccttcagcagtcgtcatttctgtctgggtgattgagacccagcccagacctgaatgcggacactaaaaagatttaaagactttgagagtcccccagctttctgaccctggcttttgtggagaggtctgggaagatgggagatagtgagctcaaagaaggagaagataatggcgtatgtcccacattttctcccagggtatggcagcctccctaatacccttataagctaggaagctcctaggatgctgtagctcagtcaccatttagtaatgtctggagagatttgtggttgtcctaagagtgggagggtgctgcaggcctctcctggaggccaggaatgctgctaaacaccctgggtcagcagtgcaagggtgaggaaccctgctctggactgttggtgctagactgttaaggggtttttaaattttgctttgttttgcttccctattgcttgtaaagaaaacagttaagtttactgtgtcatttattcatcgttacttctgtatttccagtcaagcttttgtctccagcattccagtgaaatgggttgatcagtctcttcttgaaacattttccggggtttgcttctggaataccactctcctttttctcatcctttttctttcctggctcttctgcctcttcctgacttggtggtataacctagggctcaggtctcacctctcagatgagggctctgagttcatacagccctttggatctcctggtttttttctgacagaatctgttttggttttgtttgtgttttgaatgatactaagggtaataaaaattcttatttgatatacaaatttctcagaagattggcatttagtattcagctttgctatgcttaattacttcattttcagaagaagtatacgatttataaagtatatgatatggaagttataaacattaacatcacataattaaagaaacatacccattttagagattgaagagggtgatttgtggcttcacaaaaatagaataatcactctagctaccattatttctttcatatttgaagtttttctatttctttctaggtttgtcaagggctatttaatgagttactagaaaatgggatttctgtgtggcctggttatttggaaactatgcagtcctcattggaacaactttattcgaagtaagaattgtattttcattaaagagtgtatttattcaagagtttttgattatgtttatgaattacagaaacaaatctcttctaaatttatatataaaatataattttaaattattcctcagtttcccttttacagaactatgtgcatttagttaattgcctcagcagggaacagtattcagcaagtatgtttgagcacatgctgtatgtagttccaagacttaatgtcatgaagtatgtatacctcagcttatccacttatggatgaaagtatgtatgtagagagcatgtgttgaatcaagactgaaggaatatgagtggaatgcctttctttgctggcattgtggtccattctgagactgagtggaagggaattctattctggagggatggtctgttctagtcttctaagggattggcacctctgttcacccaattgctcaagacagagaaactggctatcatccttaactcctccctcttcctcattctctacatccagtctatcatcaaatgctgtcagcttgcttcctaaatgtatctcatccatctctgtcttcgctgccactacccaagttagagtcaccaatatctcttgcctggattattgaaatcatctcctaattgagctctctgtgtctagtctcaccccatgctatttcattaattgttgtttttaaataatccattcttgttattttttttaagctttttgtgttgaatatgtatcttttgggtgaaaagttgtgaaccattgtgttttgatcttcagttctctgaacatttgttaaaatacaccttccaggctgggcgcagtggctcacacctgtaatcccagcactttgggaggttgaggcgggcagatcacctgaggtcaggagttcaagaccagcctggccaacatagcaaaaccccgtctctactaaaaatacaaaaaattacctggccatggtggcttgtgcctgtagtcctagctacttgggaggctgaggcaggagaattgcttgaacccaggaggcggaggttgcagtgagctgagatcaagccactgcactccatcctgggtgacagagcgagactccttctcaaaaaaaaaaaaaaaaaacacctttcagatgatgtccaaagaaaagtagttttctataattagagcatctaatggttttattatgtgtaaaatgaaggggcagcacttgaactttcttgtcctctcaggttctcaattcttatcctttgagccatgtggacattgtcaagttgcagttgttctttatatggtaaaggttttattgtcccaggatatttttatgaaattattattaaacacgtactatgttttattcactttgctatagtggtgaacaacacagaaaaatgtatcattctttttttttaagacagagtctcgcactgtcgcccgggctggtgcaatggcgtgatctcggcttagtgcaacctctgcctcccgtgttcaagcgattctcctgcctcagcctcccgagtagctgggattacatgcgcctgccaccacgcccagctaattttttgtagttttggtagagatggggtttcactatgttggccaggctggtctcgaactcctgacctcatgatccgcccatctcagcctcccaaagtgctgggattacaggcatgagtcaccacgcccagccatactattcttgttaagcttatattctagtaggacaaaatagacaataaataaacagagaaataaaaagtttctgatggagtcctacaaaggaaataaacagtaatgagatagtgtgacttggtaagcatacagaaggtcagccgtgcatctatctgtttggttattgctgaactagaagctataagctagctactcaataaaggaaacatgattttggtataatttgttataccaaattgcatctttattataatattgtttattgtaagagacttcagtctaaaataattgttcttggattgcatccaagaaccaaaaggctgaggttattatgcggttcttctgtgatatcaccccaaatgatgtgttgaggtaccagtgtttattctcagattttattttcttttatgacttttcagctctagcaataagttagaaactgtctgaaaatattactttaaatacaattcagaaactttaaaaatgttgggtttttttggtccacccttaagccctgagtctgtgactcttgagagtgcatgaacactgaattacagctggcaacgtggaggaatttattatttacatttgtgctcatgtgtctgtttaactacttttttcttaggtatgatgaaatgagtattctcttcacagttttggttactgaaactactttggagaatggattaatacatctgagaagcagagacaccacaatgaaggaaatgatgcatatatccaaattaaaagactttttgattaagtatatatcatcagctaagaatgtatagatttttatatttgtataataaatattcttctctcctaatttggttgtcttatgttcacttagatttatttctagcccctttgcacttataaagtggacatttgtggtgcttgctttcattcagtgtttatattttttatgtctttcattgtatcaggaatatgttcagctacaagaaacaaaaatctactatactggattaagcaaattggggtttgtttttcttacatacaagaactctagcgggtagactgtccaaagctagtattactgtttctatagttagggacccaggcacttcccttctgttctgccatgtttagtacgctggtgtttatcattgttgcttcgggatcttaggtggctgctgtatttccagcctaattatcattctagttaggagaaaagttaaagagacaagagctagtcagccaacactcttcccttttaaattagggaagtaaaaacttttccagacatcccagtcgggagatgtctttacatctctttggtcagaactaaatcacatgataatttctaggcaaatcaccatccaagggaatgaaaatgatctgatttagatcaaacgcaatttatcccttgaggctgcaatagtatcttactctctcagaaatgggctttgttaccaggaaggaaaaggtctttatggaatctgccacatctatactgtcagatatcaaaaattaacctaaaactaaacttttaaaacttagagtatttacggatttttgaaaagcaactaaaatatatgttagatgtcatatattgtagtttgtttcctgtctaatatctatgtttataagaaatcttttaacttttatgtgttgatatgattgtgtaaaatatcccattgttaccaacttgacaaaaattccaactgatagtgcctgtaaaatatttcaaaagtttgactgacttaattgattttacttggtaggtttttctctttttttttttattttaattttaattttttttgtagagacagggtctcactatgttggctaagctgatctttcactccgagcctcaagtagtcctcctgccttgacctcctaaaatgatgggataacaattttgagccactgcacctagccttgttttggttattttatgcttttttttattatggagaattttaaaagcagacatataattgtactaattctatgtagtgatcatctagcaccaacaacaatcaacctttggccagtcccacctcatccactaataccacccttccatattatatcagtaatttatttatttacatttatttattaatttaagagacagggtctcactatgtggcccaggctggtctcaaactcctaggctcaagtgatcctcctgtctcagcctcccaaaatatggggattacaggcatgaaccacctcacctggcctccttgaatattatttcaaggcagatagcagctaccatttaatctggaaatatttaaggatcttttgttaataaccacactattatcacattaaaaaaataacactacatgatatcaaggaattatttacaattttgttgggtgtgataatggtagtatgtttatatttttctttttaaaaaaatccttgtctgacagatacatacatttatggtaattgagacttgctttataattctcctgtttaaaacaaacttttttaagtggtgggagatgaaataagaatagcactgagttggccagtggctgacgcttgtaatcccaaccctttgggaggctgaggcaggtggattacctgcggtcaggagtttgagaccagcctggccaacatggtgaaactactaaaaatacaaaaaattagctgggcgtggtggtgggcgcctgtaatcccagctacttgggaggctgaggcaggagaatcgcttgaacccaggaggcagaggttgcagtgagccaagatcgcgccattgtactccagcctgggtgacacagtgagacgctgtctcaaaaaaaaaaaaaaaaaaaaaaaggaagtggtagtagtgtctgtttg

SEQ ID NO: 15462 - DNA, 20468 bp, Human
aacattttcatgaagttatgactccctgtggcaccctgaggagtaatgggtgtctggaggctgaaggatggagaggttcctgaatttgggatttgcttgtctccgggaaagagggactgagatcagtgtaaactttcctcaggctacacgcacacaaccatcccgcttccttctggctctcagcacaagtggcccaggcacctgtagcagaccctgtatttaagaggcatcctagctccttaacagcctgacttgataaattacaccatcagcccttgcacacctaggagattagatcctgcccctaggcagatgagagctgctagactcttcctcctcctgctgaaattcctctctatccctaacctaaccttacttcctcctagatatctttcaagggtgggagaggaaggaaaatgtgcttagaaactcctttgcaatttttctgctgattctgaaaccctagtcccccaatccctccaaccccagcactgtatcaccaattctgaataccctaagtttccagagtaactcagttttactactgggaactggcttcccgtcttctcagaccagaaagtgttgaactttattattagaccaagcggttgcacaagtggcctcagtcaatatacacaacccccaaaaaaaggttatcagtggtatcctctttttgcagatgaggaaactgaggctcccagaagggaagcgttatgctcctccccagaagctttaggtctgtgtgtggtggaagcaaagaagcccctttccctgttcttctacaggtcaggtcctagcttgccggtttgggcgcgcttccgccgccctcccctcctgcccgtcaccaggggggaagcaggtgaaactccaatagtgctgcaaggcctatggcttcctacctggcccaggccagagtgggaaaaaaaacatctttccctcagtagctctgtcgacaccttctgtactaggagtgcaagacttctgccactgctgcagtgacctcgtctacagagctcgtccccggcccagggaaccacagatgttctggaactacgaataaaccagaaatgagtgggccggggggaccctcggctgcaagtgtccacccagctgcaggtcaagctttgctttcactgcctcaccatcctagtgcctcaccatcctcccccaagcggaggcgccttgacatccgggtttaaacaggagagtgaggagccccaggggtccagctccccagtggcgtggccaggctgggcgccggtgcagcccagctgctgggggagcttcactttggctactccctctacccataaagtagtctctttccaagagttctcccggactccttcaccctcgcctacgctctctggcgggcagttctgcaaacccaaaccgccagaccaggccagggaggttctggggcctggaggtagtaaccgaggtagaaataaatggagtccctccagggcatgctcaccacacctaacgctgcctcacctcccccgtggcctcggcgccccttcctaagtggtcagtttctcttccgccctgcgggctctcctggcccaccacctgcgtcggccgggacgcatccagggtctctactcttcgcttcctcctgcgtccccttcttccacgagcaccccagcttcctctggctctcacctgaaccccgaagcgtagtgtcttctctctggactaaagcggaactgagaaccggtggaaaagccccgcgcctaggctgcaaggcactggcttaacaagtccaaaggttaggtgaagtttggctgataagcagaaccagtaaaagaaggtctctagccccccagcgtgagtacaatggaccctggcaaagccccgctcccggcccaggtcttctgctctccaggtctgcccctccggctctccctctctccgggtttccccctccccaccatcatttgcatccagccgaaagctgggcccttcccactaatttgcatatcttatatggcctaatggtggcgatcatggcaagttagaagttttctgactcctttcggaggagcctccgggaccccggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcaggtaggcgcagagcgaggtggaggggacccacccgaacccctggagccccggccccgggcctgagtgacactgcgcccgaccacactcgccaagcccgtttcccaccagagaagtcccccggggggcgctctgcttctctcccaacacccggacccttcccaatcccttagcgggacgaccctgcggcccaccgggcttcttctccccaggcccaggccagcgtccgagacccaagggcttttccccgcggggctggggctgggccggggagaactggagctgtggagccctttgccgggaggtttgcccacgcgactgaaggtgcgagtgggtgcagtgaaaccgctgcgacttcccgggagcagagcctcgcgccgctgcaagccccaggccgcgcatttttcctgcgcgctgcctcgggtctggaaagccgcatgtcggcctcggacacattgacctgcatgatgacctgcagttctttgccgaaggacaggcggcatccggagccgggatctgggaggcgagttccctggtgggcactcttgttagccgcgcccatgcaaggcccggaattatccgggatccccaacgcgggtttagatttgcaaagggcatgttccatgcagggtccgggtggacacgcgcggggccaaagaaaccaagcgcggtggtgtgggggcgaacgcgtctcagacctcagttcgcagaggatctggtctcagtctgagaaaggagggcgtttccagacctcgctgcccacccccggcctctccccgggagttcaggccggctggcagtgtatccccagggccgggatcgtttgtgggtcctccccgaccgccctagactttgacagctggttactaattatctaaggagccgagcggttccctgagacagcacgtcgctcccgggccactccgctttaggacagagcccatcgcgtggcttcggacactgaagcgccgcgatttcggggctgagccttggccgcacgtccgcagcggcggtttggggtgggatatgaccttgcatttgaatttgtgctccgagggcctggcggtttgccctctagccaaaacaatcaggggaacttgtagattttttttccccaaacacactttggtataattcataggtttgaggttcttccctcgtcgctctcccgcccggaggtgatttctcccctaccgggagagaactcctgcaagagagttccgcgaggcggaaggtgtgagtcgcggaggctaagaggggtcgagagagtggcccctaggagcggctggggcgccagggctgccggggaggtcgctcaggacctggcggatgaaccaggctcccaccgccggccaccgggggccacagggcctaggccctcccactcggccgcaggcgcccgctttctagcgcggcgctggaaggacctggggcgcccctccgcacccagccccgcgccgggctggccgcagctgagacgtaacataaactgcagcacgtggagttggggtgttattaatttatttctataaatcatcaacagaaagatacacaaagagccgtgattaggttgaaaagagaggcgggttattcattggtgaagttgtaaacgcggcttagaggggggaaggagatcaaaacgcgggcgcggggctgctcgccgctcccagcgcgcacccagccaggcgccccgtgcggccctgcggcctcaccgctctggcgcgggacgcgggctctgtgagcgcccgagccgcccgcggagcccccgggtcgccgacacccgcaggcccggccggcggagagccaggcccggcccagggtccttagaccccagccccgctcttccctccccaaagccccaggccccagcagggcagggagagggactggggagccggagaccctcgccgagttggagacgcgggacagacctggaggcttttttctcccgtcccgagcgggtgctgcctttcctcccccgctcccgggagcgccggacttgattaaagtaatttttcaagaaatcgctagcggttcctaggtcactgcacagggggctcccaagcctcgggcacacgcactcccttcttttgcccaccgtgttcccttaagacgaaaagcaaagagaaagaaaagtcgcgttttggagttcctggagttctagtaaacctcctggaagagaaaggcaggggaggaaggtcgggactgcgcgcttcccggtccccggctcccggccggagctggcctttctcgcggcctcgaggcaggtgcgccgggggcgtctagaaagtgggctgcattctaagaagccgaagttgggctccttaacgaacgcgctgcggactgcgctggagtccaggcttctctgctcgtgggcagcaaagtcattgtttgagaaggagcgtgcgggacggaccctgcgggcgccgcggccggcgtttgacacctgcgcttgggacacaatggccgcaggccctcttcgggaccggtgcctttctcggtgttagggaacctctgaacctgagctgtgttttcaaacaaacaaacaaaaataaccagctctcccggctcttcccggtgaacacacgtgaattttggggtcagagggttgtgaaggtataactgcgccatcttactcctcactcttttaagtcggacttaaaaggttttgccattatttataaggttcttgggggctttttttaaaccctccccaattgttgggctaattcactgtttccacagaatcattcccacttagaacagtaccctatttttctaggtttcttaggcatacaaaatgaacacaggtaaaggcatttaaacaaaagaaaaatagccgaagaatttgctaaagcaatattcacttttaaaatgcaatttttcccctaaggttcgaggcgtcttgttcgtagccgttgaaagtatttttccatcctaaaaatatctgtggaaatattgaccagaaataaacttttaaatgatctgtgatgtttacaaggatatgtctaaaacgtttattacattattttcctcttaatgtgaattctccacgtttgaaactgtaactcgttttctcattttttgttcttcttgttacttcctcatattgtgtacttggaaattacctttgtaaatacttgagaaattcgttcttatatataattaatataaaaagtttgcatttctcaaaaacatctctatcaaagcctgtgttctcacgagtttaatatcaaagtcttaataaaataatcacaactacccaaatgcttataaaatatgttcgattactggatttttattcattaaacagaattaattttatttgacatatttaaaggcgccatttagaaataaaattgcttattatgttgcaatactgtatctatttcagcctctacaccgttttcttttttgtttcacctgaaactagttttcccttccgttttttttcttgttctatcaagctaatatatatatcaacatacagtaatggggtgctggtttttgtaagttaaatatgtacctgcattaaataaatagtaaacatgtatatattgcttctttagtacttttgttctgtgctgcacactattttaatttctagttttaaattatatctctcttttcaaagcatctgttcaataagcaagaaaagatattggcaaagttgaaaccattctagacaaataaaattcaaaggtgctaaaactagcagtttacacacctgtgtttatgagaaatgaaaagtataaccatgttcttattcagtatttaaaatttatgagaaacataatacaggaaaacaagcatctaaaattgttaatgtccgaaattgaagttatttgtccccattagcccagtagattttgtctggaaggtggagctgtggattttttttttttttaactacttgcctcacctcagtggtgtgatcctcccgtcccaaggagatacaacattgtattttggaaaacttttctaaaactctgaaaattatttactatttggctaagacatcctccttgcttcttagaaggtgaacacatacatttcacccctgttttataagaaatggagatacccattcaaaaggaaaataatgtaggagaggttgaagctaaaattgggcaaattcagaaactgatgctatccctacttcattgtaggatcagggagtccagccccaagctaaaggcatccccactttccagtgggcctcctgccttttaaatctcccacattgcaggaaaatggaggaaagcaaaataaaatggccaggcgcggtggctcacgtctgtaatcccagcactttgggaggccgaggcagatggatcacctaaggtcaggagtgtgagcccagcctggccaacatggtgaaaccccatctctactaaaaataaaaaatttagctgggtgtggtgctgggcatctataatcccagttactctggaggctgaggcaggagaatcgcttgaacccaggatcctggtggaggttgcagtgagccaagatgccgttgcactccagcctgggtgacaagagcaaaactccacatcaaaaaaaataataataaataaattaattaattaattaaataaaacaagagcttttctttttgcttaataagagagagtggtggtggtgcttttttattcctgaagatgggaagtcctcttttgcccactaacctcagaagaaagggatgaggtgtaccgtacaggggcagtcaccttctcctctgtttagcttccattttggcctcatgtctaccccaaagttgtagcttagatggggggaaaattcagaattttgcatagaccataggtagcaccccctagaaaaagaatgtttctccccagatgtctcccactagtaccctaaccatctgcttgtctgtctagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacgtaagtgttttcatcctgcctctgcctcaacctgaagtgacctttgccctctcaccccattggctgcctcagtttccctttcatcgacaaggccttgtgagcacttggcagatatgaggaaggtggcaagtagatttggccttggtggttgctgtacaatggattggcttctgtcatgttcttcagtcacagcccccttgctacccagccagttgctctgaggagcctgtcagtgtatgcagcataccttaaactttttggcccctccttccacctccttctctttgaaaccaagtaggtgacagagtgaaatgtcttccctgagagaaaacccagcatctccccttgatacgtgaccatcagtcaatttccaaagaagacatttcgttgcagtcaataatattgattactattactgttaatttcctcctctctggaaaaagtatcaacaatagaatgcatttgtatagagagatatattcagaacttcaccctgttcttggaggatagtgggagggattgaatcctgaggcaatttaaggtgtttacccacatttaccaacactggtagagtgtggggacctcagctggtggccctgctcatgaagaagctatttctggctaaggcagggcacaggaaaagcatctgcatttggaactctgacccatcaattcttgtcatccccattcccatcccaaagttttttttctgtcccaagatttctcccacccaataattctaaaaggtttttgttttgaagtacgtctagagaagtttgaactgcctatgaataacaagagtaggaatgacatactgtctgtattttaggaaagtattctttgacattacactttcattactttgatccaatccttttcctggaaaatttgtatcggttttcactctccccacacactatcctctggctttatctaggcttctctgtctttatcaagatgttaatttccaccactatctgggtttctgggttgggttttttccctgttgctttttaaaatgactcttgtcttctgttacacactgctctgaagtgattgtttcagtatttattgtctcaatgtccctgggctggtgaaaggaatggttttaggtgttcatttcatattgtggtgtttgtgcttttgttgggagcattacatgaatagattggaagaagcaacatgagagctgtttgctgcttagagcgagagacctttccaagaatgggttggccccccatacttggtgactagctctttaagaatttgtgttcctgacatgaagcaactctctgtagttcctggaaagcctaaaaaaattctcaggagccattgtctccaaagacccaacaacgcttgggccctgcccaatttaagctttatgcagcatctccagtctgtgctgcctctctgtattcaatgagaatttcttcagaaaggagaaggaggcaggaaaggcagactggaaacttctcaaaagacagaggtccagaaagtttctcaagatgctgaggaagggacgttttacaaatacaacagcctcttcaagagattgttgttattgttatttttgttttatttatttatttatttatttaactttttgagacggggtctcgctctgccacccagactggagtgcagtggcgcgatctcggctcactgcaagctccgcctcccgggttcacgccattctcctgcttcagcctcccaagtagctgggactgcaggtgcccgccaccacacctggctaattttttttttttttggtatttttagtagagacggggtttcactatgttggccaggctggtcttgatctcctgacctcgtgatccgccgcctcagcctcccaaagtgctgggattacaggggtgagccaccgcacccagttgttatttttgttttaaagtcacacgagacataaaagcttaagaaacattccttccttctgtaactattatacaggcacctactatgtgccaaacactacgctaagctatggaatacataggttcttttctccagggacttacctgccatccagtgaagaagtggagatgtttgagtaaataatgacattcactttctaagagctgttataaagatatacacaaggggcagcagaggaattgctaaattgcctggagacatcatgggaggcttcctagaagaggtgacattcaaatcatgtcttgaaggatgaatgtaagacatgcaagcatgatataagaattaggaagtaagagaaataaaagagggacacaagtgaatggggtgaggagaaggaggaagaggggagagaataaaaaatgatacatgattacaaatttcctggaaaaactaaaaataacaaatggtaatattcatgggcccctctacacacacagaacctccttgtccaagcagcccccaagcctataaagaggctactgaagccaacttctccaagataattttcatgggcaatgaacattttcttccccaaccccaattaatctgaagggaagtagagaagagttgttggtggctagagggagcaaatgtgggagtctagttcttcaaaaattgggagaggctagagccaagcccctgatgtcagtggaacccgaatggttctgagcacctacaggcaaacccacctggctgatttgaggacacactgagttctgaacactgttcagcctgctacctcctcaaagggcaggtgagagactgaggcagccctcacactggggagcagctgcgagagtgtctcacacccaccagacacaaagcttcaggaatcggttttgtcacctccacacaagtcagatatgaagcgtttgcggggtacgtggcttgggttttgtttttagtgagaggtgatgcacaggctggtagttaggagcctgcaagcctgcaggctgggctcgtgtccaggctcctgccccaagtccacatgactttggacaagtcacttcaccagtctgaacctcagtttcttcatctgtaaaatggaggtggctatacttctcacatggagcggtcgtaagaattagatgaaggaatatatttagaggatttggcacaatacctcaccacagaaaaggttcaataaatgtgaaccgttattgtgtctgttcacatcaaatgaaaaaatctcacattgctcccaggcccttgggatgatccacactggctttcgccattggtgactctactggtgccacacagggcccacggggaggagggaagacactgtgacagacctcactgagcaggggacatctccttctcccccttggatttcccctcaagtaactgcatttagagagctgctgtgaagtcaaataccatagaggggctaaagcactttgaaaagtataatcaggtggggcatggtggctcacgcctgtaaccccaatgctttgggaggctgaggtggcgggaagactgcttgaggccaggagtctgagaccagcttgggcaacatagcgagaccccgtctctacaaaaataattttttttaattagtcagatgtggtggcctgcacatccgtagtcccagctacttgggaggctaaggcgagaggatggcttgagcccaggaggtcaaggctgcagtgagctatgatcgtactactgcattccagcctgggtcacagagcaagaccttgtttgaaaaaaagaaaaagtataacccccaaaggaatttgggccaacatcactatcatcctgactaggggtagatattctaaaagactagttagtgtccctaagctttcagtcagtctcattccacagctggggagactaaatgatgagggaattaagctggggccccacatgatcccactagcagtgacttcctgctagtacatttgacagggactctctcaggtctatagtggcattgttgggcaccactgaaaacagagccctaaggtggcctaagaatcctccaaggtgaatgggccgaaatcaaaggccccagtgacaccatcagtccacagttaaacaaagcccaacaccacctgcagttgggattgcaagtcttggcgggctaggggccctaaccattcctcccgatggagcaaaatggaaatgagcctaagacaggtggtaagttccctgctgctggaggcatatagcctggagggccacttggtgtggggttgtagaggggattcaaacgttaagtagtagcctgacttgaaccttgaggattttggatccagttgtccaaaggaacaggaaggatggcatgtaaatgatggcacatcatttacatcacaaagggaggtggtagccttccactttctgtgacctgtgggagtaattacaggaactgagaaagaaagtcatcaaggtcgggcacggtggctcacacctgtaatccctgcactttgggaggctgaggcaggtggatcacctgaggtcgggagtttgagaccagcctgcccaacatgatgaaaccccatctctactaaaaatacaaaaaattagctgggcatggtgccgcacacctataatcccagctactcaggaggctgaggcaggagaattgtttgaacccgggaggcggagattgtagtgagccgagatcacaccactgtactccagcctgggcaacaagaggcaaactctgtctcaaaaaaaaaaaaaaaaagatattaagatccagaacatagggacccagagctaggagatgaatgtattacgtgtctttgctcagcagagtgcttagcctccatgtttattcatctttaaaatggaattaatcactcctgatgagccctgcttcatgcagatgtgaagacgaggacagcaaagctttcttcttcggtaatgtagatatcaaatctcattaaaccatgtgggctaaggcatcacctctgggccgagctgctggttctcattcattccacaaaaatctcctgatggtcacagtatgcctggactcaaggaattggacagacagggagcatcatttccagctaattaaacactactcccagacaggtcctgtgtttgtagtctttgaaattattttgagatctaaagcacattttctttttccaatacaaagctccagttatatttatttcaaagcatgttccaaaaggtttggggtttttctaaaaacctgactttataatgtagatacctaggatataggaagagggaggagaggtggggagtgctatctacagcctctgaatattttgtgcaagtgtaaattgtacctttgagcagttctcccctggatgtgagacttgattgagctcacccacttgacatcaaatacaggagttcaggatgcagagtgttgcttcatctctgaaggccagtgagccaaaggggaaaaaataataattttcttaaaactatagctggctatgtttgagctccttcaaagaaaggaaaagggtggctttgctggagcaactgaggtgggcagtaagggcctgtgctgagggctccccatctccagctccacatgcagtgagagaaggttgcaaagcttagttagacgaggggaataaaggtgtcttcgtccgttgtctgtctgtctgtctgtctgctgagtgaaggctacagaccctatcaaatctactcctttctcttttcagaattcaaccagacagtccagagttctggaaatatgacagacaaaagcagtcaggatcagctgctgtttctctttccagagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacaggtaacaccaccagaagctcacctgggcaggtgggcaagtacacagacccaggaaccctcccctcggtcctgggatattgagacactagttatacagataagtgtggctaaatcagagcttctcaaagtatgttccacagaaccccaatatcaattcattaatcagtaagtctgagaatcagcatatggatacttccccttagagagtcacaacatatattaaaggttccgagaagccctgcagtcaagaaacccacttagctttgttgaattggttgttaactatggaatcttcggtagagtacaaacaaccccatgaattattcttccagggaagatactctggagaatgctaatttaaaatatgatacttgggaagcgaaattgtgtgtttgacctccctgcaggccagggtaaaactttcccttagccacagactctagatctggcctctaccaattgtcagacatgcagtggtccaaaaggaaacttggcaggagagtaagaattggtcagatctgttcagtctactctgcccccgctgactcaacagagttctttttacttgttaactaccagccaggcacggtggctcacacttataatcccagcactttgggaggccgaggcgggaggattgcttgagcccaggagtttgagaccagcctgggcaacatggtgaaaccctatctctatttaaaaaaaaaaacaaaaaaacaaaaaaacaactctgtgttattttaagtatttatttttaaaatgtggtcttgctatgttgcccagcagatcttgaactgggcttaagcgatcctcctgccttggcctcctaaatagctgggattacaggctctagccacagggcccagctattttttttttaaacgattggaaagccttgggaaatctttttacttcattcctgccctgttctccctgactccagtattgactttctaaaacttcagctctttggtctggccaaggcctgtgtgcgctttctctgtctctgggctgggctggccttggctgtgggaagaatgcagccagggaggtcaggctgggaagcagggaggcctgtattgccactgagtcctcaggctgtgctccataccccgactaatgagatgccttgcagcacccagtagtgtctaagaatctctcgcacctggttttgaggtttcaccagccctgataaagctagagactggccatctcaatgcaccctgctttgtaccccacccagcctgccttttggaggggataaagcatcttgcttcctggcactctttcagggagttcaagccccaaaagaccagaaatcctctcgaagtgctttgaagccactcaagacagagccagcgaagggctttgccttttatgtggtgggaagaatggctaaataaggaagccccatctggaccttcccctggactgcctgtccccggcttgctctcttctcctcgagagccacaccagagcctaagcccctgactcccagggcggcatagcctgctctgtccctgcgttcaggcccacttcagccatcttcatcagatcactccatggattggccttttctctgcataggcctctcctccccagccttccattctgcccacggccccttcatactcccaaccaagactgctgtgattgtgtgtttttggccaagcaccaacaagtccccccgccccccctcactcaccatctcccctccatccattcccagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggtaagcaaaggttgggcctcactgcctcggcaacccaaccatcctggttcttgccacggatcttatctggtttaagggttttcagaggagcaaacgcttttgagatgatcctagggccgctctctcattgccagaatatactcccctggaaataatgtgtggctctgatcagtttcctccaactcctggttcagccattgccctgtgagggctcactcggcttccagggagccctttaccctatttgtctccttccctcttcttctccctgtgtggctgctgactcagcggtcattctacactgaggaggctgccttatgggtgggccagatccaaaccgcaggcaaacgggtcgtgatggcgtggcaaccctcactgtgttggaggatggcactccggccacctcctccatctctggccatatcctgcccctcgctcggtccggctgcctcaggagaagctcagtagcctttggggacggccactctgttggtggcctctgcttgttggcttccgtgtgtcatcagggttggtgggggtcagtcacttgaaatctttgcagcaatgagttgggaaaaactgaccgagtacctgctccatcatgcttgattgagtgctcctgtgtgctgggccctggcctggattagaatgcctctgctgtgggctttgggtttgtcaggatggaatcctacagcctccttgggggaaagcacacctcatgctgagcgctgtgttaggcacaggctgggatggagcacttcttctggtccttcattcttctggcaaagctggcttcctagaatggatgtgctcactggggtctgtgtggtgcccatgaggacaaagtgtagcagcctcctgcctgctccaagaaaagggcttgcgaaaggaaagccaaacactgtttctaactcaggggtgattctgaaacctgttggctcccctcacctgtcggttgcccttctgatgagaaaggcctgagggctgggggctgacccaagtgttgaggggaccaaagccaccaagacaggctcggagccatcagctgggtggtgtacaagcatttgttccatgcctgctgtgccctcccatagcactgcctcttccagggcctctgggagcctgacagtgcccagcatgaaggtggggccagtgctgggggtttctgtaggtcccactcccacagaggagagaggctcagccacacaggaagaaagtcttggttacttaagaggcagagaagcccctaggcaaagactggcctgattgcagagtaacttcgcccctttagggaaattcaaagcagggttctgagggttgtggcaaatggcacatggctggcactgagcagtaccagtgtgcttgcccaccacagcgatccacggagctgaagctgggagctacagggggcgtggttggggcaaggggcattactgggaagacaatggccattgtgttgggacctgtgatctccacaccaaagtcagggagcctggaagccaaacaaaggcccagcagccttctgacaagcaagggctgtgctgaggtcaccacggggtcgttggtttaggcatcctgtgtgctgacaggagacccagagagctagggctggagggacagggagcagggcagaaaacacagcctgtgtactcctctgactggagtctaggaagggcgtgtcccatgggaagtggatactctggggtgcccctgaagtctggatctttctaaaaatcttgtaatgttagaatttggagggaatttgaagaaaggaactgaggcccagaaagaggcagtgatttgccaaagtgacacagagcaatggtagcaaaacaaggactagagctcaggcctgctggttcccactccatactttcccacagcactacgatgtgttgaatgcttaccaagtcctgggaatatgctagtgatgtacgagctgcgcgtcctgccctctgggaggttactgtctggtaggaaggatatcgggtcactgtcgagtccccagaaccagctgcagatggaggttttgtttgggggctttgtggatctttctgcggtgtaatagatcctattactgtttctggagcaacagttatgggacactgaatattatcagtggctgcctttcttctgtcttttttttttttttttttttttgagagacagggtctacctctgtcacccgagctagagtgcagtggtgcagtcttggctcactacagcctcgaactcctggtctcaagcagtcctcctgtcttagcctcccaaagtgctgggattacagttgtgagattgtgcccagcccttctgctttaattttcactctgggctcctcaacatggtccttgtcccaagcccagggactggcttctctttctctgagtgtagttatgtatctgggttctaaccagtaaggttataactgtggctaattcacataacttctctgagtctgaatttcctgcctacaaaatggagaaataggaccttccacacagggtgcatgtgaggatgaaaggagtgaatgtataaagacacctttcccgataacccatactaccctcattatgactcttaacattagagagggctaaacaagggcagtgagaagactggcaggcagcagaaatcattttctttttgatctcacacaccagggcattccccctaagaggcagtgagatgtagcctggccctggaactagaaacagaggtggctgctgtgctagtgcctgagatgcacgatgctggggtcaaagacttgtgtccccacctcaggctgccaggatggcgtgtgtgccgtgacagggctcccgagtcatgcactcaggcagacagcaggctggagcccagcattcaggggtggcttctgtctgtagagccgcatggcactcttcccacctcagtgcccacagccaaggtagggtcactaaccaagccagaaacgtaactgtgtgcagaataccgaaaaaaaaaaaaaaaaaaaggccgggtgcggtggctcacgcctgtaatcccagcactttgggaggccgaggcgggcggatcacgaggtcaggagatcgaggccatcctggctaacacagtgaaaccccgtctgtactaaaaatacaaaaaattagccgggtgtggtggcgggtgcctgtagtcccagctacttgggaggctgaggcaggagaatggcgtgaacccaggaggcggagcttgcagggagcagagatcacgccactgcactctagcctgggtgacagagcgagactccgtctcaaaaaaaaaaaaaacgctctgtgggctaggtgtggtggctcacacctgaaatcccagaactttggaaggccaaggcaggcagatcacttgaggtcaggagtttgagaccagcctgaccaacatggtgaaaccccatctctactaaaaacacaaaaatcagctgggcgtggtggcaggtgcctgtaatcccagcgactccggaggctgaggcaggagaatcgcttgaacccgggaggcgggaagtggaggttgcagtgagccgagatgggccactccactccactccaacctgagcaacagagcaagactctgtcttaaaaaaaaaacaacaaaaaaaactccatgttgctgaggagagcccaaaatccaccgtcagcactagcaaccccaaagactgagctggggggaacaaggcccgaatccctccacacccactctccacgctctcccctctccaaacatcagcacctgagccaggagggctggcagcaccttggagacgaagcttccccagaaccctcttcctagagaggaagagcagcctttctctaacagcaccttccctcccagccatgcttaccatgctgtggcccacttgcccacgatgaccacggtgtgaccctagtcctggaatgtccggcacaataggggtggcaggaggagcactctgcctctgtcagcggctgattggttacaagatgccctacaaacacactgtcagcagagtcagctgtttccagcgttgcccctccttggctttacaatcacacaccagcatgcagccaagggttgtcatggctttgtctcccttatgcatgcttaattgacaattaagttggggctttgaaccagcctggctgccgctgctgggccttcatctttccagggagtgtcacaggggcaccctttgtttgctcttcttgggggcctgaagttactgtagcaggctgcaggcagccatttatcttcagcctggaaggcctttatccgcccccaccccctattccagctcttggccagcaggagctgtccctggttataggctccatgacagcccattctgaagccattgagcaggtctggagtgatggcctctacctcccttctggagatgaatcaagagaaaggcccctaaaaggtcagagggcagggcggcagcaaggagaaggactggttggagcctggtgcttgtattgattggctcgaggaggaggaggaggaagttggcgcgggatggaaacttggctagccttggcccaagctgtggtatctgctgtgtgatctgtggcgaccttgctccctgtaccctttgctctagtcggcagcaagctcacctggccactaccttgaggaggagaggaggggtaaaaggtcttcatcagcctccgctctcccacgcatgatgtcctcactcttgtgtcacctttgagagggaaggggggacttattctcctggaaagaaagtgaggcacaaagaaaaagagaagaggccctgccaggaggactttcaggggtcccgaaccatagccccttcaccaaagaggagacatttatttctgtggctgctgctcctccctttcgctgaactctattcctccctctccaagcccagtggacttgacttccctgatgtggcttagagcttgaaaaacagagaatcctgcctcctgcctctcgctcatcccccttcacagcccctcccaggttacctgagg

SEQ ID NO: 15463 - DNA, 20468 bp, Human; identical to SEQ ID NO: 15462

SEQ ID NO: 15464 - DNA, 62636 bp, Human
aacattttcatgaagttatgactccctgtggcaccctgaggagtaatgggtgtctggaggctgaaggatggagaggttcctgaatttgggatttgcttgtctccgggaaagagggactgagatcagtgtaaactttcctcaggctacacgcacacaaccatcccgcttccttctggctctcagcacaagtggcccaggcacctgtagcagaccctgtatttaagaggcatcctagctccttaacagcctgacttgataaattacaccatcagcccttgcacacctaggagattagatcctgcccctaggcagatgagagctgctagactcttcctcctcctgctgaaattcctctctatccctaacctaaccttacttcctcctagatatctttcaagggtgggagaggaaggaaaatgtgcttagaaactcctttgcaatttttctgctgattctgaaaccctagtcccccaatccctccaaccccagcactgtatcaccaattctgaataccctaagtttccagagtaactcagttttactactgggaactggcttcccgtcttctcagaccagaaagtgttgaactttattattagaccaagcggttgcacaagtggcctcagtcaatatacacaacccccaaaaaaaggttatcagtggtatcctctttttgcagatgaggaaactgaggctcccagaagggaagcgttatgctcctccccagaagctttaggtctgtgtgtggtggaagcaaagaagcccctttccctgttcttctacaggtcaggtcctagcttgccggtttgggcgcgcttccgccgccctcccctcctgcccgtcaccaggggggaagcaggtgaaactccaatagtgctgcaaggcctatggcttcctacctggcccaggccagagtgggaaaaaaaacatctttccctcagtagctctgtcgacaccttctgtactaggagtgcaagacttctgccactgctgcagtgacctcgtctacagagctcgtccccggcccagggaaccacagatgttctggaactacgaataaaccagaaatgagtgggccggggggaccctcggctgcaagtgtccacccagctgcaggtcaagctttgctttcactgcctcaccatcctagtgcctcaccatcctcccccaagcggaggcgccttgacatccgggtttaaacaggagagtgaggagccccaggggtccagctccccagtggcgtggccaggctgggcgccggtgcagcccagctgctgggggagcttcactttggctactccctctacccataaagtagtctctttccaagagttctcccggactccttcaccctcgcctacgctctctggcgggcagttctgcaaacccaaaccgccagaccaggccagggaggttctggggcctggaggtagtaaccgaggtagaaataaatggagtccctccagggcatgctcaccacacctaacgctgcctcacctcccccgtggcctcggcgccccttcctaagtggtcagtttctcttccgccctgcgggctctcctggcccaccacctgcgtcggccgggacgcatccagggtctctactcttcgcttcctcctgcgtccccttcttccacgagcaccccagcttcctctggctctcacctgaaccccgaagcgtagtgtcttctctctggactaaagcggaactgagaaccggtggaaaagccccgcgcctaggctgcaaggcactggcttaacaagtccaaaggttaggtgaagtttggctgataagcagaaccagtaaaagaaggtctctagccccccagcgtgagtacaatggaccctggcaaagccccgctcccggcccaggtcttctgctctccaggtctgcccctccggctctccctctctccgggtttccccctccccaccatcatttgcatccagccgaaagctgggcccttcccactaatttgcatatcttatatggcctaatggtggcgatcatggcaagttagaagttttctgactcctttcggaggagcctccgggaccccggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcaggtaggcgcagagcgaggtggaggggacccacccgaacccctggagccccggccccgggcctgagtgacactgcgcccgaccacactcgccaagcccgtttcccaccagagaagtcccccggggggcgctctgcttctctcccaacacccggacccttcccaatcccttagcgggacgaccctgcggcccaccgggcttcttctccccaggcccaggccagcgtccgagacccaagggcttttccccgcggggctggggctgggccggggagaactggagctgtggagccctttgccgggaggtttgcccacgcgactgaaggtgcgagtgggtgcagtgaaaccgctgcgacttcccgggagcagagcctcgcgccgctgcaagccccaggccgcgcatttttcctgcgcgctgcctcgggtctggaaagccgcatgtcggcctcggacacattgacctgcatgatgacctgcagttctttgccgaaggacaggcggcatccggagccgggatctgggaggcgagttccctggtgggcactcttgttagccgcgcccatgcaaggcccggaattatccgggatccccaacgcgggtttagatttgcaaagggcatgttccatgcagggtccgggtggacacgcgcggggccaaagaaaccaagcgcggtggtgtgggggcgaacgcgtctcagacctcagttcgcagaggatctggtctcagtctgagaaaggagggcgtttccagacctcgctgcccacccccggcctctccccgggagttcaggccggctggcagtgtatccccagggccgggatcgtttgtgggtcctccccgaccgccctagactttgacagctggttactaattatctaaggagccgagcggttccctgagacagcacgtcgctcccgggccactccgctttaggacagagcccatcgcgtggcttcggacactgaagcgccgcgatttcggggctgagccttggccgcacgtccgcagcggcggtttggggtgggatatgaccttgcatttgaatttgtgctccgagggcctggcggtttgccctctagccaaaacaatcaggggaacttgtagattttttttccccaaacacactttggtataattcataggtttgaggttcttccctcgtcgctctcccgcccggaggtgatttctcccctaccgggagagaactcctgcaagagagttccgcgaggcggaaggtgtgagtcgcggaggctaagaggggtcgagagagtggcccctaggagcggctggggcgccagggctgccggggaggtcgctcaggacctggcggatgaaccaggctcccaccgccggccaccgggggccacagggcctaggccctcccactcggccgcaggcgcccgctttctagcgcggcgctggaaggacctggggcgcccctccgcacccagccccgcgccgggctggccgcagctgagacgtaacataaactgcagcacgtggagttggggtgttattaatttatttctataaatcatcaacagaaagatacacaaagagccgtgattaggttgaaaagagaggcgggttattcattggtgaagttgtaaacgcggcttagaggggggaaggagatcaaaacgcgggcgcggggctgctcgccgctcccagcgcgcacccagccaggcgccccgtgcggccctgcggcctcaccgctctggcgcgggacgcgggctctgtgagcgcccgagccgcccgcggagcccccgggtcgccgacacccgcaggcccggccggcggagagccaggcccggcccagggtccttagaccccagccccgctcttccctccccaaagccccaggccccagcagggcagggagagggactggggagccggagaccctcgccgagttggagacgcgggacagacctggaggcttttttctcccgtcccgagcgggtgctgcctttcctcccccgctcccgggagcgccggacttgattaaagtaatttttcaagaaatcgctagcggttcctaggtcactgcacagggggctcccaagcctcgggcacacgcactcccttcttttgcccaccgtgttcccttaagacgaaaagcaaagagaaagaaaagtcgcgttttggagttcctggagttctagtaaacctcctggaagagaaaggcaggggaggaaggtcgggactgcgcgcttcccggtccccggctcccggccggagctggcctttctcgcggcctcgaggcaggtgcgccgggggcgtctagaaagtgggctgcattctaagaagccgaagttgggctccttaacgaacgcgctgcggactgcgctggagtccaggcttctctgctcgtgggcagcaaagtcattgtttgagaaggagcgtgcgggacggaccctgcgggcgccgcggccggcgtttgacacctgcgcttgggacacaatggccgcaggccctcttcgggaccggtgcctttctcggtgttagggaacctctgaacctgagctgtgttttcaaacaaacaaacaaaaataaccagctctcccggctcttcccggtgaacacacgtgaattttggggtcagagggttgtgaaggtataactgcgccatcttactcctcactcttttaagtcggacttaaaaggttttgccattatttataaggttcttgggggctttttttaaaccctccccaattgttgggctaattcactgtttccacagaatcattcccacttagaacagtaccctatttttctaggtttcttaggcatacaaaatgaacacaggtaaaggcatttaaacaaaagaaaaatagccgaagaatttgctaaagcaatattcacttttaaaatgcaatttttcccctaaggttcgaggcgtcttgttcgtagccgttgaaagtatttttccatcctaaaaatatctgtggaaatattgaccagaaataaacttttaaatgatctgtgatgtttacaaggatatgtctaaaacgtttattacattattttcctcttaatgtgaattctccacgtttgaaactgtaactcgttttctcattttttgttcttcttgttacttcctcatattgtgtacttggaaattacctttgtaaatacttgagaaattcgttcttatatataattaatataaaaagtttgcatttctcaaaaacatctctatcaaagcctgtgttctcacgagtttaatatcaaagtcttaataaaataatcacaactacccaaatgcttataaaatatgttcgattactggatttttattcattaaacagaattaattttatttgacatatttaaaggcgccatttagaaataaaattgcttattatgttgcaatactgtatctatttcagcctctacaccgttttcttttttgtttcacctgaaactagttttcccttccgttttttttcttgttctatcaagctaatatatatatcaacatacagtaatggggtgctggtttttgtaagttaaatatgtacctgcattaaataaatagtaaacatgtatatattgcttctttagtacttttgttctgtgctgcacactattttaatttctagttttaaattatatctctcttttcaaagcatctgttcaataagcaagaaaagatattggcaaagttgaaaccattctagacaaataaaattcaaaggtgctaaaactagcagtttacacacctgtgtttatgagaaatgaaaagtataaccatgttcttattcagtatttaaaatttatgagaaacataatacaggaaaacaagcatctaaaattgttaatgtccgaaattgaagttatttgtccccattagcccagtagattttgtctggaaggtggagctgtggattttttttttttttaactacttgcctcacctcagtggtgtgatcctcccgtcccaaggagatacaacattgtattttggaaaacttttctaaaactctgaaaattatttactatttggctaagacatcctccttgcttcttagaaggtgaacacatacatttcacccctgttttataagaaatggagatacccattcaaaaggaaaataatgtaggagaggttgaagctaaaattgggcaaattcagaaactgatgctatccctacttcattgtaggatcagggagtccagccccaagctaaaggcatccccactttccagtgggcctcctgccttttaaatctcccacattgcaggaaaatggaggaaagcaaaataaaatggccaggcgcggtggctcacgtctgtaatcccagcactttgggaggccgaggcagatggatcacctaaggtcaggagtgtgagcccagcctggccaacatggtgaaaccccatctctactaaaaataaaaaatttagctgggtgtggtgctgggcatctataatcccagttactctggaggctgaggcaggagaatcgcttgaacccaggatcctggtggaggttgcagtgagccaagatgccgttgcactccagcctgggtgacaagagcaaaactccacatcaaaaaaaataataataaataaattaattaattaattaaataaaacaagagcttttctttttgcttaataagagagagtggtggtggtgcttttttattcctgaagatgggaagtcctcttttgcccactaacctcagaagaaagggatgaggtgtaccgtacaggggcagtcaccttctcctctgtttagcttccattttggcctcatgtctaccccaaagttgtagcttagatggggggaaaattcagaattttgcatagaccataggtagcaccccctagaaaaagaatgtttctccccagatgtctcccactagtaccctaaccatctgcttgtctgtctagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacgtaagtgttttcatcctgcctctgcctcaacctgaagtgacctttgccctctcaccccattggctgcctcagtttccctttcatcgacaaggccttgtgagcacttggcagatatgaggaaggtggcaagtagatttggccttggtggttgctgtacaatggattggcttctgtcatgttcttcagtcacagcccccttgctacccagccagttgctctgaggagcctgtcagtgtatgcagcataccttaaactttttggcccctccttccacctccttctctttgaaaccaagtaggtgacagagtgaaatgtcttccctgagagaaaacccagcatctccccttgatacgtgaccatcagtcaatttccaaagaagacatttcgttgcagtcaataatattgattactattactgttaatttcctcctctctggaaaaagtatcaacaatagaatgcatttgtatagagagatatattcagaacttcaccctgttcttggaggatagtgggagggattgaatcctgaggcaatttaaggtgtttacccacatttaccaacactggtagagtgtggggacctcagctggtggccctgctcatgaagaagctatttctggctaaggcagggcacaggaaaagcatctgcatttggaactctgacccatcaattcttgtcatccccattcccatcccaaagttttttttctgtcccaagatttctcccacccaataattctaaaaggtttttgttttgaagtacgtctagagaagtttgaactgcctatgaataacaagagtaggaatgacatactgtctgtattttaggaaagtattctttgacattacactttcattactttgatccaatccttttcctggaaaatttgtatcggttttcactctccccacacactatcctctggctttatctaggcttctctgtctttatcaagatgttaatttccaccactatctgggtttctgggttgggttttttccctgttgctttttaaaatgactcttgtcttctgttacacactgctctgaagtgattgtttcagtatttattgtctcaatgtccctgggctggtgaaaggaatggttttaggtgttcatttcatattgtggtgtttgtgcttttgttgggagcattacatgaatagattggaagaagcaacatgagagctgtttgctgcttagagcgagagacctttccaagaatgggttggccccccatacttggtgactagctctttaagaatttgtgttcctgacatgaagcaactctctgtagttcctggaaagcctaaaaaaattctcaggagccattgtctccaaagacccaacaacgcttgggccctgcccaatttaagctttatgcagcatctccagtctgtgctgcctctctgtattcaatgagaatttcttcagaaaggagaaggaggcaggaaaggcagactggaaacttctcaaaagacagaggtccagaaagtttctcaagatgctgaggaagggacgttttacaaatacaacagcctcttcaagagattgttgttattgttatttttgttttatttatttatttatttatttaactttttgagacggggtctcgctctgccacccagactggagtgcagtggcgcgatctcggctcactgcaagctccgcctcccgggttcacgccattctcctgcttcagcctcccaagtagctgggactgcaggtgcccgccaccacacctggctaattttttttttttttggtatttttagtagagacggggtttcactatgttggccaggctggtcttgatctcctgacctcgtgatccgccgcctcagcctcccaaagtgctgggattacaggggtgagccaccgcacccagttgttatttttgttttaaagtcacacgagacataaaagcttaagaaacattccttccttctgtaactattatacaggcacctactatgtgccaaacactacgctaagctatggaatacataggttcttttctccagggacttacctgccatccagtgaagaagtggagatgtttgagtaaataatgacattcactttctaagagctgttataaagatatacacaaggggcagcagaggaattgctaaattgcctggagacatcatgggaggcttcctagaagaggtgacattcaaatcatgtcttgaaggatgaatgtaagacatgcaagcatgatataagaattaggaagtaagagaaataaaagagggacacaagtgaatggggtgaggagaaggaggaagaggggagagaataaaaaatgatacatgattacaaatttcctggaaaaactaaaaataacaaatggtaatattcatgggcccctctacacacacagaacctccttgtccaagcagcccccaagcctataaagaggctactgaagccaacttctccaagataattttcatgggcaatgaacattttcttccccaaccccaattaatctgaagggaagtagagaagagttgttggtggctagagggagcaaatgtgggagtctagttcttcaaaaattgggagaggctagagccaagcccctgatgtcagtggaacccgaatggttctgagcacctacaggcaaacccacctggctgatttgaggacacactgagttctgaacactgttcagcctgctacctcctcaaagggcaggtgagagactgaggcagccctcacactggggagcagctgcgagagtgtctcacacccaccagacacaaagcttcaggaatcggttttgtcacctccacacaagtcagatatgaagcgtttgcggggtacgtggcttgggttttgtttttagtgagaggtgatgcacaggctggtagttaggagcctgcaagcctgcaggctgggctcgtgtccaggctcctgccccaagtccacatgactttggacaagtcacttcaccagtctgaacctcagtttcttcatctgtaaaatggaggtggctatacttctcacatggagcggtcgtaagaattagatgaaggaatatatttagaggatttggcacaatacctcaccacagaaaaggttcaataaatgtgaaccgttattgtgtctgttcacatcaaatgaaaaaatctcacattgctcccaggcccttgggatgatccacactggctttcgccattggtgactctactggtgccacacagggcccacggggaggagggaagacactgtgacagacctcactgagcaggggacatctccttctcccccttggatttcccctcaagtaactgcatttagagagctgctgtgaagtcaaataccatagaggggctaaagcactttgaaaagtataatcaggtggggcatggtggctcacgcctgtaaccccaatgctttgggaggctgaggtggcgggaagactgcttgaggccaggagtctgagaccagcttgggcaacatagcgagaccccgtctctacaaaaataattttttttaattagtcagatgtggtggcctgcacatccgtagtcccagctacttgggaggctaaggcgagaggatggcttgagcccaggaggtcaaggctgcagtgagctatgatcgtactactgcattccagcctgggtcacagagcaagaccttgtttgaaaaaaagaaaaagtataacccccaaaggaatttgggccaacatcactatcatcctgactaggggtagatattctaaaagactagttagtgtccctaagctttcagtcagtctcattccacagctggggagactaaatgatgagggaattaagctggggccccacatgatcccactagcagtgacttcctgctagtacatttgacagggactctctcaggtctatagtggcattgttgggcaccactgaaaacagagccctaaggtggcctaagaatcctccaaggtgaatgggccgaaatcaaaggccccagtgacaccatcagtccacagttaaacaaagcccaacaccacctgcagttgggattgcaagtcttggcgggctaggggccctaaccattcctcccgatggagcaaaatggaaatgagcctaagacaggtggtaagttccctgctgctggaggcatatagcctggagggccacttggtgtggggttgtagaggggattcaaacgttaagtagtagcctgacttgaaccttgaggattttggatccagttgtccaaaggaacaggaaggatggcatgtaaatgatggcacatcatttacatcacaaagggaggtggtagccttccactttctgtgacctgtgggagtaattacaggaactgagaaagaaagtcatcaaggtcgggcacggtggctcacacctgtaatccctgcactttgggaggctgaggcaggtggatcacctgaggtcgggagtttgagaccagcctgcccaacatgatgaaaccccatctctactaaaaatacaaaaaattagctgggcatggtgccgcacacctataatcccagctactcaggaggctgaggcaggagaattgtttgaacccgggaggcggagattgtagtgagccgagatcacaccactgtactccagcctgggcaacaagaggcaaactctgtctcaaaaaaaaaaaaaaaaagatattaagatccagaacatagggacccagagctaggagatgaatgtattacgtgtctttgctcagcagagtgcttagcctccatgtttattcatctttaaaatggaattaatcactcctgatgagccctgcttcatgcagatgtgaagacgaggacagcaaagctttcttcttcggtaatgtagatatcaaatctcattaaaccatgtgggctaaggcatcacctctgggccgagctgctggttctcattcattccacaaaaatctcctgatggtcacagtatgcctggactcaaggaattggacagacagggagcatcatttccagctaattaaacactactcccagacaggtcctgtgtttgtagtctttgaaattattttgagatctaaagcacattttctttttccaatacaaagctccagttatatttatttcaaagcatgttccaaaaggtttggggtttttctaaaaacctgactttataatgtagatacctaggatataggaagagggaggagaggtggggagtgctatctacagcctctgaatattttgtgcaagtgtaaattgtacctttgagcagttctcccctggatgtgagacttgattgagctcacccacttgacatcaaatacaggagttcaggatgcagagtgttgcttcatctctgaaggccagtgagccaaaggggaaaaaataataattttcttaaaactatagctggctatgtttgagctccttcaaagaaaggaaaagggtggctttgctggagcaactgaggtgggcagtaagggcctgtgctgagggctccccatctccagctccacatgcagtgagagaaggttgcaaagcttagttagacgaggggaataaaggtgtcttcgtccgttgtctgtctgtctgtctgtctgctgagtgaaggctacagaccctatcaaatctactcctttctcttttcagaattcaaccagacagtccagagttctggaaatatgacagacaaaagcagtcaggatcagctgctgtttctctttccagagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacaggtaacaccaccagaagctcacctgggcaggtgggcaagtacacagacccaggaaccctcccctcggtcctgggatattgagacactagttatacagataagtgtggctaaatcagagcttctcaaagtatgttccacagaaccccaatatcaattcattaatcagtaagtctgagaatcagcatatggatacttccccttagagagtcacaacatatattaaaggttccgagaagccctgcagtcaagaaacccacttagctttgttgaattggttgttaactatggaatcttcggtagagtacaaacaaccccatgaattattcttccagggaagatactctggagaatgctaatttaaaatatgatacttgggaagcgaaattgtgtgtttgacctccctgcaggccagggtaaaactttcccttagccacagactctagatctggcctctaccaattgtcagacatgcagtggtccaaaaggaaacttggcaggagagtaagaattggtcagatctgttcagtctactctgcccccgctgactcaacagagttctttttacttgttaactaccagccaggcacggtggctcacacttataatcccagcactttgggaggccgaggcgggaggattgcttgagcccaggagtttgagaccagcctgggcaacatggtgaaaccctatctctatttaaaaaaaaaaacaaaaaaacaaaaaaacaactctgtgttattttaagtatttatttttaaaatgtggtcttgctatgttgcccagcagatcttgaactgggcttaagcgatcctcctgccttggcctcctaaatagctgggattacaggctctagccacagggcccagctattttttttttaaacgattggaaagccttgggaaatctttttacttcattcctgccctgttctccctgactccagtattgactttctaaaacttcagctctttggtctggccaaggcctgtgtgcgctttctctgtctctgggctgggctggccttggctgtgggaagaatgcagccagggaggtcaggctgggaagcagggaggcctgtattgccactgagtcctcaggctgtgctccataccccgactaatgagatgccttgcagcacccagtagtgtctaagaatctctcgcacctggttttgaggtttcaccagccctgataaagctagagactggccatctcaatgcaccctgctttgtaccccacccagcctgccttttggaggggataaagcatcttgcttcctggcactctttcagggagttcaagccccaaaagaccagaaatcctctcgaagtgctttgaagccactcaagacagagccagcgaagggctttgccttttatgtggtgggaagaatggctaaataaggaagccccatctggaccttcccctggactgcctgtccccggcttgctctcttctcctcgagagccacaccagagcctaagcccctgactcccagggcggcatagcctgctctgtccctgcgttcaggcccacttcagccatcttcatcagatcactccatggattggccttttctctgcataggcctctcctccccagccttccattctgcccacggccccttcatactcccaaccaagactgctgtgattgtgtgtttttggccaagcaccaacaagtccccccgccccccctcactcaccatctcccctccatccattcccagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggtaagcaaaggttgggcctcactgcctcggcaacccaaccatcctggttcttgccacggatcttatctggtttaagggttttcagaggagcaaacgcttttgagatgatcctagggccgctctctcattgccagaatatactcccctggaaataatgtgtggctctgatcagtttcctccaactcctggttcagccattgccctgtgagggctcactcggcttccagggagccctttaccctatttgtctccttccctcttcttctccctgtgtggctgctgactcagcggtcattctacactgaggaggctgccttatgggtgggccagatccaaaccgcaggcaaacgggtcgtgatggcgtggcaaccctcactgtgttggaggatggcactccggccacctcctccatctctggccatatcctgcccctcgctcggtccggctgcctcaggagaagctcagtagcctttggggacggccactctgttggtggcctctgcttgttggcttccgtgtgtcatcagggttggtgggggtcagtcacttgaaatctttgcagcaatgagttgggaaaaactgaccgagtacctgctccatcatgcttgattgagtgctcctgtgtgctgggccctggcctggattagaatgcctctgctgtgggctttgggtttgtcaggatggaatcctacagcctccttgggggaaagcacacctcatgctgagcgctgtgttaggcacaggctgggatggagcacttcttctggtccttcattcttctggcaaagctggcttcctagaatggatgtgctcactggggtctgtgtggtgcccatgaggacaaagtgtagcagcctcctgcctgctccaagaaaagggcttgcgaaaggaaagccaaacactgtttctaactcaggggtgattctgaaacctgttggctcccctcacctgtcggttgcccttctgatgagaaaggcctgagggctgggggctgacccaagtgttgaggggaccaaagccaccaagacaggctcggagccatcagctgggtggtgtacaagcatttgttccatgcctgctgtgccctcccatagcactgcctcttccagggcctctgggagcctgacagtgcccagcatgaaggtggggccagtgctgggggtttctgtaggtcccactcccacagaggagagaggctcagccacacaggaagaaagtcttggttacttaagaggcagagaagcccctaggcaaagactggcctgattgcagagtaacttcgcccctttagggaaattcaaagcagggttctgagggttgtggcaaatggcacatggctggcactgagcagtaccagtgtgcttgcccaccacagcgatccacggagctgaagctgggagctacagggggcgtggttggggcaaggggcattactgggaagacaatggccattgtgttgggacctgtgatctccacaccaaagtcagggagcctggaagccaaacaaaggcccagcagccttctgacaagcaagggctgtgctgaggtcaccacggggtcgttggtttaggcatcctgtgtgctgacaggagacccagagagctagggctggagggacagggagcagggcagaaaacacagcctgtgtactcctctgactggagtctaggaagggcgtgtcccatgggaagtggatactctggggtgcccctgaagtctggatctttctaaaaatcttgtaatgttagaatttggagggaatttgaagaaaggaactgaggcccagaaagaggcagtgatttgccaaagtgacacagagcaatggtagcaaaacaaggactagagctcaggcctgctggttcccactccatactttcccacagcactacgatgtgttgaatgcttaccaagtcctgggaatatgctagtgatgtacgagctgcgcgtcctgccctctgggaggttactgtctggtaggaaggatatcgggtcactgtcgagtccccagaaccagctgcagatggaggttttgtttgggggctttgtggatctttctgcggtgtaatagatcctattactgtttctggagcaacagttatgggacactgaatattatcagtggctgcctttcttctgtcttttttttttttttttttttttgagagacagggtctacctctgtcacccgagctagagtgcagtggtgcagtcttggctcactacagcctcgaactcctggtctcaagcagtcctcctgtcttagcctcccaaagtgctgggattacagttgtgagattgtgcccagcccttctgctttaattttcactctgggctcctcaacatggtccttgtcccaagcccagggactggcttctctttctctgagtgtagttatgtatctgggttctaaccagtaaggttataactgtggctaattcacataacttctctgagtctgaatttcctgcctacaaaatggagaaataggaccttccacacagggtgcatgtgaggatgaaaggagtgaatgtataaagacacctttcccgataacccatactaccctcattatgactcttaacattagagagggctaaacaagggcagtgagaagactggcaggcagcagaaatcattttctttttgatctcacacaccagggcattccccctaagaggcagtgagatgtagcctggccctggaactagaaacagaggtggctgctgtgctagtgcctgagatgcacgatgctggggtcaaagacttgtgtccccacctcaggctgccaggatggcgtgtgtgccgtgacagggctcccgagtcatgcactcaggcagacagcaggctggagcccagcattcaggggtggcttctgtctgtagagccgcatggcactcttcccacctcagtgcccacagccaaggtagggtcactaaccaagccagaaacgtaactgtgtgcagaataccgaaaaaaaaaaaaaaaaaaaggccgggtgcggtggctcacgcctgtaatcccagcactttgggaggccgaggcgggcggatcacgaggtcaggagatcgaggccatcctggctaacacagtgaaaccccgtctgtactaaaaatacaaaaaattagccgggtgtggtggcgggtgcctgtagtcccagctacttgggaggctgaggcaggagaatggcgtgaacccaggaggcggagcttgcagggagcagagatcacgccactgcactctagcctgggtgacagagcgagactccgtctcaaaaaaaaaaaaaacgctctgtgggctaggtgtggtggctcacacctgaaatcccagaactttggaaggccaaggcaggcagatcacttgaggtcaggagtttgagaccagcctgaccaacatggtgaaaccccatctctactaaaaacacaaaaatcagctgggcgtggtggcaggtgcctgtaatcccagcgactccggaggctgaggcaggagaatcgcttgaacccgggaggcgggaagtggaggttgcagtgagccgagatgggccactccactccactccaacctgagcaacagagcaagactctgtcttaaaaaaaaaacaacaaaaaaaactccatgttgctgaggagagcccaaaatccaccgtcagcactagcaaccccaaagactgagctggggggaacaaggcccgaatccctccacacccactctccacgctctcccctctccaaacatcagcacctgagccaggagggctggcagcaccttggagacgaagcttccccagaaccctcttcctagagaggaagagcagcctttctctaacagcaccttccctcccagccatgcttaccatgctgtggcccacttgcccacgatgaccacggtgtgaccctagtcctggaatgtccggcacaataggggtggcaggaggagcactctgcctctgtcagcggctgattggttacaagatgccctacaaacacactgtcagcagagtcagctgtttccagcgttgcccctccttggctttacaatcacacaccagcatgcagccaagggttgtcatggctttgtctcccttatgcatgcttaattgacaattaagttggggctttgaaccagcctggctgccgctgctgggccttcatctttccagggagtgtcacaggggcaccctttgtttgctcttcttgggggcctgaagttactgtagcaggctgcaggcagccatttatcttcagcctggaaggcctttatccgcccccaccccctattccagctcttggccagcaggagctgtccctggttataggctccatgacagcccattctgaagccattgagcaggtctggagtgatggcctctacctcccttctggagatgaatcaagagaaaggcccctaaaaggtcagagggcagggcggcagcaaggagaaggactggttggagcctggtgcttgtattgattggctcgaggaggaggaggaggaagttggcgcgggatggaaacttggctagccttggcccaagctgtggtatctgctgtgtgatctgtggcgaccttgctccctgtaccctttgctctagtcggcagcaagctcacctggccactaccttgaggaggagaggaggggtaaaaggtcttcatcagcctccgctctcccacgcatgatgtcctcactcttgtgtcacctttgagagggaaggggggacttattctcctggaaagaaagtgaggcacaaagaaaaagagaagaggccctgccaggaggactttcaggggtcccgaaccatagccccttcaccaaagaggagacatttatttctgtggctgctgctcctccctttcgctgaactctattcctccctctccaagcccagtggacttgacttccctgatgtggcttagagcttgaaaaacagagaatcctgcctcctgcctctcgctcatcccccttcacagcccctcccaggttacctgagggaatctaaccctgggtctcagaccagccaaactctgggccagggtacctatgtgaatgctgttgttttccctggcactgaattctgcaggacacgaggaaatctccaaagtgtccagtggcaaggtagtgactcaacgagaggaattctaatggccagtgttgatggagcacttccttggtcccaggccctgggccgagttcctccatgcatcatcttatgtgacccacacaacagccctgcagagtaggagccatctctagtgtcatcttcattttacaatcaagagaagtgaactatttagaatggaaggcatgtgcccaagttcatattcttagtaagtggtggggagaggttttgagctgttgcacactgtccatctctttttgctttatgcagatgctaagaacttttcaggcactaaacccaacacagagagagagagagagaaagacacacacacacacacacacacacagcccccagcagttccttttcccacattcctactgttcccctctaaatgacactgaggctttgggagatcatggccaaagaggtggggtaagggtgagagtctcccattctgggtagtttactacttcctccccaaccactgcccctgaccaaggtggattctgtgccctgcccaggcaagaaatcaaagccccctctttcatgaccccatccccatttgtgtggggatttgaactgcccttgcagtcggcactgtctggactactaaatgccttaacaacttaatggggcttctgagacagtgcaagcacctcagctcacctctgggagctccgccccctccctgggcagcagacagcgggaggggtttatgagggtagttgtaaaaatattcatctcagcagcaaagttcctcacggtaaataaggcccattgtccttaagtagcagattatttcagttcagaagagagacaaatcctgccttgaaatgtctgctattctaggaaacacattcatactgacttgaggtttagtggcggacatgggtggctccagcattctccttcttagggactttatctgagtgccattttatctcttgaatttgaaggtcattttatcttgtgggtaccaccccatcagctgccactgggttggggaagacaatcaggatattaatgagattaagaggcctagccttcagggtgttctgctgtcagcctccctctgataggggaccagccctggtctgcatacaaagaaaccaggctgctgtgctcgtggggctccaagcctctgcacaaaggggccaggagatactggagtcctatcaccaaagggtcatgcctaatccgcctgaaggatccttagacgattcaaggactccttgccgcctccagtgagctctgaggaggaaggaagctgcctgcaagcacacagccctggcctgcagcttatgggagaagtgctcttggaaactgttgaaggtttgatgagaagcgacaggaacttggagagaattaggtattacaggtgcagagagaggcagagatctgtgcaagggcctttgaagctacctgcttaatggaatggaacaagatctggctttatgcctctacctattttttagggggaagtataaacacaaatgaagaggagagagagaaatatacatacatatatatgtattatatatatatacacacacacacacacacacacacacacacgcatacatatagaagttatatatataaaaggaatgcagcccacaaataaagtcagatcaattagtcagtcatggttattatcctagctattcataaattctctagaacagggattgacaaactttttctgtaaagagccagatagtaactattaagtactttaaactattcagttgtaattactcaactgtgcctttgtagcaccaaagcagccatagaccatagacatggaagtgaatgaacatcactgtcttccagtcaaactttattttatggggactgaaatttaaatttcatataattttcacatatcatcctatagtctttaattgattttttctcaactgtttaaaaatgtaaaacccattcttagcttgtgggtcatacaaaaacaggctgctttggccaacagaccagtttgctgaccccgctgtaggacaatagttctcaaatgtggccacactttagaatcacccgagggagtatttaaaaatcccagtatccaagctgcaccctggacctgtcagaacagctggggagtgggactacatatcagtagttaaaactttctaagtgataccaatgtgtagctaaatttgagaaccagttctaaggttctcaaatttagcttctcaaatgttaaagtgcatgccaattccctggggtggggggtgttaggatacagattctcattctataggcctggggtgaggcctgggtttctgcattttcaacaagttcccaggtgctgttgaagaggatggtctgggacacacttttgagtactggagttggattagcaactaactcccctttgcctcccaacctgtgtaatttgcctcaccatcaccagccttgacatctaatatggggaaatgctcttttaaatccagccggcacagtgacaaaattacaggctatggaggcagacccaaattccaaccttcactttggcacttactgctgtgtgaccttgggcaagtctctggaatctctgtgcttgcctcttgaggtgtggagacatccactcatgcagatgctggaagaattaaataagataatatatatgtaaaacactccagacataccagattctcataaatagtagctgttaccattccttgcagagacttgggggttgtttctttgtttttttgtttttttagttttttccctctttccttgtccttcttggaggtttcattcaaccttgatttttaaagaatttgagtatctccaactagatattcatcttggtgtttgcagcaaacttaggctggcttgttgcagcacattgggtatgaggcaatctcctgctcttcctaggacttctctgtgacatccacaaggcatattgagtgccgtaaggcatttagtacaaattcaggaaacagtgaggggaagctgggaagaccatggattggtgggggcagaggggagggtcatgaccatgtagcaggaggtcaggttcatgatgttcatgaagtcgagatgaccatgaatttcctgtaactaacagggcatttttcttttttctttttcttttaatttttttttttgagacagagtctcgctatctcccaggctggagtgcggtggcgcgatctcggctcactgcaagctccgcctcccgggttcacgccattctccggcctcagcctcccgagtagctgggactacaggcgtccaccaccacgcccggctaattttttgtatttttttttttttagtagagacggggtttcaccgtgttagccaggatggtctccatctcctgacctcgtgatctgcccgcctcggcctcccaaagtgctgggattacagccgtgagccaccgcgcccggccatttttcttttttaattaaaggaggtgtgagtactcctctcatgtgtattgcttgttagtaattagccctgggaacctgccaggtagaggggtgtgggatgttcctggtggaggctgcatctgggaagcttaatggcccccaaacttcaggcgaaggagcatttaagaaggagaaggtgcacacagccccacggtgagcaaagggaaacctcagagctcctaagggctgattttctggaaaccacttccctcaacctgtgagcatgcgtctgcttcaggtaccttcctgttaccctatgctccaacttcagcagcctccgcaatagcacacttgcgtgagttcagccactgaggaatcaactggcaaggggggactcgatgcttccaatgcttttgggaagtcaagagtcagttttctcaggacttgtactctgcatgttcttcctaagttggagaaacaccttgcagatggtctttagcatgtagactttcccaagggaagcctacctgagccaaggtgagctggttatggccagtcccttctcaggaccggattcagatgcgtgtgtctgggtagccaagtatagcacccaaatcaggcttggcttgggttgtggttctgtcactatccggcagtgtgaccttaagttattagcttctctgtcccaatacctatccccttaggggtgcaatgaggcttaaatatgatcagacacacccagtgccaagcacagtgcctggcaaggaaggttagctgccattacagtattattgaattgactcagaaacttcagggtgttgagagaacggaagagcttgggttctccctgggttcttgacaagggtcttaccttgtagtttcaatcgggaaggatttccctttccatgaaccctgcttgtcatttgaaacatcagaaacaatgaactaagtattggcaagatctgtggttctcaaatctctctccagaccacataaaaatcatccagggagctcattaaaaatagacatggctccctccacccacgcacacctttggagtcagaattgagagatgaggggttcacaggcataagaactttcgacaaaagccctaagagattcacgtagagtcccagctacttgtgaggctaaggtagcagggtcacttgaacccaggagtttgaggctgaagtgagctatggcagttgggttgtagacaacaaggaacacaggctgcttatttttgtctccttctataaaacaccttgagataaattaagcactttgtgcccattggcgccactgcagtacagcccgggtgacagagtgagaccctgtctctaaaaaaaaaaaaaaaaagagagagagatttggatgcatagtcagggttgacattactaggccagatggagcaggagagttctgaaggggttgaaggtaatcctcatggccccttgctgaaatgggaaaagagaagcagccggggtgaggggccttggactaggattcaggagatcagagccaccaatgagcaagggtgaccttgggtgaatcatttaacttcctgggaattctggcaaatgagggtgtgggatgagggcctttccactctgacaggctattatttgaagactgtgtgtggcatccagtcttggggcccaggactccgcagcttggagtgcagagggaggcttgccattgtggtattttattgtgaaactcatcattgtctctctctccttctctccctcactccctcgctccttccccgtttcaggaactgtgtgctgttagaagccttccacctttattagggatcattagagctttacgacaccagcagattgggtggggccagtcacaataaacagatttataatgggtataaacgagacacctataactgctagaggttaacactttgagggcttctgaatagcagctggcatgcccatgccttctggccctgtccactgcagggtgcctcttcctgcttggcacccattggactgggttggcagtgaagtctatgtgagttcttgttcagcaagagtggaaaacccttaaacaacatctcctatttgtgtaacatcagtttgcacgatgggcacaaaagtgcttaatttatctcaaggtgttttatggatggagacagaaatgagcggccgttcttcttcattgtctacaaccctacagccaggggaactagagggtttgcatccctacctgtaaacttcaatctcaccgtgaagaagaaggtccctgaagtctctgaacaccttgctctgtatgtatgtattctgagtggcagaattgtgggctgtaccaacatctgagcctgaggtagctttcttcatcattgtgtctccagcccatagccctgtgcctggcacatggtagacactccatatatttgtgaaataaagatatctattatagaaggcttcctgtcaaagcatatgcagaaaccccctgttttataaatttggtattcagtttaagaattaaactgagcctaggattagttttgttttatatagcatatatgtgctatataattatatatatatgtatatataaaggcatattttctcttctctagaaacagtgtcacccagcttcaaccctattaacactgcttaagtgtacagttcacaaattaatgtcgacatttaatgttaccagaaagttttcaaagaacgtatcatgagtttctccctaatgttctactagtaaactagtctactcatttaatttagttctactagttactttaatgttctactactttcattcattttaaaatctcttaccaggatccctagggcaagaaaagagcaagaacgtctcctcttttgtttcctttgagcaaaatgaggtctagaaaagggactggactactgcaaatcaattatctggacagacagaaacaaaactgccctgctctgggcagccattaggtctctggtggtgctccctgagcacttggctggtgctcctatctcagtgcccaacacctggtgttgcttgggacgagcctccttgggcctgccggtgatcggcagctatctgtcatgatgatggtgatgatgatggtgataatgatactgatggagatgccctctgtgacagtgatgaagaggctgggatctggccaggcaaatccctatcacaaggcagctctgacacttgccagacctcaaaggatcttctccctgggtatcatctcccagtacggtctttgttatgaataggctgtggtggaaaacctctcttttctaaggcaattttattagcccttcagtcacaatacagatgtctgtttataggaccttacttttgtgtggacacccagtggctcagtctgctgatggctttatagcctttctccctttgcccagacccactgggagcatcaccattctccttgtccactaggcctagaggcctttgttgcagccatattatctctgcctgcaaaggcagctgctcagaaaataccagaccccgggagccagactgcagaagggcactctgtgtccccacagcctttaggcctaacgatgtccaccattaacccttcttagttttactctagtttctttggagaaaggggcatttaaaagttattcatgttgccacagtaaattcccattaattgactcttctccttatccccaaatcaacccagtagcccccaaactcggttcttcaaatgtgaaactgcccaagtctatcaatactgtttcttcaattttgattgtattttaatctctctctcctcttctcttactcctctttcttcctccttaaaaagaatgcttgcctctccttgcccatggaaaaacagggaggggaggccaaagcagaaggactacttgagcccaggagtttgagactaccctgggcaacatagacccccccatctcttcaaaataataataacaataataataataatattaataaattagccaggcatggtggcatgtgcctgtagtctcaactatttttgggggctgaggtgggaggattccttgagcccaggagttcaaggctgcagtgagctgtgattgcaccaccacagtccagcctgggtgacagagctagagcttgcctcaaaaaagaaaagaaaaactgggagatttagaggataaatggacatactccagtcacttcaccaccactcaactcaacagtctaaaggtgaaagtgatgtggagtcatcagtcagagtttaagcataggttattcattcatcatttactccttcaataaatgtttactgaatgcttagcatgactctgccaagaagaaaatggagaatacagacaaggtcctgccctcatggggcttacattacagtgagggatgcagccaaggaacaagtaaacaaacctgcaagatcatttcaagctattagtgggtcgtgatggggaggctctacatatctggagcccatttggggcttaggaggaagagggagaagggtcagctttggaataccacggacttgctgggagaccccctagcaaggagcggtgcaaacaaccttgtcctctccgaacctcagttttccactctgtcaaatgggtgcttgtgacacattgagaagcagatgggtgtaacatactctcagatgtgaggactgcccaagttatcaagtgccaggctggttccttttacctacagcagcaatcttcaggctgaagtattcattgcaaactgcctgatgtttgcctgcagaaactgccactctagtaaggatgaggcgtggtggcccaggtagaccttgtgggggaggacacacagagtttctgttggtcttctacctccccacatgtgcaattttttcaagtgcaccatgcatgttagcttctgttctcagccaaggtgcttttgatgaaagatttttttttcttttcttggttacatttgctttgattttttttttaaataagaaaaccagtttgtgggcttcccttaagtatcactcaacttttactccttgagtcaagaatgtttactgtccctgcaggcctgtctgtatttctcctcttatgaattgagctcctaactaagccatgttaggtagaaagggatccggaattgaaaccagcccagcatttaaattgctttcatcttgcatcagctttttcttccacatttgcagatttttaatcttctaaactctttgcaaacatgaatctgtatcctctcagaggaggaaatattaataagaactagcaaaagtccagtgctacaaacaaggaaactgaggcagcaatgctaactcattcaaaagctttcatttctggagttctcaatttcaagccagggaattgttcacattcttttcttccaaatgggcctctcagaagttcaccagacagaatcatttgtctctctgcctctgtccttaagaaaagtaaagtgtttagggagaaggtagagttatcaggacacagtactgggtccatcaagcctggcccagtctctccctgtcatctccccaacataatgatttggcttcatagaaaagatggctgtgtctactcataatttatgaacaatgaacatagttattaccttttggaagagctttctccttcgcatgctctctcctgcctgagtttaaattcccagtttctagacccaacagggctgggctgcactctgcatgaggttagaaacacaggggaagaatgtgtgtgacagagccccagccagttgagtaatgtttactctgttggtggctgggacgctcacttacgctggcagaggtccaccagccggaggaacattcctgcattatcagggatgggaggttggctctgaaatgtcaagggtgaaaggcatcccaccagattctgggtgcagctcatagacttcagtgaaaggaacccccaggtttcagtgccaaaagccacatcgtgggcaagctgagccccacattgcccaggaatccccacttccctcatttcttcttactaaaagaacaattctggtcctgttttctttgttgacattgctcttctgtttacccagcagaaccagtgcatctctgacattattttattcattcattattctggcttgtgaagaaggaatatctgtgtgcccctttcacagacaaaaatgccaaggctcaaaagttaactgacccagaatcatcagagagttatggcagagagagagagagagagagagagagagagagagattgttaaagtgtctagaggctggtgcccagttgatctctggaatcatggaattccatgattttttgaagctcttagagctgaattaaatcgccaggggctctatgagctgtagctctaaggccctgaagcacaggtttctgcaaagtctctggtgaatggcaccctgagcagctcctctctggggtcctcctgcaaggcagtcatgtttgtctttgaacacacaggcgcagtagggtctatataacctgacatatgcagcctaaaaatcaccagagtttgctaagccatgtgataagaaccacagggcttacgggaaaaacaggattaaaaacacaacacttgaggccgggcgcagtggctcatgccttcaatcccagcactttgggaggctgaggcgggcggatcacttgaggtcaggagtttgagaccagcctggccaacacggtgaaactctgtctctaccaaaaatacaaaaatttagctgagcgtggtggtgggcgcctgtagttccagctactcaggaggctgaggcaggagaatcacttgagcccgggaggcgaaggttgccgtgagccgagattacgccactgtactccagactaggtgacagaatgagactctgtctctgaaataaacttttttaaaaagcacaacacttgaaaacttcctcagcgacacattttgtttgttttgagatggagtcttgttctggtcacccaggctggagtgcagtggcacgatctcagctcactgcaacctctgcctcccaggttcaagcaattctcctgccttagcttcctgagtagtggggattacaccactatgcctagctaatgcgcgtaccaccatacccagctaatttttgtatgtttagtagagacagggtttcaccatgttggccaggctagtctcgaactcctgacctcaagtgatccacctgcctcggcctcccaaagtgctgggattacaggcatgagccaccgtgcccggccaacacatttttaaaagataagaatccaataaaaagattaccacagttttatacccgttaaatagttaagaaatatatcaatgctatacaatagtaaatatggcaagtttgcctagggaagtgggcatcagaagtgctgcgggttgtgagttactgtgaagcagtggagaaagggttatctgacatgggaaggaaaagatgtgactccatattgcatggatgtgtcttaccagtgcacacagtggaccgaggcggctggtggatgtttgaggtgcgcatatgtacacacaggagcattgttagtattctcctatgtggttccattcagctggatgcaggcttctgaattcactaagtgttttccaaatgtgaaattgacattacactcaaattatccccaatatgtctatataattggaacagatttacactttcactacaataaatacacaactgactgtattttctacttctgctagacgtgatgctccttgtctggggcatgggtgctcaaagctgctggggtttcattccttcagtcaataaatatgcacagtaccaggcagtctgctaggctataaggatgcaacaagtaaagactcatctctttctttaagaggcagagaaaagtaaacatatcatcagcgtgcatgcagggtgactgactcctgccgtaagtctctgtctagtgcatgtaaaatacaaaggaaggagcagccatctcccaggatgaatcaagaagagcttcacaggggggcgacatgtgacacgagatgctttccaggcagaggaaacagcaaaggtgcagaggcaggagatggtcaggccatttgagaagtgcattaagattgtggtgagagataatgcaaataaaacagacgaatcacaaaggcccagttctgccagtctcaggtgttggggcttttctggaaagcagtgaggagccatcagatgtttccaagcagagcagaggcatggtgtgactttgttttagaaagatatcccaggctgcagcagtgtgaaaggaccctagagacggtgctggcacaggaaggcagagcaaggatgctggcttcttggaaccatgcacctgtgccatgcctttggcacttctgaccagtcatattggatagaaaccgaatgatctgcgtctgtatccaggaatagcccaacacccatgatgctgatgcctaggaatagaggaaagtagatgatctactcaccagggcctcagggatgtctcaactccaccttggatggcttttgctgctggacacaattgctgtggttcatagagccaacaatggggatggggccagtgagtggcttgagctaggaagtaagtagaaggtgaatggctaccatctgccactgtcatttctcctatgggtcctctgtggctattaacctggcatctttggttaatcaatattaaaccagagcccttgtcatatgttcactttaagaacttgcattggtgaaggaagaagggaagatgctattccatttcttaatgcttcctaacacagtgcctggcacatggtaggtgctcaataaagtggcacgacctcagccttcctaaaaatgtcttttaaacaaggacagtgccaaagtaggaggaattgacgtgttttcagcaactgttatgtgcccagcatgatctgggtatttggacatccattaactcattccgttctcttcccaatgacctgacagatggatattgttaacagtaaggaactgaagctcagggaggttaagtaacttcccaagatcacacaggtcttacagggtagagccaagatttaaacccaggtcacctggctccagagcctacacactttgcacttatttttgttctcacttcaagtgctcttctgagtttttgaaatataggaggactggcctctccttcctctaacaagagcacctatttttggtgtacaccttgtgatgcgcccccaccccgccccctcataagatggctggctgattacagccaccctctcaggggccagtgattgccacatgcttggtgagaggagcatcgtgggaacacctgcaggtggatctggggctgatgagcagccttgtgcctggctcccatcacactgctgtgacaatggccccctccccacagtgggccgtcctctggcttatagatgaggaagctggtgctcacccaagaaattgatagcagagctgagattaaaacagggatcccccagtttccagccgagcctctatcacttaaccaggggcttttaaaggaacgttcaaaggtctaggctcatctgtcttttgacagagcagctccaccgttatatttcttatataataaagttttgttggggagaaaacaaagtataaaaaccacagcagccttggaatatgctgcctggattctaacaaatggctcttgagtctctcctgacatgctcccttgtaaagaagccttttgtttcctgcggaaatccttggttaattatttttaaataaataattgcgtagcctttggtaggggagaagcctccttgtgacccatatttgatcatcagagggctggcccttttccatcagccaaattaaataggctaaatccagagactgtttgacttgagactgaatcgatgatggggacaggctgggaggtgaaaacacaactgactcccagcgttatcaacactctctcaggagcagagcctctcggggaggtaaatagctggttagggagtcagagaaagcaggagaaaaacagggtgaagtccagttcctccaaaagaacagagcaagagggcagcggctagacctctctcccaggttgcttccagggcaaagcatcagtggttctgccagggtaggattctttggaaactgttctctacggaaagataattccattcagtgtttagaatctgtcctaagccatctagaattctaggatcttagggcaaatatcttggggtccattcctgtaccagcttcctccccacagcatccccacccatagttgccatttatatggcattttgcaagaaactgtatagatgttacctctaatccaaaaagagtcctgttgaggaggcattctctccatttttctagaggaaacaaaggcacagagagggaaagtaattttcccatgatcacagatctattaagagcagcatcagaatttgaacctgagttggtttcgctgcagagtccatagtcttcccactgcccctccttgatagaaaattcttcctgttatttatttgaaatctgcctccctgttttccattgaacctagctctgccttcagagctcataaggttcaaatctctttcttctttcatgtaacaacactttgaactgttggaagcatcctactgggaactgggtggcagacgtgaagaaagaaggcctcatttaatccaatgggatggcatcgatggcaaacaggagacgtgggggctgcagataggtgcacaggaggacaggggcctgggcaccggctgttgacttggggagctgaacgctgttcctccttttaacttcatgatttctgtccttcccaaaaaatgtagtgccttaaaccaatacaccaatgccagcgccatcccactgtcaccaccacccccactagcagctccttgattcaaagaatggggaaaatggccaatagaaaagctcatagagcaagcgtcaagccactacatactcagacaagttgctcttgaaggttagaacccagctttagcatttgttttgttcttttccccagccctcttaagctctaggtcatatcggccttgggtaaagtccttaggaagatccaaggaaaactggcttggggctcatctagtctcatcttggtaagcttcatcttggtgaattagaggcagattatgacactgattatggcagtgcctggcccctgggggaactttgtggtctcctctggaaggtggggctctagctagggcagggggtgggtggatgaaagagcaacaacagaatcagtgtacagggatggttcatcttgggaaactgggcaaaggaagacgtgcagctaaagagttggtccacctatccagataattccatgcctagagcatttggtctctgcaggacagggtcctccaaacctttttgtcaaatccaaagcaaaaaacaagaacactgtctttctaagcactgagcttaggggtgagatgccccatgtacccccaaccttgtccttgactgtttcatgggcacatcaagcaggatttccatctgcaaactggacccaggcgttcttttagcttccttcagttgcctgatctctgtccagaacttttctttcctgagagcagacctccattttggttcccgagcaagagggagggtcagagcagcgaggttgtaaacatgtttggttctacccttcccctgcagagcaaactccagtggtttactaaacatccacatctgcctgtgtgtggtgctgcctgccccacctcccagcagacacacctttccctgtgccctggaaggcagccaaatgggacccccagcaaaggaatgtgagttctacagcctagctcctagacgcagcttcatccctgtcctgctctgcctgtgtccgtgcccctgacctcttgggcctggccacaaaggtggtacacagagactgatgcctaagctacggctctttcaagggtcactggacaagggcttcttcttcgtcacatgggtctacttatactttgcagcaccacgagggatgccagggaaacatttctaaaaggcattttaaagaataaaaaatactccagccagtaacagaaggctagtctcaacccccaaatcctcaaagaactgtgcggaagcaataacaaacagaatccatccagtcattcatttattcatcagaagtttaccgagtggctattcagtgccaaggcactggggatacatcagtgaacaaaacaaacgagataaaaatttcctgccctcgtggcgcttacattctagaattaaatagagaacatgccatatttaccctggagaaaagcagccgatatttcttgtgggtggacaggggaggagaaagcaactttattttcttattacccacccttgaaaacaagaggtgccgagtcattgttccaggaccctggtggcactaatgttccctactgggtttgtgttgttttgcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatggtgagtacacctgggccattgtcgctctggagctgataagataagaggcaaaacaaacacaacttctcacaaggcctgcctcaaacaatgaaccattgtagccccataggggaaaatgagggctgtccagagtcggaaaggagaggtagtgctggtgacccagcctttggcgggtagaagaggtgttcggtttgaacccagccaataaatctgacagagttctgctctctttttattgattgaatgcctcataaaggagcaagcccggtgggacactgtttgttttggggcttgccaatgacatttgtgttgataaaatgttcattcatccctccccccaaggcctccaaagccaattttttaacttagagagcacctcactttgacacaagccccctcttcctccttaccatccccttggtactgacaagaagagtcattagcaagtcaggatgtagtggataggaggcgatggggagaagcttcttgaactggaacagtgaaagacatgggacaccatgacagcgaagatcacagcacaaatggtagatggggtggggcgatgcttagggagggagaaacaccaactttgaagttacaattgcccaggttcaaatcccagctccagctcttaatagctgtgtagcctgagcaggttactcgactacttatgatctcttcctcatctataaaatgggggcggtaacaatagacttggtgggggcatgagcgtgataacatttgagaaatactctgcagtgtttgccatagaaaatagtcaataaattgcagtattgttgttgttgtcgtgtaaatgtcaatatcattctcattaaatgaagttttctatatccgtaaccacagccccacacccagatgcaagtttagcacacttggtgaagaatgcacaatttgaatttgaattttctacatcaaactagattctaggccaggtgcagtggctcatacctgtaattccagcacttggggagactgaggcaggtggatcacttgaggccagaaagtttgagaccagcctggacaacagggcgaaacaccatctctattaaaaaaaaaatacaaaaattagccaggaatggtggcatgcacctgtaatcccagctactcgggaggctgaggtggggagctcacttgagcctgggaggcagaggttgcagtgagctcacaccactgcactccagcctgggcaacagagtgagactcgggtgtctcaaaaaataataattaataataacaataaaataaataaaactaggttctaattaggattaggttctgatcctgtagcaacacaagtgcaggagagagtggcttatgggagaacaggagcattacgacactggcaagggtagagaatggaaagctctattctttgggtcatgctctgtttttcaggggagggaggagccgcagattcccgactttcatgctgaaggtggagctgcacacattcccagagtgggggccaggatgggtgagggcaacagggtgcagaggccattttagatcttgacgtgtgtgctgtgtaggcaacacagaaacggtgagtcacaggtgatcgagtccctggctccctggaggaaaaacaagtgtggtttctgaggggagcactgacccggccaattctggtttcagaggacctgagctgcttgccctggtcgtggtctctgcaaacaaaaatgaaagggcattcctgggggaggcattttgcagccctcttctcctactcccacctatcccttaagaaagattcttctccatgtgaagaaccacttgtgtcagttacctgtgagaggcacagacaagtctttctgacttctcaagagtgtcccaaacaagttagggttaaggattacccaggcttccatggagaagggtgccttacggaagaggtcttgacttctcagtgtggaagaaccttccaggtctcagctcttactgcttgaaggtccttggggtttcctactgagctctgcctctcctccttctaagaggcaagctgcctcacccaggccagggccgctctaaatgcagcctgtggacacgctttttgcttcctgttctgctcagcagtgctttaactgggcagtgtgttactggattgatgattgaccaagactgcacacctcaacgttagcaaacacctggaagcttgtttgcagggcctggcttttctcttgtctccaacaccctagtgcatgtgctgtgtcactatcatcagaggtccaaattcaagagtctgttttcttgttaatataataacatgtccatcacggatcttggtcccccaaggcaagagtggagtatggttaaaaaggaatgcagggaagggaaccagtatgtgcaagtcttggctcggtcattcaccagcagtagtgtggacaaattgcttaacctcagtttcttcatctgtaaaatgggggataatgatgcctacgtcatagggttggtgtgaagattgcttgtagcactgttgttctttgggtcagccctgttctaggaatgacaatctctgcatgctgactttcagtaggacgtgccttgaaatctttccccaaggactggttttggaaataaagccaatccatttgaactctctgttgtactgtctgcccctacccacccccatgcccaaatgtcacgcattgacaaaaaactggccaggtttagggttgtagtctgtgcatgtcgaacctttaaaaaaaaaaaaaagagagagaacaaagcaaagcacatactggatactttcacagtatcaagcagtatgtcctaatggtgaaaagctcaggctgtggcggtagatagcctgctttcaaccccaattctaccacttgggcacacttcttaacttctctaaatttcagtatccttctctatgaaatagggataataataccaaccttatagattataggtatataaagaacctagcatagtgaagagaccataaatgacagcattaatgtaattcaggctctccaaattatcatgtaaggatcaccactgatacccttggcagtgccctagcttccatcagtccaggagccaaatagaaagtaatggttgtagccgggcacagtggctcacacgtgtaattccactattttgggaggtgaggaaagataattgcttgagcccaggagttcaagaccagcttgggtaacacagcaaggccctgtccctacaaaaaataaaaaaattagctgggcacggtggtgcatgcctgttgtcccagctactccagaggttgaggtgacaagatcgcttaattccaggagttcgaagctgcagtgagctgtgatcatgccactgcactccagccttggcgatagagtaagaccctgtctcaaaaaaaaaaaaaaaattaaaaataatagttgcattttagaatgggaagtaacttgatcaaggttgcccaaacttagtaagtgaataagatttaagctccagcaaaactggattttaactctggctttttcacttatgagtcaagtgacatagaaatagtctcaactcttctgaagatcagtttcttaatctgtaatacagggactgatagtaataatgcctgccctacttgtgtcattatctattaaggacaatcagtgaaagcactttacaaatcctaaagtcacacacatttaaattatttttatcattggcctccacacttctcttataccattaaccaaatgctgaaatgtcagagaaattactgtcacttggttgactttctccaaaggaactacattacccaagagattcagtctgagggcaggctacggatttttttttttttttttttttaatgactggtattttgaaaaacaagtccagcaaacaggctgcttctctcttgtttgatgtggtcagaattccttcttggtcatgtgaccccctaacatttcttgatgcttattttaaaaacacaaacaaacctgtttggtttttgctttctttctttttcaaattaaccttggacactatggagttgaccggaagggcagggtgggagatagcatcttacctgggtgctggtgggagagctatcgtctgaaaagctctgggaagtgaaagatggaagaaggaaagttgagttactcagacatctggtgcatcctaaccctaaagcacctctcggggttcctgatgctctcaagcacgcctgggttcagaataagaggggccagtcctttcttcataataactttaaaaattattttgaggctgggcacagtggctcacacctgtaatcccagcactttgggaggctgaggtgggcacataacctgaggtcaggagttcaagaccagcctggtcaacatagtgaaatcccgtctctactaaaaatacaaaaatcagccaggcgtggtggtaggtgcctgtggttccatccactcgggaggctgaggcaggagaattgcttgaacccacaaggcggaggttgcagtgagcagagatcatgccactgcactccagcctgggcaacagagctggactccacctcaaaaaaagaaaaaaattattttgaaactataagtagtaaactaatgtatcatggaaaaagtgtaggtgtgtttaaaactgatcgcgcccttataattacaattagagttaatgggaaaacattggaaacatttctgataacatcagaagcaaaataagcacatctattacagctgttattgtttaatactgtaagttctaagcaatataataggacatgtagacatatcagtactagcaaggaaaagaccctgttaccatcagatgcttgtattacaattacatacttggaaaaaaatcaatgaggaaaagacactagtaggattcagtgaagtggtcatgtacaaagtaaatacaccaaaatcagtagctttctcatactaatctgtcattaaaatataatggtgattacaatataggatccttgaccaaaaaagaaaaaaaattttgtaatgtgtactggagatgtggaaaaagtagagaaaccttataatggctaatctcccccaacccttagtaatttctgaagctggctagtaactcagacagtcaacaatagatgcaccatgagggcagggatcactgtctgttttacttactgctctatccccagcacctagaatagtgtctgtcccacagtagacacttaataattgtgtttttttctttttttgtagagatgggatttcaccatgttgcccaggctggtcttgaactcctgagctcaggcagtcctcctgtcttggcttcccaaagtgctgggattacaggggtgaagcaccatgcccagccaataattgttattgagtgaatgaaggaatgaatttgagaactagtcatgccaaggaatcgctaagtcacatcgtgttggaaactgctctttgtggtccaagtccacccatgtttctcttgtttttttctctccatcagatctcagtctcaggaggaggtttgcccccagtcagcaccttgacgaatatccacagcctctcccaccataatccccagcaatctcaaaacctcatcatgacacccctctctggagtcatggcaattgcacaaagtaagttctattcttggttggaaaacttgggggcagggagaagaagaatgggaagcaaattaatgtggtgaaaaataactgtaggtctccttcaaactcacccacgactagtagatttggtttaacttctttagtttctcatctgtctccttaaatccaatatttggattgtttagcctaaaacaagagaaaattgtggaatggatttggatcctggtcacagtttagcagctgtgcatcctgggtcaaatcattgaaccttcaggagattcaatgtcctcatctataaaataggttgttaaagtgatcaactgacagtgaatatgaacatgcttataaatctctaaagcatgaatatgtataacatcgtagcttacactttgtcttgagttcattcctatcactaagtaggtggtagatttttcaggaggttctttctgtttggtgatgatgaagtaagaatgacaggtttccttctaaatggggagttttgtgtggtatatgaaatctccttggccagcagtgaaaatacaccaagggaggatccagagggaaactgccattgtatctgagagctttgaaaactttaaggagaaaaagcttgctttggcacatcacacgcctgaagacacggagatggatcaggtccctccagctccaggaggctcatattcaacagcaagcctgtgccctcccatacatgggccatcttgaggcatgagaaggctgaagggaactgtggttgtggatatctctttgagagttttaatgttgatgagtattcagcatatttccagcttcactatgacagctcaggtgtcgttgtttctcaaaaccatccttgtgacccttggatgtattgctggatgtcttgggagagatctaagggtaacacattggtcatctttctttcaaccttgtattgctccattgtcctcttaccttccttgtatctagggctcatgttggccacctctttgttttgtttctgcctttttctttcttccctcttctctccctaaatcagctttagctagggtcggaacttggattctcacttctgaagagaatgacttacacatcctttgaggtcagaacagggctaagcccattggaggcacacaaatttattgaatatgtgtggctctcactctatccttagctgcttggaaattgacacacagtgcattgattttggcagaaggaaaatgggaatggggaagcatttagagaactcacaatataaatgatcattttaaatgtattgccttttgactgggccctctggtatatggaatatggtaattatactaataccagagtttggaatgagataagatacctaaaaccagcttgtttgccatttagaagatttgattaaaaggcccgtggggaagatattccacttatttctgcaaccaaaataataaacaaactgtcccacttaacttctttctttccattctaagctttcactgccatacagttatatatatatatatatactatctgaattaaaattttccctggggctagtctgcatctttccattttgttctttctaatttcctctactcatatttctctatcatttcacgatgctccttaatctcctattcagatgggctgcaccagagtgcacactgacctcagaaggatggctgtgtgtgtacatatctgtgtacacttggggtagacagagcatgagaaatggtgagaatcaccagaagactgctgagacacagaggtcctacactatggagtgttaggatgagaaactggttgcaggcatcttcatttaactgactgatgtgttgagtaccatgggccctgcctcagaattgcggaagcctgtggagaaggtggtaacaaattatttggcagggccaattccttattctctactcattctcacctcttcatcctattctctttctcatctcttccctggactggatagcatacttcccaagcaagaaccagtgcccagaaacagaaacagatgaaaaggtcaagacttacccactgagggagctggaatgacatcagaggctctcaatcctggaattgaggcacatcaggatcacagactgcattgaaaataagattcctgggccccacctctgaaggttctgactcattaggtcttgggtggggcccaggaatgtatatttgttaaagagctcccccagatgatttctgaagcacatgcaggtttcagaactatgccttcaaatgtcatccactctagacaggatcatttgcttttttgggcagcagtttctcaaaaagagcagcagcagtgctctcaaagatttctcaaaaacggcacattcatggagctttctgggagactgagaccataagcaggaggtaggaaagggaaacacggtcatcggtcatcagggtatctggtgagatgctggcttgaggagacgctgagccccctggggaactggagacagcgctgttctgagggtgatcagagggtggcagccccagcccccacccaggagagccagaagcaggattcatcccctgtcctttctgctcaggggtctcgccttttaggtttctgataacagtatcagctaaagctctgagtaggcaattgttgaggactccgtgttatctccattgatgacttccctcaaacctgcctatgaaaccgtctccatttcaggaaagcctctctaggtgtcccttccacatccacctaaaacagacctttttctggattccttcttcatcccattcttcccccaacttcccagaaagcaagaacacaggaacacaatcgaccccaggaagcaggtccaggtgtcttctctcctgatcgtcctgtccccactccgatcctaccttagctgtcttcctccgtgtcgctctcagggaggagatagagcatgggtaccaggggatccaatcctcagagtgctggcccgggttctaaagaggcctcaggatacacagttccaagttacagaggccctgacatctccagaacagaaagatgggaagacccactataaatgccaagagtcaacctttaatgtactacttcctctttctaaaacctggtccttttagtgccacaagccctatgctgccacataagatatgcccgcctcgcagactggctgagttccagtgttttctcccctctctgttacagtcaagggagttggcacctgatttctctgggggtctttgtacagtctactaaataagggtctcccaacctcatactcccgggactatggacgttgtttttagtcaaaatttgggtccctgcacactcctgccctctactggacagaccgatctgggcaataacctgtgcctcagtgtggacatctttaactctgccctgcgggcaccagggcaagcctctctcacagcctggcatggatggagtgggcaggtagagccagcttttccaaagccctggtaacctcaagagagctaagtttgggaggtcacaggatgactctgggagactctcaggctttaatcagatctgtttaatgcccatctccaacccacaactcattgtggaacttgagcaagtaaattaatatctccaagtctccgtttctttacacttgcctcccatggaatctcctatgtaacaggctcagcccggtgactgggacattgagcgggggctcaaatgatggcatccatccacctctccttatcccaggagctgtctgtgatcttttcctcttgctcccacaggcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcagaactcacacagtaaggacacgggcatgtggagggagggagcactcaggaccctcagtggccaaccactttccctctctgggtctgaactttctcggaagtttattggcttggtcacttttccctgcctatgatcaaccgactaagacaatttctcaagcataactcttgagtgttgctgtaccttttctagtcctcttctctacccctgagattcccagggaagggtttgaagaggacagtgtaggcctacagatgaaggggaattggagccagacagcatgtggaacacacaccgccaatttcccattccaacacctctggaaaagatcgcgtccataaaccaccagcaccttttcccagtgaacttcaacttagcctttgcaatctaaacttccaagcagccattatcaaatgatcacaattggcatctaatttgcatcctgtttgccttccctaaaagagaagaatcttctagagtcccatgtcctccaatttatacaccccaaacatctctaatcaagaaccatgaacacaagtgaaaaataccagtggcatgccatcctgggcattagagtttcttcctccatgccacccctgcatctctgcacacagactgtttctcatatccaatttctatacctaccccaagcctacctttcgaccacttatttcccatccaatcccatcctctgtttctctgcctttcatcctgagtcccaggcttccaatcctctggccaggtctggctatagcccctgacacaggagtttggggaggaatcatggcttctctgcttcagaaaccccaaggaagtgttcagtataaagcactagtcttagatcagacagacctggatttaaatcctggctgtgatacttaccagctgtgtagcctaatgcaagttacttagccactctaagtccaatctctacatccataaaatggaaatagtatgcatttagagtcattatgaatatgaaataaacataggggtaaactgcgtttggtaagcataaaaaattataaagattatttataaagggactcttagaaggcaatgatggtgaaagaggtttgtgtttcttccctagctgcatcggataagctgtgggtttgggggagaacagccaagtccagccttctatcttcagggctcaatccccactcgggcctgtggagctggtttctgagcaccatctcacattccaatcacattttagtggcttctgaaaatctgccacagcctgtagcagagtctgagaccacatgtgccccacttcccttcctcccagagcctggtgatgtgctccccacttaccccatcccttcacctggccaggcttcctcagtggcgaggcctgggtgggatagtcagagagtggtcaccagcgacctgtggactgctgaggcccagcaggcctggccgcccatgaagagagagcccatggtgccctggaccaggaaataacctgcctccctgcatgagaagggcaagccgaggcaacagccagtgacctttgctcccgttccgtaccggaggcctccctggtaggccctgtgttctgagagcaggtggtctctccctcacagccaagcatccacatgctttcggcagttggttatgtgacttggaatttacatgaatcttatggataactaatatgagaaatccccactataaccaccagcccttttatctacctgaggagatgggagctatggtgtgggatgggggctctgtacctgtgtctttgcctgtgtatgcaccttgattctgtcttcactctgtctctccagtgtacgcacacaagcaggaacccccccagtattcccacacctcccggtttccatctgcaatggtggtcacagataccagcagcatcagtacactcaccaacatgtcttcaagtaaacaggtaatgccagcaggatttgcgggggttggggtgtgggcagggtgtgataaggccatggatgtgcagaggttgtggcaagcatggactcggccagaaattagatccttctgaggctccctgttgtttgcaaagggaatccttaaggtcccagggcaaaaaaaaagggccacaggctgaaagggcttattgctcccccagattccccaggaagagcactaaacaaggacagaagtttgataggttgctggagactggatgacatagagcgcttaggcatttagattgagtgttccctaatagaatgatcaatggtccatggaaaaggtatttccaaggagggctcaggaggacagatcccctgctgaggttcatgctttgcaagagggatccctgaggatccacaaagtagtcagcggagaaagtgagtaggaagtcagaggtcctgaggctgattcccctggacccagaatgccataagctctgggaatgacccagttgtgtcaacccatggggactccccagtagacagcctggcttttccaggggtaagcatccacttggggttttatcaagaaatttagaatcaacttcctgctgcactgaaagtggggaatccagaggcttagtcactgtttcagttgatgactaagtcccacctctgaatagaggtgatggaatagtagacaggcagctgatggcgaggctcattgctgcagcttggacagctggactgcaagaagacaccgagagttagaaaacaggacaagatgtctgaacacaggtgatgattccagagtaacacaatgagaccttttagtagctggggtctgtgcagtgtgggaactgtttggcctctatcgattactagataagtaggtgacaaccttgaacttcatgtcagaagctctcagaatttggtcttgttgaaggtctttttttcatctgagccctgcaaatcacacttcatccactgccatgggcttcccaggaggttccttcatgggatcagggttctctatcctttcctttgccccgatctccttccagccctagagtgcagtggagcaggtgggttctattcctggttctgccatttgcttggtgaccttgacctccctgagccttcatttcttcatctttaaagtgagagttgtaacatctgctttttctgaggattcagcaagcttgcgtagattaagtaactggtgtcttgggcactgaaacacacacacgaccagggcagctgggctctggagctgggggtagagggagaggtgtgtgggacctgctttgccactcttctctcacccaatagaagatgaaaggacaacccctcactaccctgcccttcgactcccgtgcgagttcccactctttgtagtgggcagggaaaacatttatctgtgctcacaaatctcaatcaggggggcagccaggcgcagcggccctccttgggaataccttcccctttgaaaggtttatcaatccatctgccgcttggtcagccccagacaggaccatgattaattattcctgtctttcccaagttgactttgatggttgcttgttgaaacaagtcgtctgaattcaggaaatggtctcttaatcaaaatactttaagatgctccctgagacgctgcaccagccccccactggcttctcctctccattggacagagtggccagccaaccttgaagctgcatgagtggcctcccagaactgctgtgacattgtctccatgtccccagacatttcaggagtctggcaatagactcatttctgcgatgatgaggatgattattacactcagtaaggatgaaaaatactcacgtggcacgttacagtttatacttctcatgaacattgtctcattgttttctttttactgcaacctcctaagtacaaagaaataaactaaaacccagagatgaagagtgacctgcccaaggtcacacagatgataaattctagtgctggaccttcaggctttggtctttgactccacatacttgccttccactaccatctttaaaattctacggtaactgctgccactcttgttgtctttgtggtcaggaacaagagtaaaaaataagttcacttgccatattccactcaggaaacgttcttccaacaagttgaaagagaaggaggaatgggaaaggcacagtgaagtaaaatgagggtaaaggtgctgcctcctgacagcagaaggtacccaaggtgaagacagtttgtacaaactctgttcctaaggcagagggtcagaagtgagttctgaaagagacctgatggcaattctgcttttttggttttgttttaaggtcttatattccaacaggaatttcaaattcatttctggcgtgttcagatttattgcttatagcgatgtctgtttgcttcgctataaagaaatatctgaggctgggtaaaagaggttcaaaggctcatggttctgcaggctgcacaggaagcatgatgccagcatctgcctctgctgaaggcctcagaaggtttacaagcatggcggaaggtgcagacagggcaggtgcatcacgtggtgagagtgtgagcaggagggagaagggagaggccctgccctgggctcttatttatttatttatatttttatgttttgagacagggtcccgttctgtcacccaggctggagtgcagtggcgcaatcacagctcactgcagctttaacctcctgggctcaatcagtcctcccgcctcagcctccagagtagctgagactacaggcgcacaccacaatgacaggctaaatttttgcattttttttgttttgccatgttgcccaggctggtctcaaactcctgcgctcaagtgaactgcctgccttggcctcccaaagtgctgggattacaggtgtgagccaccatgcctagccctagactcttttaaacagccagatctcacgtgaactaactcaagcatgaattcctcacccatcaccatgatccattacctcccactgagcccgacctccaacactgggaatcacatttcaacatgagatttggaggggacacacatccagaccatatcattccacccctggcctcccaaatctcatgtccttctcacattgagaaatacagtcatcccttcccactagtccctgaaagtcttaactcattacagcattaactcaaagtccagagtctcatctgagactcaagagcaagtccttccacctatgagcttgtaaaataaaaaaactatatacttacttccaaaatacaatggtggtacaggcattgggcagacgttcccatcccaaaagaaataaattggccaaaagaaaggggtaacaccccatgcaagtctgaaacccaacagggcaggcattaaatcttaaagctccaaaataatccttgattccatgtcccacatcctgggcacattggtgtgccaggtgggctcccaaggccttgggcagctctgttcctgtggcttttccatgctgaggttgcaagctgctagtggctttaccattccgaggtctagagggtggcaggcccattcccacagctccattaggcagtatcctggtagggactctgtgtgtggggcgggtggggctccaatcccacatttcccctcagcactgccctagtggaggttctctgtgggggctctgcccctgcagcaagcttctgcctgggcacccaggctttctgatacagcctttgaaatctaggtggaagctgccaaacctccttcactcttgcattctgtgcatctgcaggcttaacatcacatgaaacccaccaaagcttacagactgcaccctctagagtggtggtctgagctgtacctggggccctttgagccagggctgaagctagagcagcatgtatgcagggagcagtgtcccaaggctgtgcagggcagcagggcctttggtctggcccccaaaaccatattttcttcctaggcctctgggcctctagtgggaggggctgcctagaagatgtctgaaatacttcagtgccttttttccattgtcttggctatagcatgcagccctctttagtcaagctaatctctctagcaagctgttgctccataggccacttgaattccttctctaccacagggttaggctgcaaattttccaaacttttacgctctgcttccctttttaaatgtaaattccaacattccaaatgtaagtcattcctttgcttccgtagctactgtgggttgttagaagcagccaggccacatcatgaatgttttaccgcttagaaatgtcttctgttagataccctaggctatcattctgaagttcaaacttccacagatccctagaatatggacacaatgcagccaagttctctgcctgggcgtaaggagggtgacctttgctctagttcccaatcagttcctcatttccatctgagatctcatcagcctggccttcactctccatagttctatcaggattttggtcacaaccacttaacaggtctctaagaaattctaaactttccttcatcttcctgtcttcttctgttcctccaaactcccaatctctgcctgttacccattgccaaagctgcttccacatcttcaagtaccttttttttttgcggggagggggggcggcggggcggggggacggagttttgctcttgttgcccaagctggagtacaatggtgtgatctcagctcactgcagcctccacctcccaggttcaagcgattctgcctcagagtcctgagtagctaggattacaggcacaggccaccacgcctggctaattttttgtatttttagtagaaacagggattcaccatgttggccagcctggtctcgaactcctgacctcaggtgatccacctgcctcagcctcccaaagtgctgggattacaggcgtgagccactgcacctggccatcttcaagtatctttatagtaatgccccactcccaggaccagttttttgtgttagtccatttgcatcactataaaggaatacctgaggctgggtaacttaaaaagaaaatatgtttaattggctcatggctctgcaggttgtggtgccagcatctgcatctggtgagggccttaggaagcttacagtcagggcagaaggtaaagggggaataggcatgtcatatggtgagataaagagcaagagagagaaagggaagatcccagactcttaaacaaccagatcttgtgtgaattaacttgagcgagagctcacttatcaccaaggggatggcgctgagccattcataagggatctgcccctgtgatccaatatctcccaccaggccttacctccaacactgggtatcgtatttcaacatgagatttggaagggacacacatctaaaccatatcactaggtatcaaggacatacgagtgaggggagagaaggatttcttggtcaaatatgttgggggaactgctggattacacaaagttaaatgctactgggcagggcttctcagagcatttcacttgctgatgtgtgcactgaaccgggcaattagcgtgcaccctgctcgagtcaaagggacacatcctgagcagtgctattttagaggtattgtacagtggtaggaaacgccagcagacctgagctactttcagcttcatcaccccctggtatgtgaccttgggcagttaattccctgttgggagactcagtttcttcatctataaatggggaaaatcccacccccatctcacaaaatattcaatgtgcctaacagaatgcctagtacatagtcaagtattcaaagtggtagccccctccctgttttctctcccgtctgtgatcctttaggagatagttgtctccccttccagtgactcttttttttttttttttttttttttgagatggaatctcactctgtcacccaggctggagtgcaatggtgtggtctcagctcactgcaacctccgcctactgggtacaagcaattctcccgcctcagcctcccaagtaactggaactacaggcacaggccaccacacctggctaattttttgtatttttagtagagacggggtttcactatgttggccaggctgctctcaaattcctgacctcgtgatctgcccgcctctgcctcccaaagtgctggaattacaggtgtgagccactggacccggcctagtgactctttcaatatccaattcagtgcttggtctacatgcagtcaaaggaggctgggagaagaaaatgtctcaggattactaccatctctcaagcacatcctacctcttgggcctgggctccggatccctgtttcccattctcctgctgatacacagactccctgctcacctatttcccaggaaaaaagcaaatagttcagggcctgtcaaagcacccataccctttgggcttagccaaatgcctgggctatattagatgttcagtaaataacaaagaatgaatgaacgaacgaacgaatgaatgcagaacccgtgttttttgatgcctccattttccaagcagcaccccagatgcttttctagcttacatttcctggagaaccctcttacccattctgcaaggtcgttatttttatacctgatttacaaagcagaaaactgaggttcaaagatgggtatggatctggtcaagttcaaacagatcataaattccagagctggacttccagactggctttctcactccaaactcattaaacaacgttcatcttccaatatccacttttaagcacccataataacaacccaaggttatgcaggtataaggctaaagccaggatttgtacttgtatctgtctgatcccagtacttcctgttgtcaaggcagacatgccccaagggccttggggattacaggtcaggaaccccaggctgggacttctcgcgccaagaatccttctgcatctactgccatctgtcccttccagagcacatacgtctccctccttctcaactcttgggtgctggcaagttatctctgagtgggtttgtgcctgagttcaacaatgccccgctagtctggaaacaagaccacagcaaccactgacctcagttagaacaagtgcaggcaggttgtgagccaactcctgtttccacagtgttctctccccgctgcttgacttcctagtttatgggaaggtgaagagagggcccccagagcagtaactagtcagggcactgacaagggggcaggtgggtggcctcatcatctatccccttcggctattcctctcccagcttcttcactgggtgaggaagcagagtgttctgatggttgggagcatcgacctgggagttaggcagatctgggctcaacattctaccactttctacctgtgtgacctcagagaaatgtcttagcctctttgagcctctgtttgctcacctgtaaaatgaagataatgatacctctttcatgggatcactgaaaggactaactgcacgaagacctgtaaaatacttcactcagcgcatgtcccaaaggaaacacccagcccatggaagctgggtcactcttggcttcccctgctagcacccctgagcggctctgagtttgggaaaagggtcttacgtggcaaagggcatttatttccccgtgttgagggggttgaaagaagtgctcttacataggggtgaagagcacaagccttgctgttgtgagaccccggccaacttacttatcacctctccaggccacacttccctcatctgtaaaaccggaattataatcatgacttttaattaatggagccacaatgaatctcacataagttcatggtcatagaagtgacttatctgtcctcactgtctccacttcctcaccctcaattctctcttgagatcactgcagactggcctttatcctcacgcctcactgtgtccagctcacgatcccctccatgctgctgaaaccaatggttacttttcaacctctgtctctgacacagctgatctctccctccttttttccatgggagtttgggatactaccattcctggttcttctacggcactggccacttctcatctcctcagctggcaactcatcttcccaatatttatgtgttggagggccccgggcctcattctttggcctcttctcatctgtgctcactcctgggtgatctcctccagtcccatggctttaggtcaagtgtacacgccgatggttcctgtaattctgtgtacagtccggtcttccctactgagtgctcactcacagatccagtgctgcttcggcagggacagacgcatgtctaaaatatctaataagcctcttgaattcaacgtgcctaaaataggaactcttcattttgccctatttcatcctatcaaaattgcttcccccatgggcttctccatttccaaaactggtaccagttgttcaagtgagagagctgagagtatccctgattcttctctccacatcacatcagtctctcaataagttctactaggggaccctcagaatacatcctaaatctgacctcttctcacactcccatcaggactgccctagtcccagcccaggcccccttgtctctccctgatctccttaggtggcccttgcctgtctcccacttccacccttgccccactgggggctgttcgccagagtgatctcttacaaagagacatcaagcatgtcaatcccctgtcaaaactctccaatagctttccatcacaaccaaactaaaacagagacatacaggaccctatgtgattatgcccctgccagtgtcgccgttctcacctccttcctccctccatcacccgctcagctttagctgtgccagggctgaagagatcccactccaggactcctgcatttgtggtgtctgcctggagctctttttttctgtgcatttttacatgcttgccccttcacttcattcagctcaaatgttaccatttcaaagaggcctcgcctgattcccatatctaagttaatctctttttcctcaagctgccctaacctctatgcttatttttctatggagtgctcatctccacctaaagttgtagtgtgtgtgtgtgtgtgtgtgtgtgtgtgcacgcatttgtttacttgtttattattcaaagccttcactaggaggtaaagcctgtgaagaagtgggcagggtgttgtttacagctgcatctccagtgtctaaaaaagtgccaagtacacagtaggcactcaaacgtgttaaatgaattcacgataatcacctacttcaaagggtcgacgtaagaactcgaggcagtgatgcttgtgaagcccttggtatggtgcctggcacacagtaggatgtcgataaatgttagctcttaccattatgtaacaaatcctcttagaataaggatgtccttcacatttgccacagctaccacacctttcagacggagggccccgcggtctctcagagatcttctgggccaggcccccgtggggctgcgtgtgctgggcctccagttctaagggaccacagtgcaccccttatcagatgtttgtgtttagactctgaaggaggcaaataactctagttcttttgacaacattttgggctctgccaccattttattatgtgagcaaacatttgatagctgggaagcccatccctaatgacaggccatagaatctcactggcgtctccttatctgcccttcttgtttgctcttcttttgaaacctgcaaggtcacaagccgttttctctctcctccacctgaaatctgaaaattggaaaaaggctgatagtgggaagtaaagagacttgagagtgggggtgggccaggggaggaagaggaggcaaagggtatcagaggaccctgaccaacgtctcaagaatgtggaagggtcagaagcctgtctcctcacatgcacgcactgctcagcccccctcttttttttttttttttttttttttgtgagaccaagtcttgctctgtcgcccaggctggagtgcagtagcataatatcggctcaccacaacctccgcctcctgggttcaaacgattctcttgcctcagcctctcaagtagctgggactacaggtgtgcaccaccatgcccagctaatttttgtatttttagtagggatgtggtttcactatgttggccaggctgatctcgatctcctgaccttgtgatccacctgccttggcctctcaaagtgctgggattacaggcgtgaggcactgcgccaggccttcagccccactcttaagagtactgaggagcagcaggggcttgggccgaagaaccccatgttaataataacaattgtgccaaggaccatgctcaggactccacaggtgttgactcatctaatcacacaacaactcccatattataggggaagaaactgaggcacagagagagtaacttgtccaagagcacaaagcttagtagaaggctcctcacctccaagcatgattgaaagagcacatgctgagtggccacctagacagctagtttgaagctgtggctccacactctcctagttcttaaaccatggacaattcactgactctcttttagccttgttttcctaatctgtcaaatagacataatggtatcctcatatagggttatggttggagcactgatcaatgcgataacagtggcctttagtggtattggtaggtgtaagtgtgtgtgtgtgtgtgtgtgtgtgtgtgtgtgtgtgtgtgtgtgtgtttggggggatcttgagagaataagccactaagtcaaaggcagaaccttagatgccggcaaaagcaaaagggaaggaggagacacagggagacaaaaagagactccccagaagtgaaaaggaaagcagtgacactccatgacagttcaaatgaataaggcccaggcactggagggcaaggctgccctgagttgggtgaggtggcttctctcgagggcttctccagccattctggggtctcctgccctggcccacccacaaggatggcatcagaggccttcagcctttggatcctttccctggtcctctgagtttcttatgctaaagtaagaaacccgtagaaagcactttgcaatttgcaaagctccttcctgatgagtagtttgagtggtcattttctcgtgtgctttctggccttgctgccctaggtgagcagcactggcacaccctgggaacttgttagaaatgcagactcttaggtgcaccccaggcctacaagtcagaattaaaccagaatccacattttcacaggctctctggtacttgtgggtccgttaaagttcgagaagcattagtataggaggcctctgctcttagcggtcttaggaagagacccttgcttccacgagaggcaagagctcaccatccagctgccttttcaagtacactaagcactctataaatgccactgtcacagaaagaggagcccagcttcaggattcaggtcagcaagttaagactacttcaaggtccccagcaattcacttctttcttctgaagtggccaggaaagccggctcccgggttttcctgcaggaagtgtgcctcagcatgaaaactgcagaactgagcagacacgaggcccccagccctccacctgctgctctttgctggttgagttgggcatcatctcccttagagaagccaaactaatggcccatgaccctgccaaatgacacagctgagcaccctctctcctctctctctgcagtgtcctctacaagcctggtgatgcccacacaccacttacttcgtgcgcaacaacaaggaccctgttttccacaccatcaccctctgggcagctgtcatggaaaagcccagtgacctgaccagcacctgcgagaggtccctgcttacctgacggacgtcctgctggcacctcagacaatccactctcaggaggcgcagcccgaagcccagtttcccttctatgcagtattgccacaatgcctctcccacgatgtcaaggactcctgtctgtcctggaggtgggagacaaggaacctccgaagaggaagcaagaaagccgtactgtctatgttgtgatccttcatcgaacaaactgatgcgaaaacttgaatctgttactgaaatgaggagagaaggacatgtgctattgaactgagccaaacacactgtaaatatccacagactccctcccctgcccccatcccaaatgatcttgagatttcttttaaagaagtaaatttgtccaatggctgtaaactataaactactgtaattaagtgcaatttcccctctgtgtcctctcccctctgccctgtatataatactaaagtgtctattagttttctttgtaaaggtcagagtcaaaatttcaaaagtgatctgtcccctctcccctcatggagaaacatcctaagtgggaagtgaagccccttgtcctctcccgcgggcctggacacttatggggacagcataccttggactgactaccagctaactccagtctcctgacattaagacacacctctggatccctggaggggctgaatgtagtgtgtcagagtaacatgccagcttcctgtgggccaggagctcagccgtgcactccctaagaaaccccagggcagggaaactggctgtttgatagcagaagaaaaagttgcagtctcagaaagccttccattaaaacaatttattttatcactacccagagtctcatatttctgtctctgatactttccctgccatggttccaccgagaacccctggcccctggtctccttggaattttctgtatactccactgggatcctgtagtgtgtcatctaggggtgtagagaggtgggtggccttctcttgccgtcatgctcccagtgtctgtgtaggctttactgctgattgaggtgaagaagagttgaatcccccagtaagactccacaagtcgctcagagggaatctggccagagcaggagctagcacccttttcttccctgcaactcacaggggtaaagtcatagagtcaattcttggtgggtgacatgtgatagaaacagacaaaaagtaggatgaatgaaaactctgcgggtaaattgtttagcctcatttaaagcattaattccagcctttcttcctgccctccttttccttcccttacagctctcagtcactaagtgaatgggctcttgtggacgtcacctcttgcccaagattctctctctggtggggatgctaaggaatacaaatagtccaaacagtaaaaagccaaaggcccagagactccaccagcagggactttaccacaaataattcagtgctgactccagaagaaaggaagatggacctgtcttctttgctgtttccttttttgccaaacagcataggcctactgccctgtggttcttcgcttttaggcagagcatgtcccaatgaaagtggaagcaaagattgtgctaaccaggccatgagtgatggattttttcaaaatcccattgtagtgggagattcaattctcagtgagctgggcaaatttactgagtacctagtctgtggccagagcagcaatggatggacaaggaaatactgactttaattgattcctagctccccctaacaatgtaatttggattgaaacagtgaagagaaaagttcatgactgggttgaggagggctgaggacaaggccgagcactgcatatggagagaggccaagatcccctttcattagctgagctgtcctgttggatggctcctgtgagctccgggaagaggaaaggaacataggcctcaagctccagccccaattgaagccctatatctggactcgtgttgtttctagaaaagcaagcatctgcttttgatagattttagatcttgcatttagaccctgaaaacccagaaggtcatatttatctaacaggtcatctgggcagaggtgtagatggaagagagggaggatggctgggttggggacagtctctagagagttttcctaacgaaatcctatttgaacgaagatatgtagacagctgaccctggcaactgagagccccaaggatggttagcttcacctttctaaatcaaacagggacctccctccactggctatacaagggccaaggggaatcacacactctgaagattcattggcaagcttcaacccccacaccttcctcccaccacctgatggaccaacaatctccagggtgtcttttcataccctgaccccaggctcacagacagatggttccatttttatcagagccagctgtcactttctagggtgagcctgaggaaggcaaatttcattttaacatccatggataggaaataaaaccagtactgaaaactcgccttaaactgtattaaacttttccatgctaaccagttatggggtattccaccaaaggcagagataacgcagtgttagctgctgaattcaggtagataagaaagaatacaatgcagacagtcagggaatctgagctcttggcccacagttgggggcaagtctttgaattacctttggagccaaaattccttgatcagaatctccaactccaccatttaacctccctggcccttagtgtcctgctatgtgaaacaggaatgataatggtagtacctactttattagattgtttgagaagtaagagggttaatatatgttaaacacttagaactgtatatacaatgggtattgtgtgttagt

SEQ ID NO: 15465 - DNA, 62636 bp, Human; identical to SEQ ID NO: 15464

SEQ ID NO: 15466 - DNA, 43192 bp, Human
cccaggctggtctcaaactcctgagctcaagcaatccacccacccaggtctcccaaagtgctgggactacaggtgcatgccaacactcccagctaatttttgtagtttttgtagagatggggtttcactatgttgcccaggctggtctcaaaactcctgagcccaaaaagtccacccacccaggcctcccaaaattctgggattgcaggcatgagccaccatgcctggccaactacgaggtttttacataacctcacagatcttacagctatatcttttttttttcccaagccaaaaattatacttcccaatgacactaaccaacgtaattatttatttgctttacctcataacatatacacatacactaatctcaaaataactgtcaatactaaagaaacattttaagatttggcaatttcttttgtttttaaggtatatcctacttagagatatttagtcaaattaagtgtttcaaaatcacttgaaatagttcctttctgtgtgattatgccttcaaattgatttctgagttcgttatattttgcattttattcttaagattttgaagtttatttttatttttattttttgagacggagtcttgcttgttgcccacgctggggttcagtgctatgatcttggctcactgcagcctccaccttccagttcaagcgattctcctgcctcagcctcccgagtagctgggactacaggtgcgtgccaccatgtccggctaatttttgtatttttagtagagacgaggtttcatcatgttggccagccttgtcttgaactcctgacctcaagagatccacctgccttggcctcccaaagtgttgggattacaggcgtgagccactgaggccagcctaaagtttaatattatactctttatgtttcaaagttaaatctacaagcaaggaatattcagagacatctagcttctggatagatgtctctaccctgttctctttcttcctccccatagtaacctttttttttttaaagtgtgttttattcttccatttaaaaaaatacatacatatttgtcttttcctctttcttagctaaatgggagcgtactgaaatatttatctctacctctgtgttaagtttaaaaatatatgtatatctgcatgaattgcttggcatttataggtgatatggaggcccttctagctaatggtggaaacgggtgggagaggtggacaactaataagaatgtaccctgggtatctctcatcattcggctgtaaactattactacagttgaagttcctagattccatttatttttaattttttttttttttttgaaacggagtcttgctctgtcgcccaggctggagtgcagtggcgcgatctcagctcactgcaagctccgcctccgccttctgggttcatgccatcctcttgcctcagcctcccaagtagctgggactacaggcgctcaccaccaggcccggctaattttttatatttttagtagagacggggtttcactgtgttagccaggatggtctcgatctcctgacctcgtgatccgccctcctcgacctcccaaagtgctgggattacaggcgtgagccactgtgcccggcctatttttgatttttgagacagagtcttgttgtgacgcccaggctgaagtgtggtggtgtgatctcagctcactgcaacctctgcttccgcagttcaagtgattctcctgcctcagcctcctgagtagctgggactacaggcgtgtgccaccatgcccagctcatttttgtgtttttagtagagatggagtttcaccatattggccaggctggtctcgaactcctgacctcaggtgatccgcccgcctccgccttccaaagtgctgggagtataggcgtgagccaccgtgcctggcccctagattccatttgtatctctgttcttaagcaaaacttttttctccttagacttcagattttcctgtccttgatcccagctggactgctcaagaagaaatggcccttttagaagctgtgatggactgtggctttggaaattggtaagagcttggtgttaagagttgtcctgccctagtggactcagagaagaagctgttgttgaagagtaaaggaaggaacctcaggaagagaaagtatgtgttgctttcctatcaacccatgatttagaggcaagttagtcccctctgtacattatttttccagtgtcgaaatgtgtcacgaggatatgggatgtttagcggtccatgactgagcagctttaaaaggccactttggatgtatcaacagtgggaagattgattattattcctttctgaatagtagggaagtttagtttcgttagttattactcccttctgattttatgaatttttgttagttgtagatgccctagtcatttaagtgaatcagactttagctagatggtcatacgtaagattcaagtttcacagacttcctgatagcattctctgtttttagctttcaaacacctacctgccttagtccaaaaccggcggaattgaatagcacttattgctgttgacctagggggcagcaccacttaatactaccactttcgtttttatcttttgggaacactttcatatggatgcttttattttatgaactagatagcagaggcattattgaatatattttgttcacaaattatctgaagcctagggggttgaaatgatttcttgtgattacatagcttattactgaaggactcttaattaggtcctccctgtcctgacttactagtgtatataacctttcttggtgttcatcagaataaactctgctgcctgcctcccttatgtccagggacctgaagaaggagacctgaatttagttcacattttgcttgtattcattcattcagtatttattaagcatcataaaatactgtgtacaatgagaaataccaaaggaggtagaaaagtaatcacttgtgaggagtttgctagtcatctttggcctagtttttcattttttgcttaccattctctctaaaatagtctaaacctctctgtcctccttccctcttaacaaagaacataaaaaagacatagcttctctatccgctgtgggtaaggcactaagtttggcagtgagtgggctagagctaagaattatgagatgcatcctgtcttcagaaagcttatagtttagcaggggacttaaaaatacaagtgattgaagtacacaaaacagcacagtgatgccttaggggaggtcaagtgaaatgctgtgaaaaagagaccttgaggaaaggacttccacctgtacctctccattaccttggctcaagtcagggatttttttttattgagacagtctcactttatcacccaggctgaaatgcagtggtgtgatcacagtcactataaccccgaactcctgggctcaagggatcttccctcctcagactcccaagtagttggaacaacaggtgtgcgccaccatactcagctaatttttaaattttattattattattattatttggaaacaggatcttgctctgtcgcccagggtggagtacaggggcatgagcttgactcatttcagcttcaaccttccaggctcaagtgatcctcccagctcaggctcccgagtagctgggactaccggcgtgtgcaaccacccctggctaatctttgtattttttgttgagataggattttactgtgttgcccaggctggtctcgaactcctgagttcaagccatcctcccaccttggcctcccaaagtgctggaataacagatgtgccccaccatgcctggccagattcttaagcaagtttcttaattattttgggcctcatttttccttctttgaaattgagatagtaacaatatccataccacaaatttgatactaggtttaacttaaattctgttgtgaatgtttctagctcagtgtctggcatctcatagcagctctagtaaagaaatgtttatgttaagtgtttggtaaaccgtaaaatattatgcaaaataaaactatatttctgtatattttgaatgttctgaagtcacttcttattatttacagcaattatttctgtagggcctagctcacaggaaaatttacaaattttccagtcatctttatttatttatttatttatttatttatttatttattattttttttttttttgagatggagtttcgctcttgttgcccagactggagtgcaatggcgtgatctctgctcactgcaacctttgcctcctgggttcaagcaattctcctgcctcagcctcccaagtagctgggattacaggcatgcatgcaccaccacgcctggctaattttgtatttttagtagagacagggtttctccatgttgatcaggctggtctctaactcccaacctcaggtgatccacctacctcccaaagtgctgggattacaggtgtgagccactgcgcctggcctcagtcatctttctttaagtggaaaagaaaggactttttagtcattatttctgtgttttagactagcaagatatggaacaccagattacaccaatctaggcttatatttatgtcatttttctgctgatatctttttgatatcaatttggaaatatgagagtatattatatggatgtgacttaaaatatgaaaagagcaaatgatgcttttagtattatgtgtaaatacaagtaccacttctctctttttcccacaatcctctaggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactgtaagtgcctccctatcttgataagatatacttagctcatccttgggccctgtttcagtagcagataaagagtgatttgatgacttggacagctaatgatatcacggaagataggaggagttagtatggcagctattgagagtcaggatcgacccggcatggtggcttgtgcctgtaatcccagcaccttgggaggctgaggcgggtaaatcacttgaggccaggagttcaagaccagcctggccaacatggcgaaaccctgtctcaactaaaagtataaagattagctggacgtggtggcagacacctgtaatcccagctactggggaggccaaggcaggagaatcacttgaaccgggtaggcggagattgcagtgagccaagatcacatcactgcactccaacctgggtgacagagtgagacttcatctcttaaaaaaaaaaaaaaaagagtcaggattataatgtggcaaagaaggaacatactctaagggtcagagttctatacaggacatcaaggtgcttgaagccaatgtgtagttccacctaccttgagtcctttgaacatatcagttaacttagtgctttcctttgtaaaataagatgtcaaaaagggaaaaccttttctatgctattatgagtgcaagttttttttcaatccctttggagagcttatgattatacatatgagttgcttagagaatacagtatttgactcattattattaattgccttggtgtcaagcccaagaatcagtttgttatttttgttcgcttggttgtgtcagtgatggcgaactttttaatctcatgtgcgtgtgggaccagtgggtctcttaataaaatataaccaaaaacatgatgaattataaatgaccatctttcctgaatgactctcagggtacaagtaatgagatatgaatgttttcacttcccttttctctttcctcatactctctagaaacagttttatagctgactaacttaaaggctggtaatacctccttttttttttttttttggagacagagtctcgctgtgtctcccaggctggagtgcagtggcacaacctcggcttactgcaacctccacctccagggttcaaacgattctcgtgcctcagcctcctgagtagctggtaccacaggtgcatgccaccacacctggctaattttttgtatttttagtagagaaaaggttttgctgtgttggcgaggctggtctcgaactcctgaccttatgatctgcccgcctcggcctcccaaagtgttgggattacaggtgtgagccaccgtgcctggttgatacctcctatttggatagcactttggtgttagcactttgttctcaaatccattagaccatttgtttcctaacagcaacccagtgagataggcagagcaagtgcttttgttttacattcgagaagaccgatgcagacaggttagtttgtgcagggtcatgggactagtgtgtgttggagctaggacttaatttcagctaacttccaattccagtgtttgtttttttcccgtcttttttttttttttttttttttgcctctcagttggatgagttttgtaaattgaagttcatcctaagggataagggagccgaagccaacggtaaatatttaggttctgtaatattaaaggaaaaaagtcatgatttcctttcattttaggaaagcagaaatcagaagaaatttccccatatttacttaaaggattgcctgagtcttggtttttctttttaaaaaacctgttttcataatactttatctttttcacatttccttttataaaaaccattttaaattttatttattcttggactattatgtcatttttttcatgccaatattgtattagttaactcagaaaccttctaaattcttccagctacagatgaccctccccgacctacctttgactccttgctttctcgggacatggccgggtacatgccagctcgagcagatttcattgaggtaggataaatgtgtttttagcacaaagtaggaaaaattcatttttgtttctcatgagccttctgtctcacccatagattccataccactaaaaggagatttttcaaggcactataatttgtaggacctttaggcagccacattttcttaggtttgagtgccttttctcatttgtaaacattttcacatatggaacagtaaaaattctttaaacaaacaacctatttctggccaggctcagtggcttacacctgtaatcccagcactttgggagctgagaatggaggatcgcttgagtccaggtgttcgagactagcctgggcaacgtagtgagaccctgtctctacaaaaaataaaaaattagctgggtgtggtggtgcatgcctgtagtcccaactacttggcaggctgatatgggaggatcacttgagcctgggaggttaaggctgtagcgagtggtgatcattccactaaactgcaccctagacaacagagtaagaccctgtctccaaaaaacaaaaaaaccccagcaaacccacctcttaagttgcatcagtgctggcttccacttccttaggtatgaaattcctatagtctggttctttttttttttttttgagacagagtttttgctcttgttgcccaggctggagtgcaatggcatggtcttggcccattgcaacctccacttcctgggttcaagcgattctcctgtctcagcctcccaagtagctgagactacaggttcctgccaccatgcctggctaatttttgtatttttagtagagatagggtttcaccatgttggccaggctggtctcaaactcctgacctcaggcaatccaccagcctcggcctcccaaagtgctaggattacaggcgtgagccactgcacctggcttgtagtctggttcttattgtacatctaggggctttcaagattgtactgtatcaggggttgacaaacttattctattaaaggccagatagtaaatattttaggtttagtatgctataaagtttctattgtaactatactttgtcattattgtgctaaagcagcatgggataatataagaataaatgaatacgcctgtgttccagtaaaactttatgtacaaaaacagacagtaggctgaatagtagtttactgattcctgtactatatccacaagtatataaagaatgatgaatgtgtataaaaactatatgttccttgctcagctatggaattaaaagacatgtgaatgtagccacaagtctcttgatttatcatctaattcacaacttgaaagatagtttggccaaatggggtagcttacacctgtaaatcccagcactttgggaggctgaggcaggcggattgcttgagctcaggagtttgagaccagcctgggcaacatggcaaaacgctgtttcttcaacaacaacaacaaaaaaaacccgaaaccaaaaattaacttgagtgtgatggcacatgcctgtagacccagctgcttgagaggctgaggcaagaggatcacttgagcctgggggttcgaggctgcagtgagccaagatcacaccactgcactccagcctgagtgacagagtaagaccctgtttccaaaaaaaaaaaaaaaaagaatgaattgactttatttatttatttcagagacaggctcttgctctgtttcccaggcagtcttgaactcctggtctcaagtgatttttccacctaaatctcctgagtagctgggattataggtgcatgctactgtgcccagctcagactaattttagtttttagagcagtatgtttagcttcattcctaaactcataactattccaattttttgttgtcactactgcttgtaagcctcttagatttttcccatgacttcctattacctgtgccagtattgtggccttttgccatatttagactttttaaacaactgtttgcttgtgttttttctgtttacttctaaagcatggctgctgtaaagacactaatcaaagccgatgggtttggggtggggatttttttgttcccctaaacaggaatttgacaattatgcagaatgggacttgagagacattgattttgttgaagatgactcggacattttacatggtaacagtttattttgtcaaatgtttatcgagcgccaactgtgtgatgacactgtcttgggtgctaggaattgaaggatgaatagaacatgtcccctgcccttatagaattcagaaatctagtggttaagttgctgaacttactgtgttgttggattttgaccacagtgaataagacttgtgatgagggtaaaaatattgattatataatagtagtaggaaatatctgttggactgtgtgattttacttttatctgaggtaaatctacactaaggtaattggttaaatggccctcacttgcattcttagaaggaagggaatcagtttgaattcttgggacttcactagcaactgctatcactaaatgttcactatattttgttacccggaatttcccctagcaaggaaaaagaatggaaattcctcaagagtttttaggcccaaatggggaatttcttgtttctcaggactgttgaattttcaacactgctggattcttttttatgtttgtttttgagacggagtctcactctgttacacaggctggagtgcagtggcgcgatcttggctcactgcaacctctgtctcccaggttcaagggattctcctgcctcagcctcccaagtagctgggattacaggtgtttgccaccatgcccagctaatttttgtttttttattagagatggggtttcgccatgttggccaggctggtctgcaactcctaacctcaagtgatctgcccgcctcagcttcccaaagtgctgggattacaggcgtgaaccaccacgcctgccccagcattgctgaattctaatctttgattagccctctaagggtttatgttaactcttttcctaaaacttatgtggtgaatgccaaagagctgttaagagtagatagttagactttgagtcccttttttccttctttccattttcagtgaactacatactaatatatactaatactacataataatacccaatactttttttttaattttagttcagaattgaatatgatacagtagatcagtaattctctattggaatctgtatttcccaaagagcatcttcatgatttctgttaaatttacatcccaggcaggaaagacaagtagagtatacttgttaaattataaatcaagttttcatattgcatggactggtacactgtccctagaaggggaacttgattcttttctctccatagaagagctgcctggatatttgttataccagatctaagataaagaaatagtcttcctaaaaattttaccttaagaaatttttctctacacatttcttgagcggtgggtttttttttggggggttttttttttttttttggcaacattttattcctccttttctcccacacaactttaaggaaagtcaaagtgacgcagattgaactaaaagaggaaagcttgaaagcaaactactttagcattaactaaatccattgtatttgttcagtcttccgtgtcagtctcgtcaatcccagtgactcatgttatcttttctcacctcttgtggtgttccttttgaaggtagtatgcagactgccattcatagacaccagctttaattgaaatggtattgttttctggcttgtatctttcttatagaatgccagactactctgcacaaaaggggcagcttcataaatatcattcttttagattctgctcaaaaataccaaatttttggctgggcatggtgggtcacacctataatcctagcactttgggaggccgaggctggctgatcacttgaggccgagagttcaagaccagcctgggcaacacagtgagaccctgtctctaaaaaaaaaaacctttaaaacaaatttttaaaatattattattgtttttcctcctcctcctccctgctttttatttttacctatatatttattttttacagaattttaaagtcaacatctataatgttaataatggcttgacttggtgaatcacttctctagagcctaatccaaggtcttcattcatacttctcaacattattaagaaaactatagtaatggtcggtgtttaatttcattcttcattcttcatgggagtaggacttgcagttccttctggttcacttggggtcctttttgtaattaagtggggataaaaagaaacagaagcaactgattgatcagcaatttatagttcagttagcttttcaaacccataacatactttaggtatttgtactctccctgaagtttctatagccctgtaaattattgattttcatttgagctataactggaacttatgttattaatctttatacatagttagctttaacacaacataaataataattctttccctctgccccatagtaaactgtaagatgtttagatgagtgcttttattttttattttttttgtgacagactctcaccttgttagccaggcgggagcgcagtagcgtgatcttggctcactgcaacttctgcctcccaggctcaagcgattctcgtgcctcagcctctggcatagctgggattagcgccaccatgcccagctaatttttatatttttagtagagacagggttttgccatgtttgcaaggctggtctcaaactcttggcctcaactgatctgcccacctctgcctcccaaagtgctgggattacaggggttagccaccgcgtccggccctaaatgaatgcttttaaaaagatgataacacttcagatttgggtatggttggctcacacctgtaatcctaacactttgggaggccaaagtgggaggatttcttgagcccaggaattcaaggtcagcctagacaacaaagtgagaccccccacctctaaaaaataaaaaagatgataacagtttaaagaagcttgtcagcactacagaccaaaggaatgacttgctcatgccacagagaggtattttgtttacagctctgagtctttacagcagctcctgtggcagcatgaccatgtccaggagcatattgtccctgagctgtcactcgcagaacactcagtgaagtgcactaggagcccatggaaagtcaggaaggaatgaaaaggggctttataagcacacctggaacagttagaggggcacagattttgtagaaatcaggacactgattcagcctctggcttgcttctgagtcatggtataatcatgagtaagtgcttggaatcttgcttgctgtttctttatgtcctctgccattaaagaagaggtgacactgattagtcagagtgtaaatgtctctaatgaaacatggtacataattcagatttgtgttgttaccattccattataccattatgctcttaatattactgagcattaacaacattatttttatggttcctcatttagaactactggaaggttgcagactgtttggctgggttttgtatttagaacctatccagaatattggctgatgccaccaagaccttttcctcacccacacaaagatttttgccttgaatcatggaatttgtttaataaatttggtttgcatggttcattatagagacctgggacacaatggagggataattgtattgcagccataccagaaggctttcagaatgtatttcaaatgtatactgcaagtgaagcagtatccaaggaaaaataaggaagttccgtgatccctaattggtacttactcatattttattgaaataagcagaaatgtttggttcagaaagagagagagagaagactcatatcttagaactgtcttgtctcatgtatgttgtgagatctcaatgcacatgcttagtgtagttccttcttgctgccatctctttccccatctcctttcatttgtaaaaattcttcctaaatttttagagtactctttccctgagtttctcaggatcctaaagtcctggttgtaatgtcttccaagtcattgttgccccataacccaggcaagcaagagatatgatgagctcctcctatgtgttgggtctgtgtttccagtacttctcagggttgcaccttagtacagttcacaatttcttctccctctgttctggaaaggtaattttagaaagttttctctcctaggcttggatctgtggaccccttcacctttcactgtatttttcaaattgtatttctttggcacatattattagcctttaaatcctttaacaattagtagagcagaggtccagcctggtctctgtatattcacctactggcagttcctttcacttatagtgatttcactgtttttttttttattttttttgagacggagtctcgctctatcacctaggctggagtgcagtggcgcgatcttggctcgctgcaagctccgcctcccgggttcacgccattctcctgcctcagcctcccgagtagctgggactacaggcacccgccaccatgcctggctaattttttgtattttttagtagagacggggtttcaccatgttagccaggatagtctcgatctcctgacctcatggtccacccgcctcagcctcccaaagtgctgggattacaggcgtgagccaccgtgcccggcctgatttcactgttttatacataggatattttagacatgaatactatcagtaataattgctaatacatatagcatttactattagttaccattctaagctcttcatatatattaagtcatttaatcctcaaaaccttatgagttgcatattattattatcctcatttttgtggatgaggacattgaagcatagaaaggttagataacttgcctgagatcatacagccagcaagaggtagagtcatccccaagtctgtgttcttaatactgtacaatacttagctgtctttacaatcttgatttttttttttttttttgagacagggtcacgccctgttgcccatgctggagtgcagtggcacaatcatggctcactgcagcctcaacctcctgggctcaaactatcctcccacctcagctacctgagtagctgggactccaggcgtgcaccatcacacctggctaatttttaaaatttttttgtagagacagggtctcactatgttgctcaggctcaaccttgaatgtttgttgctgtttcatttttgtgaggtttcacatttgttatcttctatagcttcaacacattcctgaggaatagatattttcctgttttacattcagggaagcagacaaagaagttaagtaatttgcctaatccaggggtgtcaatcttttggcttccctggcccacactggaagaagaagtgtcctgggccacacataaaatacattaacgatagctgatgagctaaggaataaaaaacaaacaaactcataatgtcttaaaaaagtttacggatttgtattgcgctgcattcaaagccgtcctgggctgcatgtgactcacgagcgacaggttggataagcttggcctaatgcttcctggttgcttactttagccattagatcacatgatcttccctgcacaaaattgtttgtgtgcatcttggccaaaagcttggggggaaatgacttaaatagtgttgcttctggggaatacctgtgtcacaggtttctacttgtttggtcgcagtagggattttgattggcctccctgcagttaaggcctctgagttggttttcttgccaagcaagcagtaagtgccttctgtcaagaaaacagaaacatgttgttagctattttgaacaatgttagaaatacattgcagtgggaaggagctgcctctgacttctgcccacttcttgaaatattttaaggctagccgtttggaaactttatcattctccagtgtaatcacagggagactgtgcttcccccaaagctgagatttcaggggccttgtagcaatggacaaattacaggtgattttggtttgtttgtttatttttaatgatctctggttctctgtttgctagcttatactgcagcttccagctgctttaagtagactgtgagcaagtgattctcattcttgtagattctgccttctcatttctgttctgcctgctgtgctgttgtcctccctaggttattcatacagttaagatattgtattcagttgctgctgagtgtgctcagagatagcttcaaatatgaatttttatctgggagaattccagttctcctcccatttgctcctatgtgtttcttttcttccttttgttctccagagccagttgtacaagtttaaactactgaagtgatcaaactgtagtaccaattatcagcagtatttattcagaggcttttttttttaaaagaaacagagtctcattctgttgcccaggatggaatgcagtggtacaatctttagctcactgtagccttgaattcctgggctcaaatgatccttccgccttagcctcacaagtagctaggacaacaggcacacgccaccacacttggctaatttataaaaaaaatttttgtagagacagaatctcaatgtgttacccaggctggtctcaaaactcctggcctcaagcgatcctcccacctcagcctcccaaagtctgggattacaggtttttttgttttttggctttttttttttttttgagacgccctctgtagcccaggttggagtgcagtggtgcaatcttagctcaccacagcctctgcctcccaggctatagcaatcctcccacctcagcctcccaagtagctgggactacaggcacataccaccatgtctggctatatttttggtacatttttgtagagacagggtttcactatgttgcccaggctggtctcgaactcctaagctcaacccatctgcccacctcagtttctcaaagtgctgggattacaggtgtgagccaccatgcctggccttttttaaaaattaaatcactcctacacaaatctcaggaaacaacatggcatcttgtatcttacaaaaatcgcagaaatgggcctggcgcagtggctcatgcctgtaatcccagcactttgggaggccgagacgggcagatcacctgaggtcaggagtttgagatcagcctggccaacacggtgaaaccccgtctctactaaaaatacaaaaattagccagacatggtggtgggcacctgtaatcccagctacttgggaggcaggggcaggagaattgcttgagcctgggagacagaggttgcagtgagccaagactgcgctgttgcactccagcctgggcgacaagagcaaaactgtctcaaaaataaaaaataaatcacaaaaatgttttgttaaaattagcagtaattttactggctcttcaagacattttctttcctattaaattcatcttactgagtagataaatgagataaggcttataaagatcttgaaatatggccaggcgcgatggctcacacctgtattcccagcactttgggaggccaaggcggtggatcacttgaggtcaggagttgcagaccaccctggccaatgtggcaaaaccccatctctactaaaaatacaaaaattagctgggtatggtggcgtgcacctgtaatcccagttacttgggaggctgaggcaggagaatggcttgaacctgggaggtggaggttgcagtgagctgagatcatgccactgcactccagcctgggagacagagcgagactccatctcaaaaaaaaagatcctgaaatatggtaagtactcagtgtgttttagctatcattattgtatttgtttccctttctggctttaactgttgacttcctaatccttcctttctcttaagagatagagtccactataaaacttgtatttggttatactgtatgtcagaggcacttcctatccttgtttctacccaccacttctaccacataggcttgtaaagtgcatctccaccagcataacattctaaagcccatcattccacagcaactgtgttataaaacagtgacaggtataggcattctatgatatctggacttttatatgtagcaaccctataaatcaagaaatatttcatttgtagaaagagttctgctacctaaaaaaaaaaaagagtttgaaaactattgccttaaatcttggacctgacagtattgaattatttttagtttgtgggcaggataaggaaaagtaaaccaatgtttaaatatttgaacttgttagaaatgaacaaaaagaatccatggtagttaatttttcttttttaccctaaacttttaaaaatactgcatttcctcccttcttcagattatccagataggacttaggttatttttatctcagacccaagggagaatgacctggataaagtactcctggacatctcccagtgattgaagttacatacatatatataggacatctgctcatagcccagcatgtaagattttggtattgaactttccagtctaagaatatccttcagatgagaacatgtagagagagagagaaaagaaaaagagagtatcttaagggcaggtagcagtgagatgcacagtaatgagtcagtatgtggtatcagaatttatctctattatcagagttattaacagtgcatcagcattgtacattgctcaatttttgtttgctttcatgtaataaaagaaattattgattctaatgagccatcgtattctgttcttttacttgattggtcccactttttttctaccctaacatctacttccagcagaagtgtggcttccagttgttccatggaggcaccttcagggactacttctgggaaaggcagctggagctagaacaggcagaaggggttcagctagagcagatctgacttatctgttccaaataagattttatttgaacatacagtttaaaacttactgtagtagaacatgtaaataatgtgttgacttattgccctcatgggctaaactggaacttggatctcacattctttggatgaggaatgagattgtattactcttcagagttaatcagcattccagaggctttaggctctattttggattgaagcttactaccttgaaataactgatttttttttttttttttttttttttttgagacagagttttactcttgttgcccaggctggagtgcagtggtgtgatctcggctcactgcaacctctgccttctgggttcaagagattctcctgcctcagcctcctgagtagctgggattacaggtgtccgctaccacacccagctaattttttgtattttttagtagagacagggtttcaccatgttggccaggctggtcttgaactccttgacctcaggtgatccacccacctcggcctcccaaagtgctgggattagaggcgtgagccatcgtgcctggctgaaagaactgattctaatacgtagccaaattctttgttacaaaggttggtatgttattagaaattacctaacattgagcctctggagcttctgccctgaaagttgagctatgcagtttcagcaggtacaagatctaccccagacacaagaggcgctatgccaggaccgatgggaaggttttctagttccttagtgcaaaatgcgagggcattactttctttctttcttttttttttttttttttggagtcttgctctgttgcccaggctggagtgcagtggcgtgatctcggcttactgccatctccgcctcccgcgttcaagcaattctctgcctcagcctcctgagtagctgggattacaggcgcctgctaccacatccggctaatttttgtatttttagtagagacagggtttcaccttgttggccaggctggtcttgaactcctgacctcatgatccacctgcctcggcctcccaaagtgctgggattataggcgtgagccactgtgcctggccaagggcattcctttctaaggaatccttagcaaataaactggtcctctacagaagaaagcataaaaaagggacacttggaagaaattcaaaagaaaagaacctgctgagcagtcaaattccagaaggccattactggtgcatctcttgctaatatagtggccaagaggaatgagaaacatgaagttaaaaaggctcaatgaaaacaagctagcagggctgctaaggaagcaaaaaaggctaagctagcatctgaaaagaccgcaatggctgctgctaaggcagcatctacacaaaagatggtgaagcctgtgaaagtgtcagctccccgaggtggttcaaaacaccaagttggcagatcagattcttaaagattggactgtagaaaaatataaattatattacctaacatttgaataacgtattttagtttttcagaggacacgtggcaggttatattgtgctatagagcctcttccacaaatacattcagtaattaaaacaaaaaacaccaaactctcaacttacacaaagcttaattgataacttattaagaaaatttcagattctattgcaatcattcaatctcaaggtgctttcaggatccataagtgagaagaaaggtttaatgtagcatagtgccaagttttgcattactcatattttcttctagcgttgttactatctggcattcatttcttaaccctagaggtcttctggttattaaaaaaaaaaaaaaaacctgtgggagttttttgcttctgaagtttgtttttttgtttgtttgtttgtttgtttgtttgtttttttgagacggagtctcactctgtcgcccaggctggagtgcagtggcgtgatctcggttcactgcaagctctgcctcccgggttcaggccattctgctgcctcagcctcctgagtagctgggactacaggcgcccgccaccatgccaggctaattttttatatttttagtagagatggggtttcaccatgttagctaggatggtcttgagctcctgaccttgtgacccacctgcctcggcctcccaaagtgctgggatcagaggcatgagccactgcgcctggccgcttacgaggttttttaaaatacacatttcattttcaattaaggcagatttagaatatagcataaacacagagaaagtaaacatttagacaatttcagtgtttttcctacttaatactctggaaccagactgcttatttttggatccctgctgtgtacttaacagctgtgtgatcttgggccatttgttttgtatgcatggtgtatagggcatatgcgggagtgataggaaacaagaatggggccgggtgcagtagttcacgcctgtaattccagcacttcgagaggccaaagtgggtggattacttgaggttaggagtttaagaccagcctggccaatatggcgaaaccctgtctctactaaaaatacaaaaattagccaggcatggtggcgcacacctgtaatcccagctacttgggagactgaggcaggagaatcccttgaacccgggaggcagaggttgcagtgagccaagcgcccctgcactccagcctgggcaacagagcgagactccatctcaaaaaaagaaatgagtggaaaggtaggcataatcaagacaataaatagtcttgtgtaacatgcaagagtttgaactgtacgtggatgggaagccactgaagaattataagcaagggaattacaccattacattgtgctttaaaatatttctcaagtaccatttggaagaggtgagttacagtaaggcaagaatggagtcgataagtgagtaatgatgcctctcctacaagatagcatgaagatgacaggagagacaagatgcctgagctagggaataggattagggatgaagggatgaatttgagagatgtaagtgttaagtgcagtgtggctaagactcatcgactatggaggagaaggaggaagaatccagattgagttctgtcttggatagctatctttactctgatgcagttatccaatataggagttttagaggataggaaaggggtagaatataagtttgcaactgaagggcatgtgagtaaattatatgcagtaggaactggagcttaaaatagataccgagtttgaaattatgcattttgatggtacttggacccatagaagtagaggaatttataggactaaggtgaggggtaaaaaggaattagaacagaatctttggaactctgaagatggaaagagtggctagggaaagaaagaaccagaactattacactgataaaacttctactatttacagcctctttcctccttcttccctgtgtctttaacatgagactaaagccaggaaaggattgggtcccaggaaaccaagcagggcttttacactggttagggtacttgatggaacttttcactacagaatgcaaaactctacactctaaacagttgctgctccccaactgaaaactcctactctgggaaaatgtctacactgtacctttattcacattagtcttgccttgacattgtctgttactcctgtgcagttatgaccacaatcattattcttttttttttttttttttttttgagacggagtcttgcagcaatgccctggctggaatgtagtggtgccatctcggctcactgcaacctctgcttcccaggttcaagcaactgtcctgcctcagcctcccgagtagctgggactacaggcacttgccaccacgcccagccaatatttgtatttttagtaaagacatggtttcaccatattggccaggctgatcttgaactcctgacctcaagtgatccatccatttcagtcttacaaagtgctgggattacaggtgtgagccactgtgcccaaccaacattaattcttttttttttttttttttttttgagacgagtctcgctctgttgccccaggctggagtgtagtggcatgatctcggctcactgcaacctcacctcctggctttgaacgattctcccacctcagcctcccgagtagctgggattacaggtaactgctatcatgcccagctaatttttgtatttttatagagatggggtttcaccgtgttggccaggctggtcttgaactcctgacctcaggtgatttgcctgtctcagcctcccaaagtgctggaattacaggtgtgaaccaccacgcccagcccaatattcattcttatgagtactctgatgcaatttctagcccatgtattaccaaagatcagatattcactatatatagtaatagttacataacaatgtccaaaaaaggtgtttaatagaaaggagaattttttttaacttttattttaaattcaggggtacatatgcaggtatattgcataggtaaacttgtatcatagggtttgttataccgattattgcatcatccaggtattaagcctggtacccattagttatttttcctgatcctctccctcctcccaccctccaccctctgataggccctagtgtgtgttgttcccctctatgtgtccgtgtgttctcatcatttagctcccgcttataagtgagaacatgtggtatttggttttctgttcctgtgttagtttgctaaggataatggcctctagctccattcatgtcctggcaaaggacatgatcttattcatttttctgactgcagaaagcagaatttataatctgagtaatgccataagatatataaatagcggaaaaataactttacttattgatagacaaattctttatgctggaatatttttatgttttctagactagtgagtgtggagtaattagcaatatgaggttcaaagtttgggtaaaagatttatttttgtcttggttttatttatttatataatatatatatgatatgtatatatagtatatgtatgaatttatttgtagctctgaagatggctgtggtagatatctatcattccaggttaaaggagagacaaagacgaaaaaagtaagtataaaaaaccatcctggcctcctttcagctttggattattgttttttgtgtgtgtgtgtgtgtgtgtgtgtgtgtgtgtgtgtctgtgtctgtgtctgtgagagaggcaaggtctcactctgttgcccaggctggagagcagcagcacaataatggctcactgcagcctcaacctctcaggctcaattgattctcccacctcagcctcctgagcatgtgggactacagcagtgcgccaccatgcctggctaattttttgtattttttgtagatacggggttttgctgtgttggccaggctggtctcaaactcctggacttaagtgatcctccctcctcagctcccaaagtgttaggattgcaggcatgagccactgtgcctggcctcagctttgagtgattgaccacatatagtccatgagagaatgctccacttgtgactcatcttttgaccttggagaagactcttaccctccttagacctcaatttttccttctctcaattgaggatagtaattcctgtgttatttttatatcctctgcccttatcctttattgacgttatgatgaacaatgaataatatgggtacactgttttaagctatttgaagtaaaagaacaagataaaataaaggcatcaagacagtattgttacacttttttttttttaatatttgtgaatcattctttgcttttgtctttttttttttgagatggagtctcgttctgtcacccaggatggagtgcagtggcgtgatctcagctcactgcaagttctgcctcctgggttcatgtgattctccagcctcagcctcccaagtggctgggactataggtgtgcaccaccacgcctggctaatttttgcatttttaatagagatggagttttgccatgttgtccaggctggtcttgaactccccaccttaagtgatccatccccctctgcctcccaaagtgctgggattacaggcgtgagccaccgtgttcaacctttttttttttttgttaaataagagacagagtctcacacttactctgtcacccaggctggagtgcagtgtcactatcatggctcactgcagtctccaactcctgggctcaaacaatcctcccacctcagcctcccaagtagttaggactacaggtgcgcaccaccacacttggctaattttaaaacctttttctttttttagactgggcgcggtggctcacacctgtaatcccagcactttgggaggccgaggctggtggatcacctgaggtcaggagttcaagaccagcctgaccaacatggtgaaaccctgtctctactaaaaatacaaaaattagctgggggtggtggtgcatgcctgtagtccaagctactcgggaggctgaggcaggagaattgcttgaacctgggagacggaggttgcagtgagccaagatcacaccactgcactccagcctgggcgacagggtgagactccgtctcaaaaaagaaaaaaaacctttttttttttttttgagacagggtctcacaatgttgcctgggctggtcctgaactcctagactcaaggcatcctactgccttggcctcccagagtgctggaattacaggtgtgagccactgcactcggactgttaggcttttttattttatttttattttttattttattattattacttttgagatggtcttgctccgtcacccaggctggagtgtaatggcgcgatctcagctcactgcagcgtctgcctcctgagttcaagcaattatcgtgcctcagcctcccaagaagctgggactacaggcacgtgccatcatgcccagctaattttttatttttagtagagacacagtttccccatgttggccaggctggtctcaaactccaggcctcaggtgatccgcccacctcagcctcccaaagtgctgggattacaggcatgagccactgcccccagccctattgtgcttttttaatgttctctttctaactgttcattttttaatgagaagtctttcatctaaaaggatttcaaagaaattctgaacaagtttcaggcatactggttcttcctctctttgcaacatatcaaaaagtatacattcagacttagaaattatggatctcagacctctgttggtttcagagaagagtatgcagagggtataagtgtgcatgtgtgtgtatgtatgtgtaggcatgtatttactgtgatgttactaactgtagacacagtgatatctcagcaataaaaaggagagaagccaggtgtggtagcatgaacctctggtcctagctacttgggaggctaaggtgagaggatgacttgagcctaggagttcaaggccagtctgggcaacctaggaaaaccccatctcttaaaaaaaaaagcaaaagaaaaaaaagggacttgagattcactctggaggaactaagatgtgatctaaagcagcagtcctcaacctttttggcatcagggagtggtttcatggaagactgtttttccatggatggctgggggcaggaatggttttgggatgaaactgttccacctcagatcatcaggtattggttagattctcataaggagcacacatcctagatcctccacgtgagcagttcacaatagggatcgcgctcctgtgagaatctaatgctgccgctcctctgacaggaggcagagttcagacggtaaagctgctcacctgctgtgcagcctggttcctaactggtccatggcccaggggttgggaactcctgatctaaagtaaaacttactctctgcatgtctggagttagcttccatgaaatgctgaagaagcatacccagttgctcctatgagaagcttcattgctagttatgaatacctctggtataaatcagattcaagacacataactttgcctggtttaaattctcttttgcttaaaacacaattcgagctagagagtactgtagaactcagttgctgatgttgctatcaaatcttttgttttataatgccctttcattaaacatgcacaatatttatttctagtaccgccagtgttgtgtgaatgcacagttgtaaatgttgaatatgtgatcatggtgccctttagcagatttctctaaaatggctgttctcaattatttccacaagctgaatagattaactttatgacatggacagagattcctttcggtttcatcttaagtgacagacatgtgtttttcagcatttgtgagtggttattgattcattcattcgttcagcaaatagtcatggagagtctactatgcccaacaagaggaaaaacccgtgatgcctgagagtctaaaattgggttagtgattcactgacctgcagaaatttgtgggagtgacttctttggacctctgtattgtattccacctcagcatgtttatgtctgatgatagctatatgtgtaaagcattagtaaatgtgaaaataattctaatgcacaaattattgtggcttttcattctagaattataagagaccatggattaatcaaccttagaaagtttcaatgtaagtattagcagttttctttattttacaatttttttccaatattattgaataattttaaataaatcacgtattgtagttcttaatccaagttgcatattagcctggctatcactccagactaatgaagtaagaatctctggggttggaggcacagcacctgcatttttaaaaagtcttcagggcaattctgatccatagtgagagtttaaagtattaatttggggccaggcgcggtggctcttgcctgtaatcccagcactttgggaggctgaggtgggcagatcacgaggtcaggagatcaagaccatcctggctaacatggtgaaaccccatctctactaaaaatacaaaaaaaaaattagccaggcgtggcggcatgcacctgcaatcccagctactcaggaggctgaggcaggagaatcacttgaacccaggaggtaaaggttgcagtgagccgagatcacgccagtgcactccagcctgggcgatagagcaagacttagtctcaaaaataaataaataaattaagcaaataaataaatgtattaatttgtagtcaataaaacttgtattaaaattcttttttaaaaatttgtatagtaattacagtgtgaatattaatgaataattttctggatagagtcatgttttgcaactatgtgttaagcataacataaccttaatcttcaggttgtaaaaatattttagataaataacagaaagtgatctttattttggatggttatagacagacaaaataaatgatatttaatattatatgacggtgataaaaatacatatagtgatttttaaaataaatgccacctttgaccttactgtggttttttgttgttgtttgttttttaagagacaggttcttgcactgttgcccaggatggagtgcagtggtgtgatggtatcttgctgcagccttgaactcctgggtgcaagtgatcctcccacctcagcctccttattacaggctcgagctatcgtgcctggcctttattattttaaatatcagagatacctaagcagggcagaaaaagtccctgtactttttcttcttccacaacatagaggcttccacaactaagaaggatgatgtcataataacaatcacaatgtttgtattaaaatatttgtaatagttgtgtgtcataatattctttttttgtaaagaataacctaatggttaggtttgtacaataacctaatggttattgtaaaacatcccagttgatagattcttgtaggggtatttatttaataatatatagcatcgtagggttcagtcaacaaggttaagtgtctttttagtgtaaataaatatctagccaggcatggtggcttgcacctataatcccagctacttgggaggctgaggcagcggatcacttgagcccaggagttcaaggctgcagtgagctataatcatgtcactgcactccagcctgggcaacagaaaatctatattttttaaaaatatagccatcatcataagtatgttacattttaggtcctttattatttatttattttttgagacagggcctcactccagttgtccaggctggagtgcagtggctcagctcactgcagtctccgcctcccaggctcaggtgattctcccacctcagcctcccaagtagctccatctctactaaaaaataaaaaaaattagccaggtgtggtggcaggcgcctgtagtcccaactactcaggaggctgaggcaggagaatcgcttgaacccgggaggcggaggttgcagtgagccaagatcgtgctactgctctccagcctgggcgacacagcgagactccgtctcaaaaaaaataaaaaggtaagctaggaaaaaaaaaaatagctgtcataaatgaaagtctgtatcgttagtccaagagtagatagaactaacctaattactgattgaaacgacccaagtagcagttcgagagttactgactgctccaatctaccagttattgttagtcagttttactctccatcttctttgcagatacatctttggattagttgtttggtcagtagtgatccccagagttgctgctctggtgtctctgcatgatatttgcatgacagttgtcaaataaaacttcattagcagtaaattaagttgtagtagttaatttagtttggagaaaggtaaaatgacccatatgaaggatgaaaaaaatacttaccttgcttgaggatgtgtaggtgggacatgcaagaaatcacactttttctcagctaatgggaaatcttctggatggattattttgtctgtagcttctttgttttcctgtgggagttaataccataaattttggccataattcttcctaagaatgtaagatctgcctttaattgtctcgtccattactgccagcagttcctgcccctgtgtagtttaaaagacagtgaggtggccgggcgcggtggctcacacctgtaatcctagcactttgggaggccgaggcgagcagattgcctgagctcagtagttcaagaccagcctggccaacatggtgaaacctcgtctctactaaaatacaaaaaattagtcgagcatggcggtgtgcctgtaatcccagctacttgggaggctgagacaggaaaattgcttgaacctggggaggcagaggttacagtgagctgagatcacaccactgcactccagcctgggccacagagcaagactccatctcaaaaaaaaaaaaaagacagtgaggtggctgggcgcggtggctcatgcatgtaatcccagcactttgggaggccgaggcgggtggatcacctgaggtcaagagttcaagaccagcctggccaatgtggtgaaattccgtctctactaaaaattcaaaaattagctgggtgtagtggcgggcgcctgtaatcccagctactttgggaggttgaggtaggagaattgcttgaatccaggagatggaggttgcagtgcgccgagatcaccccaacgcactccagcctgggagacagagcgagactccatctcaaaaaaaaaaaagacagtagatgtgggagatgagtagtgctcagtggtggagatgatctccagtgttaacaacatccctgtgggatagttgctatggtgctgtcattatgattagtgttttgcattcttggctttcctgtttgcttcctgtcatggataagttagtcatatgaggttatgaataatgttcttccattttactaattgtaaaaaaaaaaaaatgctgaaaactcagggatccttacatttcccatgacacatttatgttttattttctctgtagtaatggaacggcggtatcccaaggaggtccaggacctgtatgaaacaatgaggcgatttgcaagaattgtggggccagtggaacatgacaaattcattgaaagccatgcatgtaggtggtttttgagccttgagcagtatttgtgtgtgtatatttatataaataggagagataatggtgtgttttatgtgaagttctataaataaataaatggatatttctctctttgttcccctttattaccatgagacaaatttgggactatgggggtggcagaagagaggttaaaaagccctaatgacttcccccattgccccagataaacaataatttagtagtttttctccctactttgtatcatgggaactttcaaatatatatagaagtagagataataatatgatgaactcccgtgtatccatcatccagcttcagcagttttcaacacatggccagtctggtttcatctttaccactcactcttccctcctgccctcaactggattattctgaagcaaatcccagacatcattttattttgttcataaatattttagtattaaaagtagttttaaaaatgaggacagagatggatagcttgtggagatagtacttccatcgatctcttgcctttctgtggtatttctatgagagctctacatagttaccatttgatttttcactataaaaaattaaaagttgttatgaggccgggcgtggtggctcacacctgtaatcccagcactttgggaggccaaggcaagaggattgcttgagtcgaggagttcgagaccaatctgggcaacatagtaaaactccatctctacaaaaatacaaaagttagccaggcatggtagtgcacacctgtagtctcagctactttggaggctgaggtgggaggattgcttgaacccgggtagcagaggttgcggtgagctgagatcacaccactgcactccagcctgagcgacagagtgagaccctgtttcaaaacaaaatatgttggtatggcagtaaggcctagattgttaaaataatatggactctggcttgttctgtacctttcatcatgacatttgtgtatgtggcttctaagtttagttctgggaaggtagtctactaaggcccttattctcaccgtgaaaatatttcttacatagcattgcagacatttatctgagccaggttggttgtcctcaccaaacaccttgtttggttagcattctttgtgtggtttgtaccaggtgactgatcctttacttcctgtcccagtttgggacacacccctggtttatgtgtcattccaaaacactacaccccatggattgtccaggctcttccttcattctctgtttcaaaagcagccaaattagaatgatttgtagaacttttaatagaagatagttagagcagggaaacttggttgttaaaaaaattatattttgcccagtgcggtggctcattcctataatgccagctactttggaaggccgaggcgggtggatcacctgaggtcaggaattcgagaccaacctggccatcatggcagaaccccatctctactaaaaatacaaaaattagccgggtgtggtggtagatgcctgtaatcccagctactcaggacgctgaggcagggggaattgcttgaacccgggaggtggaggttgcagtgagccgagatcatgccattgcagcctgggcgacagagcgagactctgtctcaaaaaaagaaaaaaaaaattgttacttttgtagacaaatgaatttaaccatttcactaagttttctagaagacagttccagctgctgcatctggagacagcagctggaagatagctggagtaggttttcctcagctcttgggtaaaatttctaatgagaagttaccaacgagtaggattctccaaatgaacttccctagtcttataaggcagaattaatgaaaatgctcaatagcaaaagtgctcactaatgttgcttttgtttttgtaattttttccttcattccttttggggaaaacagtggaatttgaactccgaagggaaatcaagaggctccaagaatacaggacagcaggcattaccaatttttgtagtaagtatgcttcagctacataccgtacttgagggcaagtatcttccagacacacagaggaagtctctgaattgttgtgaatttttttttaaaaaacaagctttcctttaccagaatgctttaaacctttccagtaaagttttggctatttaatccctataaatacctttgtatagattatctttggtactacaaaagttgtgagacaaaggaaagagaggtgctgctttagatttaggattctgccgaggctctttaaaaaaagggaatcttgggccgggtgcagtggctcacacctgtaatcccagcactttgggaggccaaggcaggtgggtcacttcagtccaggagttcgagaccagcctgaccaacatggtgaaaccctacctctactaaaaataaaaaaactagccaggcgttgtggtgcacacgtttaatcccaactactcgggaggctgaggcacaagaatcgcttgaacctgagaagcagttgttgtagtgagccaagatggtgccactgtactccagcctgggcggcagagggagattctgtttcaaaaaaaaaaaaaaggaattttatattttaggtgtgtcacccttttcaaatttaatgatacatggtcttagcatttttataaaataatgaagcttcaactggctccaggtgcttgcatcccagttacttggggtagtgacaataattatattattagcagctaacatctatcagatatttaccatgtaccagtctctatgctaaccatttcacttggatcaagtcaatgaattctcatgacaaacttataaagtaccgttacttccatttagtgaagaaattaaggtataaagaggttacagagctagttagtactagaaccaggtcataagagatagtgtattatagtagttaagagcttgggtctagacttaaaaagcttgagtataaattttggctctccagcttgccagctctgtgatgtgattctatccaaatttatttttctttccttttttttttttccctagagactgactcttgctatgttgcccaggctggtctcaaactcctggcctcaagcagtcctcccgcctaggcctctcagagtgctgggattacaggtgtgagcaactgtgcctggcctctattcaagttttaattttctaaggttcttagagttagtgtaaagatttaattagagatactgcataaagcatagcacagtatctggcacacaataattcctcaataaatggcagtttctgttgttttgctgtcattgttgaaatgatctttagcattccctccttcttcctatttgaagtttttgtgattattgatagctgtcacctactatctataagaaatagttggcttcttttttttttttatttgagacggagtctggctctgttgcgcaggctggagttcagtggtgccatcttggttcaccacaacctctgccttctaggttcaagcgagtctcctgcctcagcctcctgagtagctgggactacagtcatgcaccaccatacccggctaatttttttttttgtatttttagtagagatggggtttatccatgttggtcaggctgatctcgaactcctgacctcaggtgatccacccacctcagcctcccaaagcgctgggattacaggtgtgagccaccacgcccggcaatagttggcttcttaacacagccctgtgggtgcaacatagccttatggatgtaagttcagcctagtataatggctctttaacagtggaaaccatttttgaaattaaattttgtgtgagccccaatctacaaataagataaaagtgggctgggcacggtggctcacacctgtaatcccagcactttgggaggccgaggcgggcggatcacttgaggtccagagttcaagaccagcctgaccaacatggagaaaccccgtgtctactaaaaatacaaaattagctgggcatggtggcgcatgcctgtaatcccagctactccggaggctgaggcaggagaatggcttgaacctgggaggcggaggttgctgtgagccgagatcgcgccattgcactcaagcctgggcaacaagagcgaaactccgtctcaaaaaaagataaaagtggaattactttggttgaactttaatggttcaatttatgtgtagagcccaggacccgccggtatctggcagtgccctttctctttacattaacctctaagatactcttgtggtatcctggggctctgtggaacctagtttgaattttgaaacccactggtgcagtattttggaatctgtgaacctttgttaacatgtagaaaacaccacgcagctcttctgtttagcaagatgcatatagagactctgataactaattttggtttcctgatattggctgcctctaagaaatatggagaagaggtactacatgtcaaagagaactctttttttgtaattctaattgttttttaaggaaaggcatatgcttatagcacttgtgtgactttgaaaaaatttataaaaatagaaaaaacaggaagcaaatatgactatagtaaaagttggttactttttgagagtggaaatatgagcaattcttactttctttgtacttttctgttggtttttttccccttatttcttacagatagaaaaggaatacaaatatttaatatttaatacttagtattaagaaaaggatttcagactagggaaaatctacttgggtcttggagaaataattgtgaaagcagttttgcaaaggaaacagactttaagaacaaaacccaaaaccggtttcttggtcagttaggaagcccttcagttctgctgcattgtcattgtggtcattgtgttttctatacccccaggtgccagaacctacgatcacctcaagaagacacgggaggaagagcgccttaaacgcactatgctctcagaagttctccagtatatccaggacagtagtgcttgccagcagtggctccgccggcaagctgacatgtgagtaattactccagggtgaaggaggcattctttctgggatgccttggccttcacatatatttttgggcaccctagatggcagagtaataataattgagtagctggaagaattcagaaatattttagcagtccatctcagaaacagtgccatactgacagttttgagaaataactgacctcctagaatcatactttactactttgatcctattttttaaaatgagtgtattttcccccagccttctacccatgacttcaactctctcttcatacctagattttcactggggaatcatgtttgtatcccttccccttgagtggtgttagtggtgttctagattacaagctcttcttaacaaatctgaggaatttttcttcctcagaacagattttctttcctgctcaatacagtgagatatctgtaaaacatagttcagtctatctcattacacttcttcaaggtgacctacctgataaatggcacccagtctcaccggggcttttggaaatcaccttgtttgatatgacctaagtttaaattcctcttcttcgttgtagtgattccggcctgagtccttccattccaatggcttcgaattcaggtaattatttctcaggccagaacaagtcttaattgtgaagtttgcatcgtaggggttatagtgacccagcaatcttccttcctctgtggtgtcagggtgcttaggcagagtaacagtaatcaagtgttagcccaatatataaacatcagtatgttttcagaaccttcatggccagacagagactatcctcagagtgacagtatagagtatagacagtatagagacaggggaaaaaagaacttcagagaggtaacttctttattttaccaatgttcatgagcagttagtttactgcagttgtgtctaccactaattttgagacttatttcacaggagataaattaaaagctttttattttattattttttatttatttacttattttttgagacagagtctcggtctgtcgcccaggctggagtgcagtggtgtgatctcggctcactgcaacctccgcttcccaggttcaagtgattcttctgccccagcctcccgaacagctgggattacaggcatgcaccacctcgcctggctaatttttgtatttttggtagggacggttttgccatgttggccaggctggtctcgaactcctgacctcaagtgaggcacccaccacggcctcccaaagtgctggaattacaggcgtgagccaccgtgcccagcctaaactttttatttttatataacatgagcaaagaagcatgttacttgccagaaacataaggatttctgagttagagacctaaagtatttctatttcttcgttttacctctttgagtatgtcctattttgaaattagtatacagagcaagattaagccatacgctatctgatgatccttggtgattggtaatcgatgactgggaattgggggaggtatgtctcagtagattcagaatctgggtctcagatttgtccgcgttagggacttttttttttttgagatggagtctcgctctgtcacccaggctggagtgcagtgacgcgatcttggctcactgcaacctctgccttccggattcaagcgattctcctgcctcagcctcccaagtagctgggattagaggcgcctgccactatgcccagctgatttttgtactttcagtagagatggggtttcgccatgctggccaggctggtctcgaactgctgacctcaggtgatctgcctgcctcggcctcccaaagtgctgggattacaggcatgagccactgcgcctggtcactgaagggacttttttttttcccccatttattcctttatttcaagtgattttttcttaatatggaaagaagaaaaaggtattgttttaggggagtggctaagacagtgaaatcaaagttttattttgtaagtttcttactgccaacactctacccccaaaatctaaatacaactaagttaatactggctaattaaaatgaaggaactgggtcaggtgcagtggctcatgcctgtaatcccagcactttgagaggctgaggcgggcagatcacctgaggttgggagtttgagaccagcctgaccaacgtgatgaaaacccatctctcctgaaaaaaaaatataaaaattagctgggtgtggtggtacacatctgtaatcccagctactccagaggctgaggcaggagaatcgcttgaatccgggaggcagaggtttcagtgagccaagatcgcaccattgcactccagcctgggtgacagagttaagaccatctcaaaaaataaataaattaattaattaaattaaatgaaggaactggctaacatgatcatatatttttgttctctgtactatctgcactgacttgttcattgtttcttttttctttttttgtgagacagggtctccctctactatccaggctggagtgcagtatgtgatcatggctcactgtagcctcaaactcccaggcctaagtgatcctcccagttcagctcctgagtggctgggactacaggtgaatgccaccaaacctggagaaattttttttttttttttttttttttttggtagaaacaaggtcttactatatcacccaggttggtcttgaactcctgggctcaagtgatcctcctgcttcagcctcccaaagtgctcagattacaggtgtgagcctctgcacccggcctcttgttcattgtttgttcctagcctgtgttagcctttctcaccccttatatttaggctgaggagatctcttgctctcctttatgttctgagttcttaaggcatctatgtattggaagcctggcatctttgattgtagcctagcctctggtgacttttgtgaggaaccaaatggttttatctccctttttgaggatttggaataatcccttatgccttttgttgatgtaacagagaagcctgttttccaccagtggagcttgtaacagtccctcccctttctctgccccacttgaaaagcaacctctataaaacttcgacattttctttgcttaactcagtctatccattcccagctgaataccaatccctaatacacattcaaaacaaaaccaaaaaagttttgctcatcaagcttcccctcctggccagtgacctcctacttgggtttctttctcaggtgtgtgagttgacctcagcccctgctttgccatataatggctcattgttcctgtttgtggatcttgcaggtaaacagggctactttggaaggaacagatattccctcacataataaaaaagaagggccttttgctggcctaacagtctttctttgatctgaaggcacacagtacttggttaattaccatgtttgccttgtactgctggccgagtggcaaggattagggaatgtctgttctgcagttattatttccattcgtcagctgtcaaagcaggcattgtgtgatgtttcttaactggatgacatctgggcatcagattttagagtctcctacatggttaggaagaaataggtgatagtcgggcatggtggcatatgcctgtcttcccaggtagttgggaggctgaggcaggaggatcacttgagccagggagattgaggctatagtgagctatgatcgcaacactgcactccagcctgagcaacagagtgagaccctgtctcaaaaataataataataaataagagataactactgtggtgagtagttacatttgatgctaaggtatgtgtgactgtatgtgtattttagcagattatgggtaattcatgtgccctgaatatgtaattcattttcaagtgaatgttcgggtgcccatgttgttagctaaacaggcctgagggaatgggacaggatttcctaagctggatatagtgatcctatacctaactggcctggctgcactgaactttttaatactttacacctgagaaattgtcactcctattaaatctatgctgtttcctttctctgtctataggtagacggagtgcaccacccttgaacctcactggcctccctggcacagagaagctgaatgaaaaagaaaaggaggtaacaaaagggagggggctgggagaaagagaataggggctgattattcattgagttgtcattaaaaatccattacagggtcaaaccccttttgtttcattcatctaacatatatgcacagctctggtgaatcctagaagtccaagagctaaagagccgtttgtggcagatttcagagaattgcttaccttgtcaccctaccaccattcctcttttggggaaagcacatgtggtatgtagatgacataataatagcaactatcatctattgagcacttaccatgtgctactctactaagtgctttatgtaaataaaattaattttttgtaaacctaaagtaacttttacatgaaaatagatatttcctattagaatggctgccttgaaaagttctatacttattccaacaacataatcattatttaaaacatttttgtaaattgtctccagagcatgtttataaacctaaggaaaagatttctacatcatatatagtcatgttaattttgattttaaaaattattttttatttttatttttttttatttatttattttttgagacggagacttgccctgtcacccaggctggagtgcagtgatgcgatcacagctcactgcagcctccacctcccaggttcaagcgattcttctgcctcagctccccgagtagctgggactggactataggcgcttgccaccatgcctggctaatttttgtagtttttagtagagatggggtttcaccatgttggccaggctgatcttgaactcctgacctcatgatccatccaccttggcctcccaaagtgttgggattacaggcgtgagccacctcacccggcctattttttattttttatttgaaagtctcgctctgttacccaggctggagtgcagtggtgtgatctcggctcactgcaacctctgcctcccgggttcaaacgattctcctgcccctgagtagctgggactacaggcgcataccaccacacccggctaatttttgtatttttagtagagacggggtttcaccttgttagccaggctggtctcgaactcctgacttcaggtgatccactcacaccagctccaaaagtgctgggattagagatgtgagccactgcaccggcctgattaaaaaattatgtgacctactttttccagttgcaatcatcagacatgtcttcatattgattttatctgtttctaaaatttaaagccagcctcataagagtcatcatcaggagttttcagaaaactttgtcacatctctgaagtctgttcctcttttggaggagttcctcttttgctcctcatatgctccttttataattcccaaggtcagttccccatctcccaccatatatcattagttcagttcagataataaggaagggtcatagtgtaggggatagtgttagtcttattttatccaccaggaacagtaaggattagtttgggagtggaaggaaatgtatgtagtatctatgtattgctgaaggaggtcataggtcagcctgattcaaatattgaatggcctggaatttcaagctttttttatccttacccacataatggtgacctcagactcctcattgctggataatgtggcaattttctagatttttagcagttaaagttacctcctcttagcaaggtctctttatctcctttccctttgaagtaggaaatgtaatccccaaagcagggactactgctttatgctgacactaaaaacaatgtgatgcagccttgagaatccaagtgtctgtgcattcttcccccactgtgccccatggctcttccctgaccattggtgctgggactgtacctgggcatttagtgtttgactcctgaaagagccaggctgctcctcaggagcacatagttgtaaatccctaacaaacccaggcccctgagccagctggcatgtgctaaaggctcttctagtatcacaccctggctttctcttcctgggtgtgtgtccttagggagtgttctctccagagaggaagagactaaatggaatgtagtccagccacccatcagctcctataaatagttggaggttgatgtcactttaaaaaattttttgctatacctgctggattaaattacaaaaatgacagatgttaatgtttattaaatttgccgtgtcttgcagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaaggctaaggctccaagagcttgggatcagaagtcagaagtttggaatgtggtgggtcaaaggacaatatgggtgggcattctggagagttgtttttcagctgaattctcatggtgaaaacaggggaaaggacaaaggaaaccttaagttgtattgtctactttcttctccatcctgctttaaaacactcctgttgttggtattatgctgcagagttgtgtgctacataagctattattaaatgtgagtgggcattcattcctaacacctcttgtaactaaaagaaccatagtacctcacatcacagtgctggtagaaatggaactaaaccacagtctgtaatcccaggagtccagctcagatccttatattgcgaggtaagtttgctgattatctgtcttgccttcaaacactgcagacagatttaaaataaagagaaaggttttagagcataagaaagctctcgttgaaggattttttaagctgacaactttttttttttttttttgagacagagtttgctcttgtcctccaggctggagtgtgatggcaagatctcagctcactacaacctctgcctcccaggttcaagtgattctcctgcctcagcctcccgaatagctgggactacaggtgtccaccaccacacctggctaattttgtatttttagtagagacagggttttgtcatgttggccaggctggtcacaaactcctgacctcaggtgatctgcccgcctcagcctcccaaagtactaggattacaggcgtgagccatcgcgcccggcctaagctgacaacttttatgagtaaaggggaagaaaatatccttatgatggtcttatcccaaactgcatctttaacttcggccgggcaaggtggctcacctgtaatcccagcactttgggaggctaaggtgggcggatcacgaagtcaggagttcaagaccagcctgaccaacatggtgaaacagtctctactaaaaatacaaaaattagctgagtgtggtggcacacgcctgtaatcccagctactcaggaggctgaggcaggagaattgcttgaacacaggaggcagaggttgcagcgagctgagatcacgccactgtgctccagcctgggcaacaaagtgagactctgtctcaaaaaaaaaaaaacaaaaaaaaacctttaatgtctggctttgtactttgcagtctgcctgtctaatctgcagtagtcttttgaggaggtggcaccggatataacatgtctctgttatttttagaattaattaaaatgttttgctatttaatttgtgggtgtgtcaaatattctggtaactgaaacacacttaaggtgttggatgcctgccccatcacgctgcactgtctgctgtcacatgtgtcctgaactcaccctgtttttgccctgggtttcccaggataccaagcccctgaggatggagatgatgcaacaaacctcagctttgcttggattgtgacttgaaccctatttctcaatggtgaaaggctagcctgcaataaaagctgcttttaaaacagaagtaaagcagctttatatatgggactcactagatatgagggtaagtagccccaccacatgtaaaacttggtcctcaaacgtttctgcagaataagaagccaaacttatggttatcttgtttctgttagaaacaaagttgtatatagaaataacttcgtcagaatcgacacaaatcacatcgaatagttgactgtttaattccttctacattcaaatatctaattaaaatactgtgtgctttgttggaagcatctgctcaaacttttgactgttgtaaatatgcatgcagctgggaagggattcatctaagggataagaaatgaaaaagacactctaaggacctgagggaattcaaatagaggacttcgattttttaaaaagaatgacgtggaaatgatctgttttccttgtaaaatcatatctcgtagaaaacattttaccactaccatcacccctagttggtt

SEQ ID NO: 15467 - DNA, 33721 bp, Human
gaaattaaagggaattaaagaaaagctggcaaggagtaaggaagggaaaagtttatatttttaaaaaacctaaagtgactgatgtattcaaattcctggattatataatcttcaaggaaagatacagacttttcctctattctggaataatgatgatggtggtcctagggctgtctatagatgtccaggcccgagcagtctgtttcaccagtacaatcccagttaaaatgcaagtctgaggggttgtacaggccatgatcatagagatcctggagagatcccgctggtatatgcactgggccttgaggcaggcaaaggtgcaatttctaagtgatcgtgtatcctaggggacaaaatttgtcccagaaaaatcatgaagtaggcaaactcccctgggcttcagtgaattcttttctaaaattaagagattaagttctaaaaatgcaagaactccaagatggcttggagttttttatacactgtatacctaccttacagggatgcatgcagggtgcttggtacagggcctgacacagagtaagccctccatgaaaggggtcggtgataatgatgctgatggtgatgatattcttggttgcccagtatcccctatctacacctttcttccacctgcagtcacctactgcaatatcttccctgtaccactttaatatttttgttgttgttttctttatttttttaagctgtacacttttattgaactggtcttgtcaggtttgttattttttaattaaaatctattatactcttacttacctgagccacccttagttatgatttaaaaaaaaacaaaaaaaacagggccttgctctgttgcccaggctggagtagtacagtggtgtaatcagggctcactgcagccttgacctaggctgacgcagtccttcagcctcagcctcctgagtagctgggactacaggtgcgagccaccacgcctggctaacttttttttttattattattatttttgatgtaccactttaaaaacaaagtcaaaagaaactactgtagatctcacattggtagagtcaatttgagacccttgcctcggagaccagaacctggtgtaactttctcttaacaaaggttaatagccagtggggggtcagggttggaactcaccgaatctgcatcacatagaatcaggtacctctcacattcacgaaagtgaattatttttaatgaattgtgctgacagtatgcctcttgcaaaaagaactagccctagattcttttctagctatcaagatggaaaacaaccacatcgttaattcagacggaggggtaaaccaagttaatcagactccaagacccatactaattgttgaccaagtaatgccacagtattccatggctaaggatttccagcttgttccagtccctaaaaatctgttctgcacagttaatatttcacaaaaccaaaagggcttagttgcaagcacaaagagctagaaatcaggagacttgtggtttctattgagttctatcattatctgtctaataagataaataagtcacttctctgtaactcagtttccacatttgtgaagtgagggaagagaaacatgtcctaaaaaccatgcaggggctctggaaagaaaaagagctaagaatggtgggttttttataaaagttacacaaatgaatggtttttgtctccgtttttctgaaagtgggttaaaaatagcctccaaataaagctaaaagaatttatttagactaaattgcaccagagaagtagaggaattaagagatatgacaagcaaagatgggatgtttcaatggaagaatctcaggcagtaaaaaggctatgctgtaaaaccagaacttttgttagcactgcatttttaagatgaattggtcatagttaatgtattggatggaagaatttttaaacatctgccccaaagtatgctgcatccaaaaaatatataacaaaacgaattcttactcatttgtgtttattcttggacttatcctgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaaggccgttctgactggcagggggagaaagtaaacagagttgaatcaccctccccactggccaattggagggggtttggtttgtgacgtgatgggattctgcgaaattgttactgagcaagagaatgccggaacggtgcggaccggccggagcaggggttcagaagccgtcagtggactcgggaaaaagtgtctcttagacctggcgctcggcgggaccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgcgccgcgccgcgctcgtcgtccgaggccagggcagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggttagcggcgtcgccctctcccccggagctctggggttagttaacctttggccaggcagcgttcctgggcgttcgggacactgcactcggccgaaagggtgcaaacatgttggataagatgcggtttaactctttaaataatttaaatgtgcattggcggaaagctcactctctccttaattgtccccggcctccgggagccacggagagccttaaactggcgggcagagcgagtgcggtgcgtggcttcgcggggagtggtgtccgcccctcccctgtcccgccccgcccccgggactctcccgcaccccgcgacggtggggccaccccacctgggagacgctggcagcggggaagtcagatggcgtatcttttatttaattctcttgtcgggttgcagagaagtggttgaaaccgaggggggacgcggcgcactttacttcgagccttttagggatgactaaggactcatttaactggatgcctgctacttttttgggcttgccaaggtggttttaaatttggctgggagtcccccgagaggtttaaaataacccggcttcaggcagcataggagtctgatcaagtaatggtggttaacttcactcatgagtcctcctgatgagccaggtttcagagctgacttttttttttttttttttttttttttttggccatgtgacttaggtcgcaccctccacccctgaatcgcggtttgcagggaggtgtggtccttgccggaggtcaaggcttggtaatgaatgttgggcggttctggaggcctcagggaatagttcctcccagggagggtgagaggcatggccgtacaaatgaatgtggccagaaagacatctatctgccttttaaaatgggctttggagacttccagggacctgggtcatccaattctgttggttgtgtttaacatgaacggtaaaagttggaaagcattcacatttggacatgctgtcttgaccatcttcggaatggttcttttacaagcgccattcagaggtagcggggcttggtcctctcagataagccttttgcctctgtcttgtgacaccgtgtttgagagggtattgttggagttagttggaaaagtgttgtcattttttggtgtaatacctcgatacttttaagatgaggtcttgggcctgtggtttaaaaatgatacatggaaaaaaatgatacttgattggggttttttgttttgttttgctttcctttttaaaagaaaggccacgtaactgcttctcattccatttcctttggaaacttgttcttgtggaggtggctgctggcaccggaatcagactgaatttcctccatggttaatgcaaaatcaggttctgtttggggtcatcatttaggttgccataaaacagcacgttttaaggcttgtatctgtaaggttgctgaaaggcatgtgcctgtgttgggggatgtgacctttagtgtggctctgggggtgaagtaggggtatattaactggagggtgttactcaccaacagctgttgggcgggcctggctgtgtcagccatgttcccggagttcagttgttcccatcgacacccactgccaccttgagcaaaggcattttctccttcagggagctgcccagtcgtgcagccagggaggcctgcagttcctctgtgagctgccagagtctgtccgactcaggaatagggtttccagcgttctgggccattcggctgagtgatttttctcaggcatttatagaaatggctgcttctgtgtgcgtgcatgcgtgctgctccttaattctccataaggcaagtcattcggctcagctgtttcaggagaacctttttcccagtcaggagtggaaaacgaagtgagatgttcattcagctttaagtgctacagtcagtgctttgaacctagggatgtggtgattgcaggtgcctatgttttggggatctctaatcttagtgcatggttgaacaaaacctcagcctgggttaatattgtcggaagtgtattcctgctagaggaggtatgtgttaaggttactttaaataagagacttggaggtctcatgcatttggaagtttcagatacaacttcaatttaaattgactttagggtagggtaaggagcttttctaattttctttctgctggtgttaaatcaagaaggtgggcagagatggcatttggaatgtctgcattctgtgaagattttaggagctaaactccctgccacacccccttgcttagtgctgctaacattccctcaagaaaccctccagcttgctcacttccttatagagacacatacagctgccacttcatagaccacttctacaccagctttagaagttgaatcattcaaacagattttcttctaattcagtgctgctacttctgtagtgtgctgggaggaacgacacagttgaggccagctaagctgggttctgatttgtcctattgttttctcatttgagaccataaggaagttactttaattcagagtttgcaaactggaggcttgctgctgaatttgctttgcagatttgtttggcttggccaacacagggtttataaaaatttaattagttaccaacatctaaaaatcagaggattatagcatgaatccagatttctggcttgtctggaaaaatcaaaagatctggcaaaactgggcctgaattcttgcctagcaacaattggcttgaactgatcatgatatggggcagtacctcgtattttaatcatttacaggatctcttttggcatttaagtttgcaacctctgctttgtttaagcctcactttcttaatccacaaggtagggctactatcctcaagtcacaggttcttgtgcaaagataacatctataaagcacttggtagggttccacacacagtaaccccttgagaaatgctgggtcctgtggtttgtgtataatgtacagaacgtcaccttaaaaatcaggaaacactggataaacttatttttaagcagtatgttaatttacattttcaaatagtatgttcagtttgtttttcttcaaccagaccagatcttttcaggtgacatacctctaaagtttaagcagtggatccattgttaatctaaagaaaacaaaagatgcaacaaatatactatttttcctgtttccagactttttggacactttatgatgtatttatttgtactgtttcagattaattttagaactattagagtattttatatgaaaatatatcaagcatattatttgaaaatgtaattaacatgaagtttatcctaagtctcctgactttgtggatacctttcacatagagtatgggcagattttggggggcgggtggtaaaggcagtgttataaggaaacaactacattctaattccagctcggaagtcatcagaacaggctgatgttgaatcatgctgggttgatatctggatgacagaaaccttaggccttgtttctgtgccaggtgccatcttattctctttttggaggggcttaagtcagctatcgccaagtggtgacaatgggttgagtttgataacactggttataggattctgaagatcagaaaaccccaaattccaaccatgacaccccagttctatgaaaaaatatttttcagtatatatatatacatatatgtatatatatatacatatacatgtatatgtatacatatatatacatatatgtgtatatatatacatatacatatatatgtatacatatatacatatatgtatatatatacacatatatatacatatatgtgtatatatatacacatatatatacacatatatgtatatatatatacacatatatatatatacatatatgtgtatatatatatacacatatatatatatagtgcaaaaggaggctcacataaaaaaccaggagaggtgggggctacaaaagcccggagtggcggcttctgctccttagcctcttcgaacacattcttgggatccttggcatacttggtgtgagggacctggatagcctccgtagtagaagttgtcctccaatatggaaaacagatttttttggtccctctaggaatgtccatcactagccaactctaacttaggtgggaattttgcttaaaggcatgaggttgccctgagcttcttgcactcttctcccttaattactgtaaaaggttttggagtcaactgtttggtcaaggagagtctgatgtcatcggaggtatcaggaaaaactcacttcattgcctgggaggtggggccttagggacagagcaaggccttgccctagactaaggggccttagctcactgggctgcccattaagtaggccctgcccagcccttaccaccatctcttctcttcatgagtggaacggaagccctgtacctggatccttagggacacattctctctaccccattcttctttccagagggctccccagagtgatgtggaatggcatttcataacccaacttgcttcatccaacatagatgtacaactaggcctgagtggggcttgcacaggtaactgtttctctaccctttttccataattgtcccctccattactgatcctcctgcctcagcctccagagtagctgggattatgggtgtgtgccaccacactcggctaattttttgcatttttagtagagacagggtttcaccatgttggccgggctagtctcgaactcctgacttcaagtgatctgctcacctcggcctcacaaagttctgggattacaggtgtgagccactgcgcctggcctcccccattacattttaattccacagatacacttgagctgtttatggactatgccccattccgaaggcgacaaatcgttgtaatagctaagacttttttcacctgtcacagaaccaatttttgccccctgggagatgatactgcctcaccccactcagcaataggagtgatatcaagtatcctgttagggaagaataacaatctatgcaaaaggctgcatacacatggcttctagctatagaggatgggtttctaaggctgcaagggtttgctatagggtttgtttctgggttttagacaagagggtaaaactcccttgaatcaagtgaaagatgcccagactgttcttcagcccccagcccaagctctctgcagaaatctgaccctggggctggaggctgttaggaccctatagctcttattgctagtcacaaggtaggagccacccagttgcctttctttcctcatttcccatttgtcctgtgtcatcctccatctatctgccctagcaaagacagtcggggggcctctgagaatcttctgctggcaagattacagtttcacgatagaaaacataagtggagtcaaattacagagtacgcacactgtttcccttgattttcctctcacatcttctgtgcgtggtgagaagagagaggggaggggtataagtgggttcctgggtgagagagggaggtaccagagtaaatacagtgccacttggatggtgacaccccattaccttcagacacaaagatgtaagctgagggaaatgaattcttggattcagggaaatgaattcttggattctgaacatgagggtcagatttacattcctgtctcaattgttgacgcttatcccaaggactagtcattctgcaacatctgtgggaaattcccagattgaacttcccagggagaaacatcatatgacatattgggaaaatggctgacaatggttttccttagtaagttcattgagaagaaaagtgggcggatgatttcccagtcttcactctttcagaagcccctaaaacaatctgacatgctctagttggagcctgctttctatcccatcagtttgatttctgaatgccttatgatcattagcattcttcattaaaaaaaaaaaaagctttgtcgcatttgttagtcttgacttccaaatcttccgtgttcttttttttttttctctctctctctctctttccctttggctgttctcaggcttggagaaaaagcttgtagcatgccattccttcctccactgctagaatcctcccccacatccgaccctcccaccttttcctaatgtttctccagcaagcccagcgcccactgaagagcgtaaattagtgcctagtaattggtacaaaggcactttctgtttctatgcaacacacgcagaaaggaggggcaaaaggaagacgaagaaaaaaaccccacagatggttaaaaagggaaagaagtgagatcctctttcagtggtctttgagcaatcctggctctctttctccgccccactttttgttgaaagttagtcacaggcctaggcctaactcagagcacttggtggcagcagttgttagtatcaaaagaatagcacttggaggttggaagtgaccttgggaggtcatcacatccatcattttgtctttaagaaagcacatccccaccctttctcagagagatggggattgttctcttgaaatgttttggggggacttgaagggctttgaagcacaccaccaggtttcaaaagctgcctatctgccttgactagcatgtgagtggtcatactgtgtaatctcccagagcctcaccagctcatgagggtactaggtagttggaagcatttgtcagcagaaaatgctaaagcccctagcttcaagcttggctctgcgggtgcctaggaatttttccttcattttgaattctttgcagtactttcatttgaattctttccccccacttgctctcctgggacttcagtctatggttaacatttttctttttcaccttagtttaaagggctgcttcatggaattaaccaagtgaaagggcagaggtggagtgagctggggtggcctatgccctttttatgggagcagcactctctttaacagcccaaggcagagctgctgagaggtttcctaccactccctacctggaatcgtcctgaaactttaatacctttttgatgcattaaggccacgagtaaacatttgttttatcccagtgtcaagcagtcccctcagcaaataataggactaacattattattcataagaatgtgatcccccctgagggagtgagaagcacccattttttttttaaatacatgggaccttccaaggccattcattgccatgtgtgtccaaagcctttttgatggtgtgcccgaagccttctcttttaatctcagtttctagtgtggtataattgactttggaatcctgagatgagaattgaagaacctggatctgaaatctaaaggttctagagctgagagaaccagtttgctcacgatctaagccagagctgctgctgctgggcctttgaatttgtttattttttaatgaaactgagaatgatcacaaatttgaacaggagaaaggaatctaggagaatttgaacaggagaaaggccaatccttaactggccagattgagtctttttaaaaagtgaggacatttatttaaatagattaaagtaagagacgggagcttaagccatacaaaattagtgacaaggatttgaaatgcagtcagtggtgttatgtattcaatgaagtttgaacatttttccaagctgagcctccgtccttgtggaagggagtatctcccaaagggcctgacttgaaccaaagtgggaaccagtggaataggcaatggtcaaaaacacaaaagtctctcttgggagttttggacattttagaaccgggagcaaaattacagatcatcttggcccaaagaaatagagggagaagaaaatgtttcaccatctctgtcttccagagagctagctttcataagacaggcagttagaaatgaagagtaaggcctgacctatttcatattgaacagtcaaactgaggaactggaatgtgagggggcctttaccttcagtacagagacagtagatagagtcgtcagagcacaggcttttgggtccttctgacatgggtttttgaatcctgtctccaccattctatttatgacaactcaggctctacttaccttctctgagcctcaggtttctcatctgtaaaatggagctcagtaattatatatttatgaagttgttatgaagcttaattcagatgaggtgtttaaatcatttagcacaccattataattaaaaataaagaatttatgtgtgtgttccagaagcccttgattcctagaatttttgtttagaattccagattagtccagcactgcctcattcacttcaattatttattattattattattatgattttgagactgagtctcactctgtcaccgaggctggagtgcagtggcatgaaggatcttggctcactgcaacctctgcactctccccgcctacttccccctaccccctactcaagcaatcctcccacctcagcctcccaagtaactgggaccacagatgcacaccattttttgtagaggctgggtttcactatgttgcccaggctggtctcaaactcctgagctcaaaccatttgcctgcctcagcctcccagagtgttaggattacaggcatgagccactgcacccagccatctcattcacttaaattatttattgagtgacttacatgcaaaaagctgtgtaaaatgctggtaccaggcactttggattttgtggctaatagtgataataatgacaatttctaacatttattatatgtcaggttccaagctaaatggtttacatgcattgtcacatttaaactcacagcaatcctgtgagatagaaaggtgctgttcttctcatttaataggaggaatcagactgggagttagttaacgtagttcaaggttacactggaattttcctagtctgtctctaggtgggtggagttgggcatgaatgcttgctgatctggaccccttgagtttccgccagtgggaagagaccctgtgttttacgtggttctcttgggtttggtcccagagccaccagtcttcagctgtctactcttgttgttctgactctggcttatggttggttttcatgaacctcggttaggagtgtcagcagaaatcttggactctgaccatacctactctgtattttccatagttatccagaagctgcttccttcccattgaaaaataacctggttgtgggcccaaagctgtattagtcaggacaacagaatccaaacagggactggcttaataaaaaaaatgaaactttattggttcaggttacaaacacatctaggggtagctctcatttcggtgtctgtggatacaggcactcagtttctgcctctccatggctcagttttgctgccttttgctacagcctcattcatggggttggtgggggctgtctccaaatagtggtgagatggctgcccgcagttccagactcatatcctgccacttaagcaaaccccaaggaaagacagttttccattcccaaagattccagcaaaagttccaggctttaagctccatgactagttcagattgtgtgccccatccctgaaatgaatcactgtggcacgactgggtcacatccaatctctgggtctggaggtgtggggtcaccctccctggaactacatatatccagaatggggaaggagttgttgccaaaaggaaatttaatgtgttatttattatccagaagggaacaaatgccagacaggcaaaaccaacacccattctctctgtcatcccatttagttagttatttatttttatttgtatttttttgagacaaagtctcgccctgctgcccaggctggagtgcagcagcacaatctcggctcactgcaacctccacctccctggtttaagccattctggtgcctcagcctcccgaatagctgggattacagccacaccccaccatgccaggctaatttttgtatttttagtagagatgggttttcaccaggttggtcaggcttgtcttgaactcctgacctcaggtgatccacccgcctcggcctctcaaagtgttgggattacatgtgtgagccaccatgcccggctatcatcccatttataactaccaacaggattttccaaagaacagagtttgacaaaatgagaggcaaacagtacgatatttttttttctatatatttttcttccttttggtgggaaggagctccgaactatctctggagttcaacccgaaagataggccataagtgaatgtacagaagggtctttgcagaagatagatgattttgacaggtattacatacgcttaggcaaacacccactggccctcctgagtggatgttctagaagccaataataaaagcctcacatggaacaagtataacagcagcagggtgaacttcaaagccattgacttggttttaattccagtctgtccattttaatgtccagagaaacaaatcatgtttacaggaacatttattaccctatatgctaataggtaaaagcctagtctatgcaaagacgagctgtttatatggcagttcccactgggattcagaagtgtattcagtgtgcacaatgcccaagaaaaacactgtaataaatcataagaggcaaaaagtagagcttaaaaacaacttaacaaaaacacataaaagtgacttaactccctgtgctctgtaattctacagtagttttgtaccattaccattttaaggaaaataagcagaatgacaaccaaacagctggctttctctcgtattgtaatccatactcatggccagccccaaaatgcttgttcagtgagcattatcccactgaagcggggggttcccagtgtgaaaaacataggctattttctctaacctgaggcatttctttttctttttcttttctaattgattttattttattttatttttatttatttattttttttgagacagtctcgctctgttgcccaggctggagtgcagtggcatgatctcgctcactgcaacctccgcctcctagattcaagcaattctcctgcctcagcctcctgagtagctgggactacagggacatgccactacacccagctcatttttgtacttttagtagagacggggttttaccatgttggccaggctggtctcaaactcctggcctcatgtgatccacccaccttggcctcccaaagtgctgggattacaggcgtgagccactgcagccagcctaattttttttcttttcttttcttttctttttttttttttttttttgtgaaggagtcttgctctgttgcccagactagagtgcagtggtgcgatctcagctcactgcaccctctgcctcccaggttcatgtgattctcctgcctcagcctcctaagtagctgggattacaggtgcccgccaccacacccagctaatttgtgtatttttagtagttgatagggtttcaccatgttggccaggatggtctcgaacttctgacctgaagtgattcaccggcctcggccttccaaagtgctggattacaggcatgagccaccgcacccagctaatttttgtatttttagtagagacagggtttcactatgttggccaggctggttttcctgagatggggtctcactctgtcacccaggctggagtgcagtggtgcaatcacggcttattgcatcctcatgctccttggctcaagcagtctctcacctaggtctcctgaatagctgggaccacaggcacgcaccaccatgcccagctaatttaaaaaaattttttttttttttttttttggagatgggatctcgctatattgctcaggctggtctcgaactcctggcctcaagtgatcctcctgctccagtctcccaaactgttgggattacaggaatgagtcactaacacccagcctaacccgaggcatttcttcccaaagccctgcttgctcctaaatttcaaaacaccctctagaaatacatgcccaaagaggggactatattccttttctgagatctcagggggagggttgagtggggactgttttgtgaagggtggacagctctgacctgcagttctttgtggtctttggtgccaaacatcaagccatgtgacttagtggctcactccatcccaagagtagaagggttaaaagcttgaaaagctgctggtggcccatgtggcatgtatgagtaggatttatggccactgcagccatactgtggtgtgcatacagtgtgcagaggttgagcccagagggaaaaagctggatggaaacacttgctggagtggcatcacttttcaccatgagtccttatgaatgccacagcctagcaggtagagtacgtgttgactaatcaggcatcagtctctccatttctgctgctgggggacaatctttttcttggcatttcagggtctcagttacttctgcattaaattgtattctcttttggctaaatgtttgcaaaatcagggttctctctctaattcggggtcccttgcctttcctttccctgggagtgatcttctgtttggtgggcatggggctcatctcttgtttcagcctcgtgggagagccatccatgttgcatgctgtcctttgaccttgtggtgatgtccactgagacgtctgtcatgcacttgcctgtgtccccatcctcacaggctgacatcagtggctctgggtgttagatccttgcactgtgacccagtcctcctgtggatttctccaacagcacagttttgggctcaggaacacagtccttttccccaccctgcactttagaagggtgcgcacactgagacccctctcagctgtagctccccaactcctcaggtgttatggcctgtgtggggcttccaagaggaccttatttgtataaggcacttcctctaggcatgtctcgaaggctgtctctacaaggagaataaagacctggatatttcttagagacctctgtgtctctaatacagtcctaccagctctttctctttttctgcccctcatgtcttggttggaagatctggcaaattgagagtttttttaagctcaaggacttaggttttctaaatgctactttgaaaattaaagctcagtggcaacttatttatcctaaactatgtctgatccccctgaggcaatgcatttggaaggaagggcctggaaggcagagaattggaaaaaaaggcactgtgaaaggtcagtctctgtgcttttagtttgagtccaggctcttctttcacatctaatctcattttgtgcataaaactgaaggagcaatttgaaacctggttttaatctggtcacacactattgtgcagggcgtccttgggcacgtcatctgccctctgagttggcttcatctaaaacatgacaggtttgaattccatggtgataaaaatcaccaaaattgcaaagattcaaagaatctgttcttgggatagctttgccattaggcatttatatcttgttcaatatttaatgcctaggtagatatttattatctatgtttcccacaaatagctgaacaaaggcagcatagtctgggatggcaggaattacctagtctgggccagggtctggtctttgaagggctagctatgtggttgtggggaggttgcatcatctttctgggcctttggaggatccctaagatttcatccacctctaaattctgttactctgacttttatgatcttttatcacactacaccaagaggcagatcttcattgtgttaaaaatttatgtttagggtccacattttgcctctgcactatttttagttttcaggcagggccatataactgagacttcaagacagctcttggccaggtgcagtgtctcacggctgtaatcccagcactttgggaggctgagacaggaggatcacttgagcccaggagtttgagaccagcctggactacatagtaagacccctgactatacaaaaaataaacaaaattagttgggtgtggtggcatgcacctgtggtccagctacttgggaagctgaggtgggaggatcacttgagcctgggaggttgaggctgcagtgagccaagatcacgtcactgggtgacagagcaagaccttgcctcacagaaaaaaagaaaaagaaaatgtatagtttttgctgaatcaagaacctaaagaggcaagaatctgttgtcagctgggcacagtggctcatccttataatctcagcactttgggaggccaaggcaggaagatcacctgagctcaggagttcaagaccagcctggccaacatggtgaaaacctgtctctactaaaaatacaaaaattagctgggcatggtggcaggtgcctgttgtaatcccagctacttgggagactgagacacgagaattgcttgaacccgggaggcagaggttgcagtgagccgagatcgtgccactgcactccaacctgggtgacagagcaagactccatctcaaaaaaaaaaaaaaaaattctgttatctgctgtcttttgtttgaggtctgctggaactgcatgtgctgtctcacagatagctgaggttgggaatgtgtgcacgatatttggatatgcttgcttcttagactctgacatgcttaaatgaggaagtgctgcatacagatgtcagagacacacacccacttctcatttcagaacctaaagcataggacaagttgctttctacagataaacacagagatccggaagtaaaatctcacacctaagccctacactgtctctgttgtatcaacaaatacaatataaacggaagccaaatcacaagcaggattcagtgagaggtcagaagcaaatggtagtaatatgatgggatggcattcaggcaggattattctttcaaagcctatttaacatttttattcgttcagaacatctacatgcaaagcaatatttctgataaacaggagacttttgaatgaatgatttttgagttcagtgttcattgaaatgatgtatgcagaaaaatgtggacttctctgtacccaggaatggcctgcacacctcttccgtaatgtgtattggtggttctgcacatgagggtaatggagaatgggaaaaaagcaactgttcatgtttcgtacctgcatgttgacattgctttttggtgaggagagaagccagatggtgatggacaaatggggtgcttgaggcctagggtcagggcaggtctatgtggatgcattccccaccagtctggtccatgaatgctttcttagactcaaatctttgcacttcttcatgatctgactcctctcacctgctttctaacaaggacactcctttgttgggcaaccctactgttactgtttgtgcatttccacctctgaaggaaggttcctgtctgttcttataagagggccatgtccctttcacatatggaaaaagtaggagaggtggaaatagaggagtgagaagacagatgtagtatattcaggaagtttctgactttctccgttttgtttttttttttagtcagagtctcactctgtcacccaggctggagtgcagtggtgcaatctcagctcactgcaacctccacctccagggttcaagcgattctcctgcctcagcctcccgagtagctgggattacaggcatgtgccaccatgcctggctaatttttgtatttttagtagagacagggtttcaccatgttggccaggatggtctcaacctcctcacctcaagcgatccaccccccttggcctcccaaagtgctggattacaggtgtttacaagtgtgagccatcacaccgggccaggaagtttctgactttctgacaattagtttgagaagaagacaaaatgactcttctctctttggtcatggatcacttactgaagtgtcccagtaatttctcaatagaaagtaaatcacctactgccctccacttccatgcccatggaatatattccttttaaaatttttaagagatgaggtttcactatgttgcccatgctggtcttgaactctgggcctcaagcagtcctccctcctcagccttccaaagtgctgggattacaggcataaaccaccatgtctggcctggaatatattcttgatcaagccatttgtggaatggtttaaactcagatgtatcgctgttttctgtaagacttttaaaaaatattaaaataactttttctgactttttctcataaaagaaatttatactcactgtttaaaaaatcagaaaacatagggaaaaattacaaaaggaagtagaagttattctttatctcctcactggtagatagtaattgttcaaattttgtatatattctttttacttaatatttttttaattttaaattgtagtagagatggggtcttactgtgttgcccaagctggtcttgaactcctgacttcaaatagtcctcctgcctcagcctcccaaagtgttaggattacaggcatgaaccacctcagccagcccatattttgtgggcaacaggatttttttctctccatatatattcacacacttatgcagctgatcatacattgttcttctcagttagcagtgtatggctaacatctttccatttcattatataacagtctggtacctttttcacaggtacatattagtcccctgtaaggatatactttatgtattaaaccagccctttatttttgagcatttaagttaccaccttttagctctcataagcaatgctggtatcccttttcatgtctctatctaattattatcaaattaattgccaaaaataatctgcaggagaatattgccagatggccctggattaattataaatcccaccagtgtggtagagggcctgtttcctcatgcctccaccagtggtcggtatgaacagattttttaacgttttcactagcctcacagatatcttgctggtgtcttaattggcatgttttgattacttgtgagattgaatatatttttgtatgaaatattaaatattttcgtatttatttcttggtcattagtattttatttatgtatttatttatttatttattttgaggcagcgtctggctctgttacccagactggagtgcagtgacacaatctcagcttactgcaacctctgtctcactggttcaagtgatcctcccacctgagtagctgggactgtaggtgtgcaccacacagcctggataatatttgcatttttagtagagatgaggtttcgccatgttacccaggctggtctcaaactcctgggctcgagcaatctgcctgcctcgacttcccaaagtgctgagattacaggcatgaaccaccacgtctggccagtatttcttactttataaattatttatttgcatccttgcccacttttattaagttgggctgttcctttttgatttgcaagtcctttctgtgttacagattttaacattttgtcatatgcttcaatttcttttaatttattttgattcttaaatttttctacttatatatatttttaacatgcagaagtttaacatttttacgtattcaaaactatccttcaagtaggattttgcttttggtttcatgtttagaaagtctctattccaggattctaaaaatgctcacctatattttatcgttatggctttattttttacatttacatttatagcccatttggaaatcatttgagtgaaaagtatgaggtagggactaagatttaatttttttcttttacctgacatctaagccacttactgaattaaacattttctgtttcactgatttgaaataccccatttaccatgtacagaatccctatagattcttaaggttattttcagaccctactctgttccactgatttgtcttttcctgtgctgctatctcactatcttaattattacagctttaataatccattttaataactagtattgcaagtgctcacttattatttgttcttccgcaaaattttcttggcaagttgggcatgtttattcttccaaatgaacttcagaaataactttgtcaagttctagaaaaagaaattcttacggtgtgtgttaattccgtagatgaatttgtacagaattgccatattcacaccattgagccttaccatccaaaggcatggcaagcattttgtttgttcattttcttttatattgaggctttatgcatttcttcaccaaggtcctgaacttttattgttaggcttattctgactggttatggctggcatataagaaagccagtgctcttttgtacagttacatctgtgaatgcacctttaatttagattagatttttcagttatcttgaattttttcaaagagaaagttgtgtcaactgcaaataattcttattttataacccccccttcttctcaccatttacttcttattttatctaattgcactcattagtatttcctggaaaatgttaaattatagcaatgggagcgggtgtccatttatgctttgggctagactttagtagttatactacctttattttactgttgaccttgcagaggaaaggtttcagagctgatcttttatactgctgaggaattattttattttcctgaaagcttttattagggatggttgttcaattttatcatatactattttgtacacgataagagtgtgtatatgatattaaatgatactaaatgtgtgtgtgtgtgtgtgtgtgtgtgtatgagctgttaaatgggggaataatatcagtatgatttaataatatcaaattgtcctttttaaaattacatttcttttgtagagttggggtgttactgtgttgcccagattggttttgatctcctgggctcaagcagtcctcccatctcagcctcccaaagtgctgggattacaggcgtgagctaccacagccagcccaaattcttcttttatctatggaatcctagtgctgtttttgcaatcagaaaccactctttttttttttttttttttgagacagggtctcagtctcactctcacccaggctgcagtgcagtggcacaatcatagctcactgcagcctcaacctttgggctcaagcaatcttcccgcctcagcctcccaagtatctgggaccacaggcaagcaccactacgcctggctaatttgttgtatttttggtagagatggggtttcaccacattgcccaggctggtcttgaacttctgtgttcaagtgatccatcttgagcggctgagcattatttttcttctagaagaagtcttgattttctacatctgcaagaaactttaattcttaattggcactgtttgagctctgttctgaaaaggaggcctaaatcccttagatttgttttttaccagattggtttacttttgctagatgcaatggaagcttttgattttgtatttttgactttcctgtctccattaaagttagacccatccctggacttgggtggggcagggaagatgagaagaaccaggtaggaaagagacgacattcagatggcaggcctccctgaccccaggcaggacttcagtggcagcctggacagctcagggagtctggggagggttgcctatgtccagtgagcaagcttggcacttggcaagtacccggtctctgtcttctctatggagaactcacctccattcgtttcaggactgcccacaaaaaaatgggcttcatttggcatcatcaactaatcagcagtcgaggaggctccctctcaaaagcagcaagtgtccttttgtgctaagtaggcaagcacatagccagggggccccagtccactgttcttgcaccctccgtaggcccaggagaattctggaggcctgatgactgtctctgcaaaggaagtcttttacacattgtgcgcagtgttcagtagcttttttgatcacatttattttatactctgagctgagtcagtcagcaagaggtgcttagcttgttactgaaaggggcggggagtggtatataaataatgagaactcagagaaacttgtgctgttaacagctctgctccagtaaagtggagtttattgtgtcactgcctctgggtgtgttttcctgtgaaggccagaaataatgcagtggtacaagtgtgttgggtatttttttccctatccccaggaggatggtaactctctcattaatactaaagacaggtttaaagattctctaattgatagttgcattgctgtgtgatttgttcagcgtgaaggctgaccattctcctttagaccttagcaccgagcctcaaagagagggcctgacttggtttcccccaggctgccagacgaaggtggagtgaccgtctctctaggccagtcctctcctcctctgtagatcatctctggtcccattcagccttaattctgttctcgtctacatgtgacttccccattccatgctttcttaagtgcaaaacatctatcattttctaaataataccttattatatgactgtcattaacttatatgctgggatgttagattcaacatcatggcatgttagatccaaactctccactgtattaaaaaggtgggagatttttcaaagggctacaaattgtaggtccctaagcagaatccagcctgcgtacacaccactgggtggcaccataatttataatgttgaaattgaatgcctctaagtaggggaagcaccctgttcagttcaccatggaatccattatgatccatgattgaatgcacctgctcccaccctgtccccgacctgtgtctggctcctgaagacatttgaatttacaaattctggtggccagttagaagttcaagtcctctgttatttgtttatttacttgagacagggtctcactctgttgcccagactggagtgcagtggcgtgatcttggctcaccacaacctccgcccctcgggttcaagcgattctcatgcctcatccccagtagctgggattataggtgtgcaacgccacacccagcttcaagtcttttgattgagatcaggaatcaaccaactttttgcaaaaggtcctgatagtaaatattttcagctttgcaggctgtacagtctctgtgggcaactgctcaacactgctgttttgagaatgcagctgtagataatacttaaaccaatgagcatggctgtttccaataaaactatatgcagacaaggaaattttaatttcatataactttctcctgtcatgaaatattcttttaatttttttcaaccacttggtaaaaaccgaatataagaatggtataagctattcttagctcatggcaggccagatttggccagtgggatgtggattgctagcccctgatttagatcactgaccaaaaagtttttaaagttttccaaaggatgccagataaatcaaaatgatcccgggccttttatactagcaactcacttccaagcagatcttttttaaatgcgtaaaaatggtaaacttgaattatacaagttacatgagtctaacgaagcttctatttgctcttgattttctcggggctctgtgggtgtccctctctgctctctgtgaaacacttcagggataaggacgctaggtcaatgacagcacttggattagaagcaaggagaaccatcacaaaatgacagctccaaggggcagtcaagagagtatcactgtcagctaggtcgaaagtgaattcagtgggaacaaaccctgattacacttgaaatatatgtaagtcacaagcatagaaacttaatagttctcctattctgatggcttcatgccagttttccatggtcacttctagaaagccatcttcctaacacagcgagagtatcttactccttttccagtcctagcccacagctgaatggtcttctggtccattttccccacagtggacacagatcccccaactaaatgaaccccctcctctcatgactcacttgaaagaaatgagtacacatgccagtgaggaggctaagccacattagcactcctccaagaaaaccacttctaatgagtttttgtcttaacaagcattgagaaaacactgagctcttcctttcattgttttcctcaccgccacatcagaagggagtggagaaagggctccaaaaaggaccgagcagagagggcgttttgttttggtttggtttggctttttgcaacttaaccattctatgagttctgaccccttgttatatttttcatagaacatgtttagaaaaacatttcccccataactgcttcactggggttaaagaggacttcactgcagtctaattctgcaatagctcaggtttctccagtagccagtaatatctgagcagatttcaatgtgagtgaccaggaggaggacgagagagagagagagagagtgtgtgtatgtgtgtgtgtgtgtgtaaagtttgagcatttaccaaatgcttggcaccatgagtaggacaaaagtcatacatgacattatttttgcctcaagaagctcagccttgatggggttgtaacaatctgtattttgacttttgctcaaaagtctgctgaagtgggttaaaatcctgtttatctaatggaagttgcagaagtgtagttttcaactccatgtctttattgagtttttcacgggaaactcttttttttttcctctttgcagccccatccccgagcatcaaaatgcatcaataaccctagctcttatccaccttgagtagggcccagcattcattggtttgctattgccttttgctgccgtagcttttcagctcagagctccataagggtttatacgtagatctgcacatagagaatcaactgctacagattcgttttacccacattgggtttcctcgaaaagtacgttgtacagggtgttgttatgactattgctctgcttagaaaacagcagagagccttcatcatgaatagattatcacaaaggtgatagatttggttgttttatcatatttctgcatctcatcagcacaggttaagagacgctggggaaaacagaatgaataattttggatgactcaaatgcaccacgctggacagctcccagcctctgcagtttctctatgggttctgggaaggccgggacaggagtgagaaaatattcactcctcacacctagccaaggagtgtctggagagttctgcggaaaccaggaggctgtgtgtcctctgtctatgcagcagctattgtcagctgtgcttggaaaggtgtgaagagtaggcagaggcaggctcttgggagccagggcgatggcagtcacttataagtggaacaagtgtggttctcatcttcaacagctcgtctgcttgtctgcctgtgtatgtcctccccaaacacagacatggccttcacctcccctgccttcatcttgtggggtggggagcagcaggaggttatggatgctggcctgataacatctggcaggcaggacttagctgcattttcagtgggacacagacattagtgtgaatccaaggaaagcaatcggaaagagggatgtggaaattgtcaagtccccaggacccccaggagtcaggacagccaagtggccaagagcacgggccttggtagacagggccagttcattactctgctttccagttatgtgaccctgagtacagagtttaaccctccaagtctcagttttctcatctgtgaaatggggcaaccttgtggagtgcttgtgaaaattcagtgagaagggcacgggaagcccttagctttatgcttagaacaatgttagttcatcttttatgaggaatatagaagaaactggaattgtttggaaatgggagaagagattaaagaaagacatatctgtctgcagatatttaaaggattatgatgtggcagaaggaacaaacatttcttttttttttttctttttgagacagagtctcactctgtcgcctaggctagagtgcagtggcatgatcttggctcactgcaaccttcgcttcctgggttcaagcaattctcctgtctcagcctcccaagtagctgggactacaggcgcacgccaccacacccagctaatttttgtatttttagtagaggtggggtttcaccatgttggtcaggctggtctcttaactcctgacctcaggtgatctgcccgcctcagcctcccaaagtgctgggattacaggcgtgagggattacacacctggcacaaacttacttctagtgttaagacaatatgacttaaagtatggcctttgcaggaaggcagattttatatcaataaaagatgtgacagagatgctcaggaacaaccagatgctgagtggcccctgcactcaggagctcagggagaaatgctcgttccaggtaggaggctggttggacccaatgccaattcttttccatcctacaacaccaagaaatttagcaaaaaggctcagcttttttactcttgaaagaatttatgaaaccagcaattgtgtggaataaaacagaaaaaatactttccaggggacccatagggtaccaaatggcaagctcatttgcttagagatgttagcaactttctcattgtattagtttgggctgccataacacacaaccacagactgggtggctgaaacaacagaactttatttcctcacagttctggagactgggagtccaaggtagaggcaggggacgggttcgtttcattggaggcctctctccttggcttgtagatggtggcttcatccctgtcttcccaaggtcttccctagtcttcacatgtctgtgtcctcatctcctcttataaagacaccagtcgtggattaaggcctgccctcatgaacttgtttaacatcagttgcctctttaaaggccttaacttcaaatgcagtcattttctgtggtgctgggggttaaggcttcaacatagggattttggggagggggacacataataatcatctccgagggatttatcctttgagtcgtagggactattgaccatgaccgcccttcggaatttttttcatgttctttgagctgtatcctttctgattcctttctcttaggtgaacggccctttccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggacaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggaggggggtaaggccaagactggggtagaattttaaagattcaacactggtgtacatatgtccgctgggtgagttgacctgtggcctcgcacagtgattctgggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaaaacagttacttatagtcaatgggtaagcagagtctgaatttatactaatcaagacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatggcagagatgtgagggcagaatatacacaacagatgctgaaggagaaggagggtagtgttttgcaaaagaaaaagaaaagaaccaacagaattttaactctattaacttttccaaattttcctatgcttttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaaaatcgtcccttgtggagaatgcaggcaacatggaatactacgaatgaaatcacatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttcgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagttgtattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcaacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacaatttacttcccaaaaaagttgttacttgccttttcaagttgttgacaaacacacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaaaatttaatagttttagagttaagatatctcctctctttggttagggaagaagaaagcccttcaccattgtggaatgatgccctggctttaaggtttagctccacatcatgcttctcttgagaattctatttggtagttacaattacagaaactgattagtttgtcagtttgcagatagatttagcacagtactcatcactcggatagattgagatgttctttcacatcagatgatctgtaacactgtaagatactgatctttacaactgtttaatcagttttatttttgtacagtattagtgacctaagttattttgctgtcccgtttttgtaaatcaaatgaaattataaaagaggattctgacagtaggtattttgtacatatgtatatatgttgtccaaataaaaataataaatgataaagactgaattgttctagccattatgtgttgtaaaagggggctatttcaccataatgaaagttacttctttaacctgtgttcgcaggattttgggatgagtgcaaagatgattttaccctgtacctttcaacacatgcaatagttatatagacttgtgtgtatttactattcacagacctctgaggaagtagatgcaatagaggtcacttgaaaccattgtgttatgctggaggggaatatttatattttgggagataaatcactttaagaggcttttagagctcataactgtgcagggtgtactaggaactggtcagagaaagttgtaagctcagattgtgctcttgagatacgatattaataagaacacacaagttgaggtttcattggctcaacagtagaaacataacaccaagcaaagacaagcatcaaagtgtgtgtgtgtgtgtgtgtgtgtgtgagatttatgcagacatgtactagctattatgtattaattaagcttttattgtaaactactcatggcgttgggtgtttaggtttttcacatttaatccttacagcagctcagtacagtagataattattattatgtacatatttctgatgaggaaattgaggattggataacttgccaagaggcacatctaataagtggcacagacagtgtttaaatttggatctgctgaatccaaccctgcatctttgtatgcctgcatcacagcagcaagggatttactggagtgtaccattcatttgacccattttattgagcacacctattcatgccaggcactgttgtcactgtggatacaaaggtgaaaaaatagacaaggaccctatgttcagggagtttctgttagtagagggaaataaatagtaaacagattatccatgtactctcagatagggataagcatagtggcgagaatagaatagggtgatgtgattgtgacttggagggtggggagaggctactacagattgaggaggcagggaaggactccctgagggtcttcacatttaagctgggacctagatgacaagaaggaactagcctcagaaaatgtgtagggagtgtggaaggagtttggcaggaatgtgaccagcgtttggaggaacaggataacagtggggtggctggaatataaactggacaagaagggaagggaagtgctggggtggttggcagggcccagttcacaagggccacgtattgcaggttgtaaaacggtgtttgattttgattctaaggggaggggcaatctgttggaagctttaaagcagaagaatgctacgatcccacttgtatttcagcaagctctttatgagtgccagggaaaatggattttagagggacaagagtggaagctgggagactagccaggagatttctatttgtccaggcaaaagatgatggttttccagacccgaaggttagcagtggaaagaagtgaatagtttcaagaaatacatcagaggcagagtcatttggacttggtgatgttaggatgtcgggggtaaggcataaaaaagtccggtaatgaccctcaagtctatggcctgagcaacaggtagatgttactgcagagtggtgaggatggaggaaagggggaaagaagggggtggatgagggaaagggcatgggttcatctttggacatgttgaggttgcagtgcctgtcaactgggaatgtc

SEQ ID NO: 15468 - DNA, 36228 bp, Human; identical to SEQ ID NO: 12256

SEQ ID NO: 15469 - DNA, 34315 bp, Human
atcacttgaacccgggaggcggaggttgcagtgagccaagatcgtgccactgcactccagcctgggcaacagaacaagactctgtctcagaaaaaaaaaaaaaaagttagaattgaaaggcaagtgatttggcaccaggcatagtagctcaaccctgaaatccccagcactttaggagaccagggtgggaggagtgcttgaggccaggagttcgagaccagcctgggcaacacggcaagacccctaattctacgaaaaaaaatttcaaattacccaggcatggtggcacacgctggtagtcttagctacttgggaggttgaggcaggaggatcacttgagcccaggagttcaaggctgcagtgagcacgattgtgccactgcactccaacctgcattacagagtgaaactttctcaaaaaaactaaaataaaggcaagtgatttggttcctggttaaggcaagcaggctggaatggaaaagcagccatgggccgggcgcagtggctcacgcctgtaatcccagcactttgggagaccgaggcgggcggatcacgaggtcaggagatggagaccatcctggctaacacagtgaaaccccgtctctactaaaaatacaaaaaattagctgggcatggtagtgggcgcctgtagtcccagccactcgggaggctgaggcaggagaatggcatgaacccagaggcggagcttgcagtgagccgagatcgtgccactgcactccagcttgggcgacagaacgagattccatctcaagaaaaacaaagaaaaaaaagaaaagcagctatgatcaccaaagatcagtcagacctagaggcctcttctctcatcccggaacgtgtacctcatagaacttttggctttccaggatactatacatattaaggtcctgatattaattcacaggtccagcatgggattcacatcctcaaggacatggccacctgcacttctgagttgtctttgagtggccccaaactggatctttgcaggttccagactagtggggctggtaggacaatctttgaagctagaccagttactgggcctctcaggaagaggcacccacaaccaccatcctgaactaaggtctgagctggaggttctccatttggtcaagtgccagttggtgaattccaagagtatcagagatatctgaaagtgactcagaccctctatgggactatgggtggtccttttgcttatttttctaattgttctacaacaaaatgtgttatttttgtgattacaaagagtatatgtctagcggctgggttgccaggtgcattctatttattggtatcacactggtctttgctttataattacagtatttgttaaaatacaaatttgtttaaagactttcctctgtgtatgctctcttccacaattttcaaagtgtttaataaggtgcacatatttggttttcttttttttcttttcttttttttgagacggagtttcgctcttgttgcccagactggagtgcaatggcgcgatctcggctcaccgcaacctccgcctcgcgggttcaagcgagtctcctgcctcagcctcctgagtagctaggattacaggcatgcgccaccacgtctggctaattttgtatttttagtagagatggggtttctccatgttggtcaggctggtctcgaactcccgacctcaggtgatccacccgcctcagcctcccaaagtgctgggattacaggcgtagagccaccgatcccggcctgtttttcagtctctaatacactgttccgcgtccctagcatagtagctgttttctgtaaattcggagcgaagttgactgcaaaacccgccgggttcaccggcctgggcggtgtggacttcaagccccaggaggcattgcggccggcacatcgggaactacggcgtctgagaagggggccgggccctccggtcctttccctcccagaagcccgcgggcggctcggaacgctgtttctatcatggccgcgggagccgggacggcgggccccgcttccggcccgggcgtcgtgcgtgacccagcggcgtcacagccgaggaagcggcccggccgggagggcggggagggcgcgcggcgatcggacacgatggcgggaggaggcgggagtagcgacggcagcgggcgggcagctggcaggcgggcgtcccgcagtagcgggcgggcccggcgggggcgccacgagccggggctggggggcccggcggagcgcggcgcgggggaggcacggctggaagaggcagtcaatcgctgggtgctcaagttctacttccacgaggcgctgcgggcctttcggggtagccggtacggggacttcagacagatccgggacatcatgcagggtgagggccgggccgggggaggggggttggagcgccggggaagggggtccgggggaccgggagtcgggactgggggtcgcccagccaacgatgtcttctctcccagctttgcttgtcaggcccttggggaaggagcacaccgtgtcccgattgctgcgggttatgcagtgtctgtcgcggattgaagaaggggaaaatttaggtatggctatttttgtgttcttctctgggcttacttgcgtagggttttgttttaaaacttatatctagaactgaaggattccaggttaaagtgcgatagtttccatcagagtggtctttttcattctacgatgggtctgttttctggctcgactggctctagttttctccggttaaggttgtcttggctgcttttctgtgttttttttaaatcttctcccacctgttaattgctcaccccaactttgctcctgtctaaagtgagttatgttcatatggacatcttttttcccccatggtagagagtttttcagagtggaagtactctgacatttttcccctctgaatttaacttgaaagctatttagctgttgtcagtttcttgccactcgtatctgaggaggatgggtatattctgaatttgagaggcaaatgcaggtatttaaaaataatttttttgcctgtcttgacaggtgttaaaaaatggtcacgttaaattcattgatttgaatttggacccttatcgtgtatgtcaacctgtagcaaatatgtcaaaaaattaaatgcaaatcttaccatatttgcatgctccatttccataaatatatatatataatttttggacataacttttttacccttagaaaagagcttaaaaatgaaaactgtgctttgtcctagactgttcctttgatatggaggctgagctcacaccactggaatcagctatcaatgtgctggagatgattaaaacggaatttacactgacagaagcagtggtcgaatccagtagaaaactggtcaaggaagctgtaaggctctatttttatatcttttttctttgaccaaaaatcaagggtctttgaggatacagcacttactctttactgtgtggggcagaggaaaacagcaatggggagagattgagcaagcaagaaagcacacacacagacgttatttcttcaggtgtctcctttcccacccaggcttgggaagtaatggcagttgctcagtttttgtgatttgggtggtcttccttgtggctttggcattgaagctctgacattttggaggttactgcaccattcgggagcactctacaagggccttaagtaactctggcctagggtttggtcacccttgtttataataaaccaaggagataaactggggccttggaaaatgtggtactgactttgagttctttctgtctgcagaaagaggggcttagagaatatcccttttgaacagatagattagaatcagaggtgctgggataatgagccagctagcaaaatagtaatggtagaagaatgatagaaatccggcacaggcagtgttcttgaattcaagaaaaaagctaatggagtgtctaggaatttgggattgtcactgtgttgtggctcaggtagcttcaaacagtagaaattattttaatttaaaacatagaagtggctgtgggaaccagttagaaaaagatttttcttcccccaaaaccaaggctggggggtgtggaagcagatgcagaggtgaagatggaaaacatcagctaagcattgccctggtggtagaaaatagggaaatggttaagaaaagagcacccctaaaaggatgggatcccaaagatgggggtggggtagaaagaaaaaccttgcttcacaaggaaaacctgtctcttggctgtgtacattgtacttgggtaccctattaaaaaacaactagtgtgcatgaggtgcacatattttatttatttaattaaggaccttgggcagatactacttttggtctggtaaagaaatgcttaaatattagtcatttccaaggaagaataatttcaagagtacatttttagtataggaaaatcaggtttaggttgaggggaggcatatgccagaatagacattatcaagggaggagaaattcatgcctactttcagaactgttaaggatcttttgaatgggtaccagtttagaataattcatttaacttctattaagtacacattgagtatcccttatccaaaatacttgggaacagaagcattttggatttcagattttggaatatttgcattaaatttagtttgagcatcccaaatccaaaaatctgaaatcccaaatgccctcaaatctgaaactttttgagtgccaacatggcactcaaaggaaatgctcattggagcatttcagatttcggattttcagatttaggatgctcaacctgtagcaactcctttagaacacaagggctatagatttgccatctggcccctcttctggaagagtctttgtgggctttcatctttcagctgcgtatttattattattatttaggctcatagagctccttatttgggtggttcattaggaaaaatctattagaaaaatctaagctctcagagtagccattttcttacgttgactctgttctccttttccagtctccaccacgtactagatcttatgcttattgttactgcagtgtaacaagttactccaagaataagcagctcaaaacagttaatattatctttcagtttccgaggatcaggagtctattagtgattctggctcagggtttctcatgaggttacagtcaagctgtcagctaggtttgcagtcatttcaagactcaactgcttccctactcacatagttgttaacaagactcactttcctactggctgttggctggacacttcagctcctggcctcttcacagataaggctgcttgcaacatggcagctttgttttcctacagcaaatcatgcaagagagcaagaacccaaggcagaagtctcattcttgtagagtctaatcttggaagtgacacattatcacttccaccatatgctcttggtcatacagactagactcactctggtagagtgtgaatgggactccgcaagaggtgaggcgcattgggggctgcctttgaggttggcaaccacaattaccttgatctcctagttgttaaatgatattatttcatccatctcttcaatttactttgtaaaagtttctcatttacagtcacggaatctgttaatgatcgggaaaattctacagacgcctaggttcagtgagccttgctcatgcatttaagctttgtaaagtgccaaaacaatttatttaaaagtatattgaatctttcgcaaagtttatcaagtaagttatttgttaagttagaaccctcagtgcatggtctagggatctctggaggtccccaggaccctttcagagaagccatgaggtcaaaactgttttcataagcagaaccaaaacattatttgactttttcaatgcattggcatttgcattgatggtacaaaagcaaggatgagtaaaatgggtgattccttagcgtgatcaagatggtagtaattgtactagtagtcattgtattcttcactgccacaattttttttaaaactaccaattttaattaagaatgttagtcacagttgtttaaaagctcagaactcccattaaaaaaaaatttaaaaaagaatgtctttggtaaagcagcaaaaactggatgaattttattaactctagagccttgagtaaacatcttttcaggattttgtgtgttgaaatagaaagtatgggccaggtgcagtagctcatacctgtaatcctagcactttgggaggctgacgtgagtggatcgcttgagcctaggagttccagaccagcctgggtaacatagtgaaaccctgtctctacaaaaatacaaaaaattagctgggtgtggtggtgtgcacctgtggtgtcagctacttgggaggctgaggcagaaggatcacctgagcctgggaggtggaggttgcagtaagctgatatcatacctctgtactcgagcctggacgacagagtgaagaccctgtcaaaaaagaaaaaaaaaaaaataagaggaagtatgactaaaatgtttctgctgcataccaaaacatgatggttaccaggaaaagcacttgtgttattattagagttgcatgctgaactagctgcttttttatggaatactattttacctgaagaacaactgacaaattacagttgttcacacttgggtatttggcagtcattttcttgagaatgagtaaagcaaacctgtcacataaaacaagtgacagtatttgttgccagtgataaagtttaagctttctagtgaaaaacagaattttggaaaacttgtattcatgtgcttgatagcttcccaatacttagtcttttctgaagattggtaatattaacaactgacatttaaaaaatattttttaggctgggcgcggtggctcacgcctgtaatcccagcactttgggaggccaaggcaggtagatcacctgaggtcaggagtttgagaccagcctggccaacatagtgaaacctcgtctctactaaaaatacaaaaaaaattagccaggcgtggtggtgggcacctgtaatcccagctactcgggagactgaggcaggagaattgcttgaacccgggaggaggaggttgccgtgagccgagatcacaccactgcactccagcctgggaaacagtgagactccatctcagaaaaaaaaaaaaaaaaattaatgaatgtgtcaatatttgaagatcttcataactcagtgaaccagtattttccagatgaccaatgcatgatgttatgaagtcatccatggatgaaagatctatttaaactacaagatagactgatggattttttttttttttttagacgtagtctctctctgtcgcccaggctggagtatagtggcgtgatctcggcttactgcaagctccgcctcctgggttcaagcagttctacacctcagcctcccaagtagctgttattacaggcgcccaccaccacccctggctaatttttgtattattattagaaatgggtttcaccatcttggccaggctggtcttgcactcctgacctcatgatccacccgccttggcctcccaaagtgctgggattacaggagtgagccactgcgcccagctgactgatggattttaatgtgacagattaagaaaagtttacttactgcagtttcgtgtagaatcaaacaagaatagccacagttttctgaaaaagctattaaaatactcctccattttcagcttcgtatgtgtataaagccagatttttaaaaatgccttaaccaagggtagggcatggtggctcacacctgtaatctcagcactttgggaggctaagacgggtggatcacttgaggtcagaagtttgagactaggctggccagtatggtgaaaccctgtctctaccaaaaatacaaaaattagccgggtgtgtggcccgagcctgtaatcccagctactcgggaggctgaggcatgagaatcgcttgaacccaggaggcgaggaggctgcagtgagctgagatcacatcactgcactccagcctgggtgacagagcaaaactctgtctcaaaaaaaaaccccactctaccaaaataacacatcacaacagattaaatacagaagcagttatgagcatccagctatcgtctatattaaaccagatattaaagagattttcaaaatgaaaaacaaatgtcacccttctcattaaacttttatcttagtaaatgccgtaatttttcataaggatgttatttatgttaccttgtaattagtttattgttattttctaatgaattaataaatatttaaaattttctgatttatgtttctaatacagtgaatatcagcaaatataacctacataaacagaaagctctttgagggtctgcagtaacgttttaagaagaatataaaagaatcctgagaccaaaaatttgagacctgcttctgcaagctgttaattatatcaagactatatttgttttctcctcataactaaaggagagattgatctgttaggtttctttagagaacaaggggtagcaacacgtatagcatgtccttgaagcatttatatgttgctttttactatgcggcattgtcccctgcagctttggcaacagcagcttgatgttctttgagggccttaccccatttggggtgcttgtatatcagatacactctgttagaactttacatttgaaacaaaaatatttgttgaggctttttaaacattgctgcttcccagaacagccttgcttctttttgcatctgcttctttattcttcagttctgtgagtttggtcttcttctcttcctttgttaataaatgtgctttctggcatttcttcccaacataaacctaccttacctattttgaaaatctgtgcttggaatttcccttttatttaacttatccagagaccattgatattgcttataccctagaaaccttaacaaatacgtaagagaagaaactatacttacttctgggaactgccaagtgaaaaagcagtgattcatctttttaatttccccccccccacaggaaattaatacatagttttaaaagataagctcatagcacaacctttgaagcagacttcttcatttcaatttgaaagcattcatatttcctttcttgcttcacacattaaatatagaaggatatgtgttccaattctggagaacatagagtaaacatactctcttctgtctctccctcttaatgtaattataagtcttggacagaatgcatggagtagctatctgaggattctatctggaaataggcatatagggaaggagaccagaatttgaagttccaccaaaccagtgatgaatagtttaccattttttccttctctggtgtcacccagcccagactcaaaggcagcctgaaacctggaagtgcactccaggtgtgaacagaaagagcaccaagagaagctttctctttctggtctgaggagcaaggaaggatctctcaagggtcagagatggtgaaagaaatcccagttttttctcttttttcgcttctttcttgccctggcccccaggcaatactatcctggtggcagcagctgcctagcaatgacggtggcaacagggcagacatctaaaactgaaggaggagaactctttttctcaccaaaggagctgtgatccccagaacatggaacaaattccatagccttccactgtctgtcctgctgcttggccctgggtgcagatgcagttagtgtgtgacagagtggggaaaccaaagtccaggaatgcaaggctgcttcagtatttgaaaatcaatcagtgtagtccaccatattaagagaaaaaccatatgatcatataaattgatgctgaaattcacagaattcaacattagttcatgataaaaacactcagcaaactaggaatgaagggaacttcctcaacctgataaaaggtgtctacaaaaagcccacagctaacattcttaatggtaaaaattggaatgctcaccacttgtattcaacatcataccggaagacctaaccagtgcaataaggcaagggggaaaaagcatacagaatggagaggaaataataaaattacttctttttgcagatggcaggactatgtagaaatctcatgaagtatacaaaaaaaaaaatcctgtaagtttagcaagatcaacacaaaaatcagtcatacatcacatgaaaacagcattttaaagtaaaaaaagaaaagtcagtcatatttccatatactagcagtgaacaattcaaaatgaaattaccaacacaatgccatttacaatggcttcagaacagaaagaaatacgtgtaagtctagcaaaatgtgaaggaactgtatatggaaaattgtaaaatgctgatgaaagagattaaggccaggcagcactttgggaggctgaggcaggcggatcatgaggtcaagagatcgagaccatcctggccaacacggtgaaaccccatctctactaaaaatacaaaaattagctgggcatggtggcatgcgcctgtagtcccagctacttgggaggttgaggcaggagaatctcttgaacctgcgaggtggaggttgcagtgagctgagattgcagcagtgcactccagtctggtgacagagcaagactccatctcaaaaaagaaaaaaaattaagactgaatgttcatgttcatggattggaagacataaattaagttgccacttagctcccgttgatctatagagttaatacaattccagtcacaatctcaacaggattttttcttttttttttttttgagatggagtcttgctctgttgcccaggctggagtgcagtggcacaatctcagctcactgcaacctccgtctcctaggtttaagcgattctcatgcctcagcctcctgaggagctgaaattacaggcatgtgccaccgcacctggctaatttttgtgtgtttttagtagagatagggtttcaccatgttggccagactggtctcaaactcccaacctcaggcaatccgcctgcgtcggcctcccagagtgctgggattacagacgtgagccatcgcacccagcctagcgggattttctttcttttctttgtctttttctcagtttttttttttttttttcaatgtgacaaggtctcgctctgtcacccgggctggaatgcagtggcataatcatggctcactgcagccttgacctcctgggctcaggtgctcttcccactttaccctcttgaatagctggaaccacaagcatgtgccaccttgcctggctaatttttttttttttttttttggtaaagatggggtctccctgtgttcccatattgcacagtctggtcttgaactcctgggctcaagtgacgctcccacctcaaccttccaaagtgctgagattgcagatttgagccaccctatctggcctcagcaggattttctatagatacagactggctaattctaaaacatatggaaaagcaaaggaatttaaataaccaaaaagtgttatattgaaagaaaaatttggattcatactacccaattttaagaattatgagaaagttacagtaattacgactatagagattagtagaacagaagagagcatctaaaaacagacccacacaaatatgactgattgatttttgacaaagatgtgaaggctattcaatgggaaaaggatggtcttttcaacaaatggtattgaaacaattgaatgtccatatgcagaaatgaactttgaccataagctcacatcttgtacaaaaattaactcaaaattataatctaaatgtaaaatgtgaaaccataaaacttagaggaaacatgaaggaatctttatgtcctggagttaggcaaaaaaatcttagataataatttaaaaacatccataagaagaaaaattgatgaataggacttaatcaaaattttaaacttttgctctgagaaaaacactgttaagagaatggaaaagcaatcgacaggttgggagaaaatatttacaaatcacacctgacaaagaactggtatctagagtatatgaagagctctcaaaagaaacaagtctatacaaccctagttttaaatgggcaaaaagctcacccaaaataatgtagatggtaaaaaaaaattacatgaaaagatgttcaacatcatttactcattaaggaaatacaaattaaaaccacagtagattcaaataccaattagaatggaccaaactttaaaaaatactgatagtggggcatggtgtcacatgcctataatcctgctacttgggcacctgaagtaggaggattgcttgaggccaagagtttgagttcagcctgggtgatatagaccctatctcaagaaaaattaattaaaaaaaaaccctaactataaaaagtgttagttacatatttcaaaacatcatgttgtacataagtatgtgcaattttcatctgttttttaaatagagatgggatctcactgttgcccatgctggacttgaactcctgggatcaagtgatcctcctaccttggccttctgaagtgctgagattacaggcgtgagccaccacacctagcctattttttaaaaagcactagtgaggatgtggagcaactggaactctcatatattgctgatgggaatgcgggatgatacagctactccagaaagtagtttggccatttcttataaacacattttccatgagaccatgcaatcctattcttgggtatttaccttagagaaatgagaagttttaccttagagtaaatgagactgttttagcatctctatttataataaccataaattgcagacatctcaaatgtccttcagtggatgaatgtataaactatagtacatgcatggaatggaatactgcccaacaacaagaaaaagtgaactattgatagtgtaccaacatggatggaccttaaaggccttatacagagtgaaaggagccaagctcaaggctacatcctttaaaaaaaaagtcctacacacttacggcttttttgttcttgttttttgagacggagtctcactctgttgcccaggctggagtgcagtggcgcaatctcggctcactgcaacctctgcctgtcaggttcaagcaattctcctgccttagcctcccaagcacctgagactacaggtgcgcactaccatgcccgtctaatttttgtattttaagtagagacagggtttcacatgctgaccaggctggtcttgaactcctgacctcatgatctgcccacctcagcctcccaaagtgctgggattacaggcgcgagccactgcgcctggccctttttttttttttttttttttttttttttttttttttttaaagagagagagggtctcgctttactgcccaggctggagtgcagtggcatgatcatagctcactgctgccctcaaattcctgggctcgggtgatcctcctacctctgcctcccgagtagctaggaccacaggcacacgccaccatgcctggctacttttttgtagagatgggttttcactgtgttgcccaggctggtttcaaattcctggcctcaagtgatcctcctgtctcagtttcccaaagcactgggattacagttatgagccaccgggatcagtggttgccagggttaggtgtgactacacaggacagccaaggcagggttttggatcctcattgtagtggatgatacaggagtctacgtgtgttaaaattccaaaccagatgtcctaaacaagttaattttgttgtatgcaagttaaatagaattttaaaacagtaagacctgtatgattaaaaaagtaaaaactttgtattcaagaaagtaagtatagtttgagcatatgtttttctgctgaaagtgatgtataaatggatatggtcatctgagtaaaatgaagacttactttgtaccttccctgtgcagcaagaactgtgcctgcatattcaagggcatttgacatcagttgccttccgccctgtatggctgtgcttaacacgttgaggatagaagcaacagattagtacttaatgaatttccttgctattcttccccttagtctgtgtctctgtacattcttccctgtgaagatcaaaaatatctgtgaaccaattttccttttattgtttgttttgagacggggtatcgctctttcgcccaagctggagtgcagtggtacagtcactgctcactgcagccccgatctcccagacccaagtgatcctcctacctcaacctcccgagtagctgggaccacaggcacacaccaacatgcctgggtaggtgggtttttttgggggagagacagggtctccctatgttccccaggctggtctcaaactcctgagctcaagcgatcctcccaccttggcctctcaaagtgtgggaatacagttgtacagttgtaagctgccacacccagtcggcttgcctttttttgtatggtggtctttttaaagaatctgtgtctctcagacaggatttgagatagctactttattctatcatataacttcaaatactcccaattttttgttggcttttctaatttttaaaaatgttcatatatattataacttccttgtaaatgttcagtcactgttatttttcctcaagagaacctcattctcttgaggtttctttatggaaggactctactttctctctgtggctggtgagaccttatcttacctggaactttgccctttttatttgctgcttgtgaatgacctgggtttgttggcttcagtagttccctaggtgctttaattgaagttgccagctggggtttatggtagtaaggggttgtcccttcattctcctacagaactggccttaggcctttccagaatggaactagcagaactctgtggtcagcacatctctttctttccgcctacagtatatcctccctccctcatccccctcttgctttaaagcttttgcatccaaaaagaacagaatcaattgttctggggacctgaaattacaggacgtagaatgactcctgtccattctgtctttcctcaggaggccctattgaaattggttaaatggtctgtaatccaggtgatcagattttgctctatcagccatgtaacaaaagccattgtattgttgaaaagtgactaccttacaagcagaaagagacagcttccagtggttcataacacttgaacaataattgtttgtttgttttttttgagatggagttttggctcttgttgcccaggctggagtgcagtggcgcgatctcggcttactgcaacctctgcgtcccaggttcaagcaattctcctgcctcagcctcccgagtagctgggattacaggcatgcaccaccatgcctggctaattttgtatttttagtagagatggggtttctccatgttggtcaggctggtctcgaactcccgacgtcaggtgatccacccgccttggcctcccaaagtgctgggattacaggcgtgagccaccgcgcctggctttataattgttagtttttaagtacagaaatttgatatgatgtgagagagagttattttgatgtttgatattctgattacacctgtcattacaaaagtaaaaaaagatttttcccctcctttttaggctgtcattatttgtatcaaaaacaaagaatttgaaaaggcttcaaaaattttgaaaaaacatatgtccaaggaccccacaactcaggtaaatttgatacatttttgctcctgtgacttaaattcatctcattgctttttgtggggaaatagggaaagggttcttggtcaggaatattacttaaatattctcctttcaacatgtaacacctgcagcaagttatcttttatatccaagataactcactgtaagattggcttttcaaaatttagtttttattagagaaattgacataaattattcacttgccttatttctgtctagtttataacagaacattgatttaaatgatcagcaccaggtatggagctgacaaatgtaacacttctaactttatttacattaaatggtgatcctgcagatgtgaggaaacttctttggtgaggacatagcacctgtttcctggtgtcaaaagttctgttggtcccctgcttttattttttcttcttcctttttattcatttgtttatttattttttttgaggcagagtctcgctttgttgctcaagctggggtgcagtggtgcagtcatagttcactgcagcctcaacttcctgagctcaagcagttcttccacctcatcctccccagtagctgggttcacagctgcatgccaccacacatggctaatttttaaattttttgtagagacagggtctctttatgttgcccaggctggtctggaactcctgggctcaagtgatcctaccacctcggcctcccaaagtgctgggattacgtgaatcatcatgcccaaccatttcttctatatactttttttttttttttttttttgagatggagtcttgctctgttgcccgggctggagtatagtggcccaatcttggctcactgcaacttccacctcccagtttcaagcagttctcttgcctcagcctctggagtagctggggttacaggcatgtgccaccatgctgggctaattttttaaattttttagtagagacggggttttaacatgttggccaggctggtctcaaactcctgacctcaagtgatccgcccgcctcgacctcccaaagtgctggcattacaggtgtgagccactgcacctggcctctatataaattcaaattttattatttgaaaaggtaatacatgtacataatacagaattcaaaaggtataaccaaagagtttggtgaaaatactctcatctgtgaccctcagccatcttcttcccttcagaggcaaccaatttctttttttttttcttttatcctttcaaagatcctctatgcatgtgcaagcaaattgtgtgtgtgtgtgtgtgtgtgtgtacagacatccacatagatccattttctccattcttctcatacacatacgtgatagcatatcctacacactaatgtgaacacttttctaaattgcttttttcacttaatattatatcttggaatcattctatgttagcatataaggaacttctttatctgttttttatagctgcatagtaacccactgtggctgaacctgatttattgaccaatcctttgtgttgggcttcccttcctgtatgtgtgccagtgatttgcattgacggcattgcagaagttctcatagtgtctgtctcacctcatcatcattgaatttttactggagttctactttctcatgttgcaaatatcggtccattgtgtagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacggtgcgccttggcccttctcccataaccatggtgtgcccttgaggatgtgcggggaatcagaatatctgaagtgaaaagagttgatgtgtgaaaaagacattgaattgtatgcactagctttcttaattaaatgccttaaaaatgcaaaagcaggccaggcgcaatggctcacgcctgtaatcccagcactttgggaggcccaggggggtggatcacctgaggtcaggagttcgagacctgcctgagcaacatggtgaaaccccatctctactaaaaatataaaaattagctgggcgtggtggcaggcacctgtaatcctagctactttggaggctgaggcaggagaatcgcttgaacccaggagatggagattgcagtgagccaagattgcgccattgcactccagcctggacaacagagcaagactccgtctcaaaaaataaataaataaataatacaaaagcagagatactggcagaggcaaatggaacacacctggtctccctcatctgccatttttatctcctttacacatggttaatctgccatggttgaagtagaacattcacttgcaatcgatggtggttcccaaaggcgatgacttgtgaactaagtttggaggaagggtggtttggtagatgtggtacgatggagttgctaacaggaagaaggcatggtgtggagaaaggtgtcactgaaagtataaagttgaaagaagccaaatgaaaacattctttaattggatcaaagagataaaagaatggaagcagtgaggctcaggacagcatagggaagaactagacccaggctgtcatagatgggagactgtggtgaaggaacactgagtgagagtggttttgttttgtttttgaaaccaggactttggcccagtacagtggttcacacctgtaatcccagcactttgggaggccaaggcaggcaggttgcttgagcttaggagttcaagaccaccctgggcaacatggtgaaaccccttctctacagaaaatacaaaaattagccaggtgtggtggcgcgtgcctgtagtcccagctacttgggaggctgaagtgggaagatcacttgaggctgccagtgagctgtggttgtgccactgcacttcagcctgggcaaaagaaaccaggactttgagaatgtggaaaatattctgtctcgtaacagatctgccaggcccatattaggatagtgtccatgatcttagcagtcgtttggcaaatctcagattatttataagcaggtagtttgggatattcaggcagcaggtgtcaagatagttgagcctggcctagggtcctttcctttccattccaggtaactggaaactatccttatctatataacacaaagagccctgattagcctactcagggctctttgtgttatatagataaggattctcaaacagttgttaataaggcaaaacatttgtagaaacagttataaaaattctatacacaaactggaagatattagtatgaacatttattgccgggcatggtggctcatgcctgtaatcccagcactatgggaggctgatgcgggcagatcacttgaggtcaggagttcgaggccagcctggccaacatggtgaaaccccgtctctactaaaatacaaaaattaactggacatggtggtgggcgcctgtaatcccagctacttgggaggccgagatgggagaattgcttgaacccaggaggtggagattgcagtgagccgagattgcaccactgtgctgcagcctgggcgacagagcaagactccctctcaaaaaaaatgtattagttatcttaagtttgaataaaaaaagcttgatttataagtcttacaagttctctcccattttatgtccttcgttttatgcctagattggatttgtaagtgaacttgtttgcatattgagtatattcttggtgaaagaagcagagaattaatgcaattctgtggcctcttcttcctgatgacatccttcctttcccagatggccaaaaaggctttgaaatctgagtccgctgcctcaagtacagggaaggaagataaacagccagcaccagggcctgtggaaaagccacccagagaacccgcaaggtaaaaagatgctctcttgtgatcttgggtaaaacactagggtggtcgctggaagcagtctcctccttaggccaggatcagttcctctcagcactccgacctactaacgtgttacgaggttactcatacaaggcactgggggagactgcacaccctgggaagataaggaaacaggatgcctggggtccctgacaacttcctgactggccattcctcaaaggctctttcaccatttctctctccttgcctcccccgtattgactcagtacttttcttgtggacacctaatctcttaatacattcaggaagcactgctcagatctgtgagtcgaatcccaaaaccagttcctaaagcaggggtcacaagcttagatgccctttgagggccggttaggaaacctaaaggaacaaagtggacctaggctgagagcatggggctgggaaccaggggatgtgcttttcagcttcttgtggttgttgctctgtgggagtatccaaggatgctcaggcttcaggtgctcagatttttgtatgagatgtccagggttttccatgagatttcccagtttttggatgttaacagttgatccacttaaaaaattttttttcatgttggttagacaacaagacaggctgccagatggatttggcctgcaggctgccagtttgccccctctcctaacagtttttccctaaagcatactaactgttccaaatgatagatgaactttatttttaaaaggcagtttctcattgttccaagactgtgtggcatgccttttactctgagaattctcaagatcctgctcttaagtgtgttgtaggccgggtgtggtggatcacgcctgtaatcccagcactttgggaggccgaggtgggtggatcgcttgagcccaggagttctaggatacagtgagctgtgtttgtgccactgtatcctatctctctgtcctatctactgtctaggacagacccagaccctatctctaaaaataaaatgagaagtaaaataaaggttctctaacttggagttttaaattcataatacaacttacatatcacatttaaagcctcctcaactggaatttgaagcttcaaacttcaaaaaagttgtggctgtttggatgagcatcatcagtggtgaaaaacatctttgtgcctatgcttgatttgcaggcagctacggaatcctccaaccaccattggaatgatgactctgaaagcagctttcaagactctgtctggtgcacaggattctgaggcagcctttgcaaaactggaccagaaggatctggttcttcctactcaagctctcccagcatcaccagccctcaaaaacaagagacccagaaaagatgaaaacgaaagttcagccccggctgacggtgagggtggctcggaactgcagcccaagaacaagcgcatgacaataagcagattggtcttggaggaggacagccagagtactgagcccagcgcaggcctcaactcctcccaggaggccgcttcagcgccaccatccaagcccaccgttctcaaccaacccctccctggagagaagaatcccaagtatgaagaccttctttgtagaaattttggggctggttggtggtcctggttgggcctggtattacttccgtgaatgaagtaactttcagctaagttactcaccaccaaggcttgctcagactgctagaacttgacgcaggagtggccagtgacgacgtagccatccctgccggttctgaagccccgcatgtgggcttccaagccttgcactagggcatgagtgggaatggaaaggtttcagagcctcctactcatcgctgctttcatttttagcaaacatctgagtgtcttgacttctaaacattagtcttgtgtgttaaaagaaatttgtttgcattgggccacattatactttgacccttaaaaagagactgatgaatatgtataattttgcacccttctgagcatttgagacttggcaagttcagtgaatacttactaatctcccatgtcctgctaggtactgtggggcagtggctagaatactttaattttgctccccattgtgattctcatcctggctttgagttttgcttccctttgtgtcctgtggtggatcctccctccaggcagactggcctgcttgctctctggaacatgttgtttgtttctaccactgtacttttgcttcctctcattccccacagtggaccgtcatcccttcatcattgcttgtccaaatcccatttgtcctttaaagggaagaaaagccgttgttgatgaagtgctttctgggggcagagcactttcatgtatcatcttactgagtcactacaatcctcactctgtgaggtgatgatatattagccccattacacagaggagaagggctcagaaaagttcttagctcacctgaagtcacacagctaaaagtggcaaagatgggctttggatttttaatccaagtcagtcttgacagaaaagcccatggcctgtataccatatacaacaagttgcctctcttacaattctccttcctcaggctgggtgcgctggctcacacctgtaatcccagcactttgggaggctgaggcaggcagattacctgaggtcaggagtttgagagcagcctggccaacatggtgaaactccgtctctactaaaaatacaaaaattcgccaggcgtggtggtgggcgcctgtagtcccagctacttgggaagctgaggcaggagaattactggaacccgggaggcggaggctgcacagtgagccaagattgcaccactgcactccaggctgggcaacagagtgtgactccgtctcaaaaaaacaaaaacaaaaacaacttctccctcctccacagactcctccctggtcaccactagtgatccaccttatggatctcccaaggccacctctgcctctgctctgtgttgtattatttggggacctgtggtctggcatgcattgtacttggtgccccaaagggctgtggcatctgataagtgatttatcctcaggcacagatttgcactatgtcaccactacttgtatgtagaagtgagtcaccggctggcaaatgggcatagctgctgggcagtggatgcagctccatgcatgttattctcatttgatacaggatctcattggcttctcacagcaatcctgtgcactataggtattgctcccgggaacagatgaggaaacaggagagtgcgagattacagtaattttgtaaatgggaggatttgtgaaggtttcagacatacaccctctctcatatgtcaaggatatgaagtctaatgaatcccctaaagcagcaggggttggcaagctgtggccctggggccaaatcagcctactgcctgtttttgtaaataaagttttattggaacacagtcacacccatcatcaatgtattatctagggctgctttctgttcattggtagtttgttgagtagccacagcagagacaggcttgcaaagtgaaaatactatctggccctttacagaaaaaaagggtcagtgtccctgctctaaagaagtatgtgtgaggtgccctggccacttatgggaagaaaagctgagcctattcagcaaggttttaggtggctcagattttatagaggaacaaacattgagctggcctgggaaggatgagcagaaggtcgtcgagtgtgttgggggctgggggactctacgcagtgggagctccttacatacaggcatgagaaagcctggtgtgcccctcagagtgtcatggagcctatggtaggagaatacggtgcataggaaagagtgaaggtaggagagtctgcatgctagatgggccaggcctgggatttctgtagtctagtgtgtcaggcagaggctctcaagctgggcttcatgacacaatgacctgtggaatgctcaaaaaatacatattcccaggctcctggctactgaattagaagagtcaggagaatgccctttaatctgctttttaaaccatgccccagataattctaatacaacaaattggaaggcctgatgagaccccactcagggaagggagggagggaggctggagactggagaccgctgccagggagcagggaggggcagtgggatcaggagggaaggcagggttggcagtgtcacttggacagggccaccatgccccaatcttgtatctcccacggcaccttgcacatagcatgtgtttactaggtatttattcaccaagtaaaataaggattctttgttcttgcatgttaaggagtgacacccaaaacacctgtaaaaagccagcagagggtaacattttaggcattttgggccacatgagttgtctgtctgttccatattcttttcttgttttttctttttctttttttcttgagacagggtctcgctctgtcacctgggctggagtacagtggcacaatctcggctcactgcaacctctgcctcccaggttcaagcgattctcctacctcagccaccatccccgcccccatcccagtaactgggaccacaggtgcgtgccaccgcacctggctaatttttgtatattttgtacagatggggtttgaccatgtaggctggtctcgaactcctggacttaataagcgatccacctgcctgggcctctcaaactgctgggattacagacgtgagccactgctcccaactgtctttttttgtttttttgttacaacccttaaaaaacgggcttgccattctcaccccaagcttcatggtacacaagccgcagcagccagactgtagcttgccaacacttgctagaccattgctcttcatgttcaaactgccagtcaggagcacaaggaccaggaagtggcctgacttggccaggaccactcagcccattacagttaggaggagcggccagatctcagccccatccacttgggaagtcaggagaggcagtgaacacatcacctgaaagtcagaggtcttgcgaaatcaccaccaaagcatgtatttgtacaggtaatagtgctgagagttcaacagaggacagggagaaggtgacctgtgaagactgtgcagggagggaggacagccactcagggaacatgacggaccagctggggactgaggttccaactggttttattccagcactgggataagcacatagaaaacaaactataaccccatctgatttttatttatgaatagtcattaacacaagaatatcctgagaaggaaaaacctcctgtaaaatgttttcactttgtctcaagtaaattattctcaagtaacatttggggataagatccaatgtaaaaacaagagaaagttaggtctaccatttgtctcagccacttagttaagtaatttcatagaaaacttatggaactcaaggaattttttcaagcctatgtacttattcatcaacttgcttttattattcatttgcaaaatacccaaacagcattaaaaataagttttttcttcatggcgggtgaagaatacagaaatttgtctctattcttggttaacttttgcgggtcatttgatttatataaattcctcaagactctgaattcagacactttccatgtttgtaaaagatgttataattctgaggtcagatctgtgctttgctctgttcccagggcagttattaatcaggtaaatgcaaagttgattagaagaaatgggctatagttttcattgaataatttgagtttggggttattttcagcttttgtactttttttagccacacccaagcatttaacgtttcatgttcacaagaaggattcttgtttgctttttactctaatctttgatggtataactcccttgtggctctctgacaatcacaatgttagttcagctaatatgtctccagctcacattggggtctgtgttactgtgctgggtatgctatgtgtttgggatggacaaaggaagatgtggcccccgccttcgaggcggtcctggttaggggcacactgcaaagtggcacttggtatggtggaaacagcactgcaggcaggaggagaaaggctttctgtgtgtgttgtggttggtagttagaggaggcttcactgagaaccatggccttgaaagatggatgagatgtcacttagcagggaagggactcccaagcagaggggctacagagaggcaggaaagtacagagcttatggaaggaagaaagagcagaacagtgtggctgtgctgtttgcacaggtgtgggcatcgtggggcggttggttagaaactgacgggccagactggatggtgtggactcccccatacaggcatatagatgccactgttcaggcagagagaagccattagggaatagaagaggcatgtggtaattttagggtgattgtcctaaaatcatctttggctttggaaggggaagagcctagcggcagagactctagttaagaggctagtggaatactgatgaaaggcgccgtgagcttgaacaagggggaatggaaacggaaaaatcagtccagatataggaagaaggcatgtccaaggaagagagggaggggtttgcaggttctaaatcagaaaaatactgagacctttaaaagagtcaaaaccaaacaagcaaaacaggaaaatgaacagattctttagaggggtggtgatgtgcttgatgtactcagtgctgaatttgaagggtgtcctgcagcctgaggggtgttacgtggagatgcctggccagccaggagaaaggacagtggctttgggaggtgcatgcaggcgaacctcgattgtggtcacaacgggacaggaaggagtacagggccaagagtgagccaagaccagaatctgggacaatccagggtgaatttgttttatacctgtgctctccttgatctcccctcagagtacccaaaggcaagtggaacagctctaatggggttgaagaaaaggagacttgggtggaagaggatgaactgtttcaagttcagggtaagcagaagattctccttggcctcttcttgatgcttgctgaagtacagatgcgtgttactgtcatgttaatattccagaagctgcttgtctccgaactagaaaaagttcagtaagttcccgatctcattttaattcatgaagaatcagtttttttttttttttcctttttcagacagggtcttgctctgtcacccaggccagaatgcagtggtgtaaacatggctcactgagcttcaaccttctgggctcaagtgatcctcctgcctcagcctcctgagtagctgggactgcaggtgtgcaccaccacacctggctgtttttttcactttttgtagagatggggtctcactttgttgctcaggctggtctcaaactcttgggctcaagcgatcctcccacctcagcctcccagagtgctgggattacagatgtgagtcactgtgccctggtcaaggagtcagtctgatgtcctctcccattaaataatggagactgtcagagtaacgccttatgtttaaagagagttcttggttttgttttaataacgcctatgatatttaattatagttgatgttcttcctaaaatccttcaattagatgtggtagtagggggtcattccctgcatttcttgtttaaagaaaaaaaaatcttaacagtttctatatataaatcctttttttttttttttttttttgagacagggtctcactctcatccaaggtggaatgcagtggtgtgatcttggctcactgtagccgtgacatcctgggctaaagcaattctcccaccttagcctctggagtatcggggactacaggcccttgccaccatgcccaactaatctttttttgtatttttagtagagccagggtttcaccatgttggccagtatgatctcgaactcctgggctcaagcaatctgtctgcctcatcctctcaaagtgctgggactatacttgtgagccaccataccataccctaccaaaattgttttctttttttcttttttttttttgagatgcagtcttactttgttgcccaggctggagtgcaatggtgcgatctcggctcactgcaacctccgccttccaggttcaagtgattcttatgactcagcctccttagtagctgggattgcaggtgtgtcgcaccacgcccggctaatttttgtatttttagtagtcgggttttcaccatgttgggcaggctgctctcaaactcctgacctcaagtgatctgctcgcctcagcctcccaaagtgttgggattacaggtgtgagccaccgcccagacccaaattgtacttctataaaatgaacaaggacttgaaaattctaggctgggcgtagtggctcatgcctgtaatcccagcactttgggaggccgaggcaggcggattccttgaactcaggggttggagaccagcttgggcaagagggcaaaactccatgtctacaaaaaatacaaacaaaaaaaatttaggccaggagtggtggctcacgcctgtaatcccagcacttttgaaggccgaggcaggcggatcacaaggtcagaagttcgacaccagcatggccaatatggtgaaaccctgtctctactaaaaatacagaaattagccgggtgtggtggcaggcgcctgtagtcccagctactcaggaggctgaggcaggagaatagcttgaacccgggaggcggaggttgcagtgagctgagattgcaccactgcactccagcctgggcaaaaaaaaaaaaaaaaaaaaaaaaaaaaaaaattgggaatgatagtaagaggaagattaaaaaatgaaggagaaaaaaagaaaattttagtacaaaacagcaaaaccatatgatttctttttttttttttttgagacagagtctcgctctgttgcccaggctggggtgcagtggcgcgatcttgcctcaccgcaacctccacctcctgggttcaagtgattctcctgcctcaacctcccgagtagttgggactataggtatgtgccaccactcccagctaattttcatatttttagtagagaaggagttttgccatgttgtccagactagtctcgaactcctgacctcaagtgatccgcccgccttggcctcccaaagtgctgggattacaggcgtgagccaccacacccagccaaaaccatgtgatttcaaagcagtggttagcaaggggttataatgcagaaattatacatataaacacacctatagtcatgtgccacataacaaagttttggttaacgatggactgcatatatggtgacggtggtcccattaggttatatatagagctgaaaaattcatatcgcctagtgacattgtagatgtcataggcattgtaacattgtagtgcaatgcattactttgtctctgtttagatatgtttagatacacaatatttaccattgtgtcacagttgcatgtcacatgctgtacaggtttgtagcggaaaaataggctacaccatatatcgtaggcatattccttttttgcagaggttagctaagttaatagtaatcggtaagattaaggggattaggactgttatagcagtggaagaatacatgtttgttacttttatttggagttgcaccaatgtttttggttcctaagtccagtggatgactctagtcctttaaaagttgagaaagccatgttgttagacatggggacatgagttagcagttgtcagatactttctccatagataagaagttgcaggctagagcctaggctctaccatctaggtttgtgtaagtcacacaaggatgaaatcaccaaacgatgcatttctcagaacatatccccattgttaagcaacatatgactgtatatatacatacacacactaatacctatatgtatatgtagacattatatatacataagggttttaaatatgacgttccctcagtaattttagaaaacgatgttggggccaggcatggtggttcacacctggaatcccagcactttgggaggccgaggtgggtggatcactaggtcaggagattgataccaccctggctaacacagtgaaaccctatctctactaaaaatacaaaaattagccgggcacggtggctcatgcctgtaatcccagcactttggaaggccgagatgggcggatcatgaggtcgggagatggagaccatcctggttaacacagtgaaacccggtctgtactaaaaatacaaaaaaattagccgggcgtagtggtgggcgcctgtagtcccagctactcgggaggctgaggcaggagaatggtgtgagcctgggaggcggagcttgcagtgagccgagatcgctccactgcactccagcctgggcgacagagtgagactccttctcaaacaaacaaacaaacaaaaattagccgggcgtggtggcgggcgcctgtagtcactcgggaggctgaggcaggagaatggggtgaacctgggaggcggagcttgcagtgagccgagatagcgccactgcactccagcctggggaacggagcaagactccgtctcaaaaaaaaaaaaaaaaaaaagaaaacgatgttgattttactgaagagcttgaaacgcatcactagccagcatttacggatgcctgtttgtaaagcacttgcattgtacaggttctcataggctgaagtgactggtgtttgcaaataaaggagaaaagtaaattatcctttagtgatatcctttctcttctcaatgcttgtgaaatttgaagaagttttccctttggggacattccatgtctttttcttgtggtttgtgcagagaaaggtgaactctgaaatgagtctacttttaatgttttccagcagcaccagatgaagacagtacaaccaatataacaaaaaagcaggtaatttaaaattctcttttctgttactggttatgtgggtagagcagaggtaaaatacgcgccctgtctcacaggtatagactggttatgtacccagtaaaaacctttttttgagattttcagataatccaaactaagttaaagtaataattatcttctggaagaaaagactaggaaaacagatgacacattttccggaacatgaatgatgtagatatgtttgcagtttggaatgcagaagtgattgttacttgaggatcaaatggcaggacatcaagaattcctgtgtccagatccacagtgctcatatcttgtccattccatgtttaaaaacataagctgtgatttcaggttcagatgattctcctgggattcttgagtttaccttatcactacattggagaaaatgtaagtaagtggagaggaaaggtggtaataaatcttttggttttcttttgcagaagtggactgtagaagaaagcgagtgggtcaaggctggagtgcagaaatatggggaaggaaactgggctgccatttctaaaaattacccatttgttaaccgaacagctgtgatgattaaggatcgctggcggaccatgaaaagacttggcatgaactgaaacaggctttcatttccacagaattcacaggagcatggttcctaataatagcccctgatagtctgctctttctttctttttcttttttttttttttttgagacagagtctcgctctgtcacccaggctggagtgcagtggcgtgatctcggctcactgcgacctccgtctcccgggctcacgccattctcctgcctcagcctcccgagtagctgggactacaggcgcccgccatcacgcccggctaatgttttgtatttttagtagagacggggtttcaccgtgttagccaggatggtctcgatctcctgacctcgtgatccacccaactcggcctcccaaagtgctgggattacaggcatgagccaccgcgcctggcatctgctgtttctttcagaagctgggctgggatgagaattttgggcaacctccttcgacgtgggggaggtcccatttccacttcatcactgttggagatcatggagctaagaagcagagccaagtccacccatgtccttggcagagatgacaggcacacagcttgtgcagtgccagaatatcattagcgtttcccttctttagtggtttgcttaaatttaaatccctggtaatctgtagaaccttctcctaggaaatggtgaagtctattaggagccacttgtgactccatgacctgttaaaaccagcaatgtgagtattatttggagtaaatttgttccacgtcaagttctggccttctgatgcaaatgcaaaggaacttagtctgttatgaacccaggttgatgacagaccagtccttgtggaataagattccctttaaaaactctttagccagtcgtgacatcaaccctagacctgtctgccttggcatttgctgtcaacatctgctgggctatgtaggcaggttaatcctccacttctcatgtggttgaaccagtgtgttttttggtaaaatggtgattgtagataagattagttccctgatcccctgccccctgtcccctgcctcttttcccaattcccttccttatgctggacttttaaagcttaaaaaaaatccgattgaatataaatgcctaatttcattctttgtgaaatggttgcttcctcctgattccctaattgtgctgtgttcgtgtcttgcactggaattcaacattcccttctccttttgtactgtgttgtgcttgctgtctctcccggacacccttaaagactgtctttttagcaaaaaatttcagtaaagtgttttctgtaatctttttttaaaaggtgagaactaattattgtccatacttgtagcattcttcattaaagtcttgcttctctcaactgtaagtagctgtttaattgcagcacagcatgtatccacagagggaggtagcaaaatgttaaactttgctgaactattttgatcaagaagctgatgtcagactttattgaatgttttaatccttggaagctatgtcaaacagatgatatggaagtttcctcttaacctttcagtttcctcatatatcatttctggggacaaaagaattccccctttctcacttctgagtgagtgaaaggcaaggcttaaagaaatgctaaagttttaaaattcatccattaggccaggcatggtggctaatgcctgtaatcccagcactctgggaggccgaggcaggaggatcacttgaggtcaggagttcgagaccagcgcggccaacatagtaaaaccctatgtactaaaaatacaaaaattagctgggcgtggtggcgggtgcctgtaatcccagctattcaggaggctgaggcacaagaatcgcttgaactcgggagatggaggttgcaacgagccaagatcatgccactgcactccagcctgggcaacaaagcgagactctatctcaaaacaaaacaaaactggctgggagccatggctcacccctgtaatcccagcactttgcgaggccaagaagggtaggatcacctgaggtcaggagttcaagaccagcctggccaacatggtgaaaccccatctctactaaaaatacaaaaacttagccagccatggtggcaggcgcctgtaatcccgacctctcgggaggctgaggcaggagaattgcttgaacttgggaggcggaggttgtgatgagcggagatggtgccattgcactccagcctgggcaaaaagagcaaaactccttctcaaaaaaaaaaaaaaaaagtttaaaattaaaaattttgaaaaatacaaaattagccaggcatggtggcaggcgcctgtagtcccagctactcggaaggctgaggcaggagaatcgcttgaaccggggaggtggcggttgcaataaaccgagatcgcaccactgcactccagcctgggtgatagagtgagactccatctcaaaaaaaaaaaaaattcatccattagttacaagttggaaacttcatacagctttattacctattaactgcattttggggtttagtacctattgttcttctatcaaccaaccccaactgaaaccacagggagaagttgagaacttgagctcctttcaggctagccgccttctgcctgcagctggtttggtctccctctgaaccggattagaatccagaagcttttctccccttaactctcatgtgagtcaatggtgctctccaggtagaggagtgaaactgatgcatttagggaaacaaaatatcctaatcagtgtttctttttatttatttatttatttatttatttatttatttatttatttatgaaatggagtctcactctgtcacccaggctggagtgcagtggtgctatctcagctcactgcaagctctgcctctgggttcacaccattctcctgcctcagcctcctgagtagctgggactacaggcacccgccaccacacctggctaattttttgtatttttcgtagagatggggtttcaccgtgttagccaggatggtctcgatctcctgacctcgtgatccgcccacctcagcctcccaaagtgctgggattacaggcgtgagccaccacacccggcatcagtgtttcttaaacttgagaatgcctatgttcattaatattttttcacataattcagtgttgtttttattatagttattgaaatgtgtgcaaagataaaactatgcttacagcttctgtagaactataaaacttactatgaactgacgattgtttcgccgaaaccaagtcactgcttatggcatgaccagtgctaggactgcgacggtggtgggactcgggtgggggatgcc

SEQ ID NO: 15470 - DNA, 9871 bp, Human
accaggaagagcagggcctggtccgactgggatcccttgggttttccgttccttcccggttgggtcgtgggaaagcggcacgtgggtgtggccggcgccgcctttgccaagaggcgaggctcgagcggggatgagaagcgtggcgagtgcgttcgcggctgctttgacctggtgggcgccgcctccggcactgcaccgaggcggggcgccagcgcccaggttgctgggctggccttggcgcccccttcccctacccagagcgcaggcaggcaggggggtcccgccgcgccccttcagcatgtaagctccggaggggaatgggggcgctcctaggctgcggatgcaggcctggggactcctgggccgcaggcgcgagcagtagggtggcaacagggagggctgggagtcctgtgaaggaagcacacggcgggctccccgggacggtggggcagagcgcccggaggccgcgcttcccggagaggctaggctgccagcagctcttttcgggccaacgctgctggaaggctgctagtgccggagtctcaggtcgatttaggcagtgactgcgtgttcttcgtcccttctacgtgagaggcgtcccgacaggaaagtgtgtttgttttgggggctccgtttcctgagacctaagagttggagcaagcttggaagcgaggcatcattgtctgtagacctcagtgaacatggggttctctagatcaggcaggtggcagagaggagatagtgtgggtcagaatgggaaggccggcagccatccttgccaccttttctttcccctccctcacatccccctccccacctgctctggaggaaaccacagtcaccctcaccactagggtagctcttcggggccggaagtgtttccatttttagggaaatgacttacctgagacatgaggcaggaatccattagaactcccattgtgctatggggagaccaagtctcagagaactggggcaaggtcaggcagccaggaggcagaagtgctgtcttaaacccaattctctagtgccaagtcctgggctgttataaaatacagctgtttccaacaggggagatgttaggagccctgacttagttgcaaatggaaaccgggcattgtttccaggagtggctgggcagggggacacgcacagagacgcatgctgcacgggcactaggaccaagcggatgggatgcccaggcagccactgtggaggctgctgcagtggtggctgcagttccctgtgctttcttcagccctgggctctaggaggctgtccactccccagcttgcatttcctggtctgcctctccccctgctttccctttctttcctgcctctcaagtaaaaggtgagaaagtggaggacacagggaaagtttctctaataactgtcttgagaaagggaagctgctgctttttcccaatgcccctttgtttgctgtttcttttgctcctgcactttcttcttgggtcttactggtggctgcactttactggtgaatatcccctccaggagtgggtgcagggtagggggaagctcttaggccactggctgcctccctggccctcaggtgcccagagctgcctcaggctcacccccttgaagcttacctcttcagcgctttgggccaggtagagcccagttctgccacccaccagccagatgtcacgtgaccctctgggccttggcttgtctaccccagtgctacactaagggctttgtatgtgtcgcccatttaaccctcaaagatgccttgaggttagtcctgcaacccacattttacagatgacgtaagggggcacagacatcaagtggcagagctgggatctgaaccccagtagtctggcttctgagtctaccaagtcttatgctcagtaagcggtaacggttttgatcagtgggtcatgtccactagtaacagagaacacccatgctcccacggactggaaatgctgcctcctgcctgacccttcatctcctgccttctctcgccagatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctttttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtaagggcgcctccctaggagcgtgtgtacatggggataagtctggacagcctggcaaactctccgccaagaatctgaggtctggtctaggtcccttgggttgtgcacacacctgtgcacttaagaaggcaacaaggtggccgggcgcggtggctcacgcctgtaatcccaacactttggggggccgaggcgggtggatcacaaggtcaggagatccagaccatcctggctaacacggtgaaaccccatctctactaaaaatataaaaaattagccgggcatggtggcaggcgcctgtagtcccagctactcgggaggctgaggcaggagaatggctcctggggaataaggcgtgagccaccacacccggccttattattattattttttaaagacaaagggtctcactatgttgcccaggctggagtgcaacggctatttaaaggcatgatcaatacgcactatagcctcaaactcctggccttgggcagtcctcccacctcatcctccctagtaactgcgattacaggcacatacaccaccgcacccagctccatgttagcccttttaatcctcttaacactcccagggagaagtgctattatctccactcatagaaggtgaaagcaaagcacagagaagctaagtaacttgcctaatgtcccattgctagtagggtgcagagccaggatttgcgcccaggccgtctgtctcaagtcttctcttacctgtgatgcagcactgcctcagcaatggcaacgtggggctgaacctcttcataagaaagcgtggtgaagagcaaaagaaaccatcctcaaaaacactcaaaatattctagttatggccaaaaagtcccattcttcctagtgtcaaagtcatgtctgggcggtgagagacacaggtgcgaatgactagcttcattttgtaggagcatcggcaggggcgggaccctgattaaaccctgcccagctttggtcaaagcaatcactgacataagcctggaaattgtactaggttgatatggtttccatcttcaaataaaaaaaactcaagagttgaaaagattaaagaccacatctttcagtacaaagtagaaaccctaggaccctggatttctaggccaggattttttttttttttttttttttttttttttttgagacagagtagctgggattacaggtgtgcaccacaacacccagctactttttgtagttttagttagggacagggtttctccatgttggtcaggctggtcttgaactcctgacctcagctgacccacccaccttggcctcccaaagtgctaggattacaggcgtgagccaccgcacctggcctaggccaggattcttgatggcatccatgctgcctctcttcctgactctgttctctgacctccacgcctgccagagcagggtgctgcccatcacttgatcagtgcttgaaggtgcagtggctgtcctgccagcccacctgtgtaccaactcagtctgctgacagcattttgagtcccctaatacgatttttctctggtgtacacacctaaaattagctcactcagattgcgtgtctggcttttttgacagttgtctctgcatgagggttgatatgtttatctttttctggcttcctaggcccaggacctcctcagtcatggagggagttaggagagcttagcaggctgttttgactgcagttcacctggggtcgtgggaccttgtgaaactttcctggggacccaaatgcttagggaaaagcccttgagccctggcacaggctcaagccacagtgactttgtcatctattcccttcaagcacaggatctcacccccaccccaccctgccatctccctttcctggccatctgggttctggtggatcagcaaacaggctcacacacctgagctgtctctttacagccctgggatcactgcataaggttgccctgggccagagccagtgagcgcttgctggatctcagcctgtcttctaaccgcctgctgcggaggtatctctccctcctaggcagaactctgcccgagccagtggggaaacccaggcagcacgagagctcttctttccctaaccttgctcagttagaaagacatccaagacatccctggactgaaggaagcaaagcagcatataaagaatgggctagggcaggggcagggaggagcagtgagaccagcagaacagcagcagtgctgggagtcttggcctgtaagtggaggaggctctgctagtctggcctgaggcttcctgggcccttcccaggcatggaccaggatgtaaggatatgcctggtggggaggtgggaagaagcacatatgagggactcagcctggtgctgatgctgttctgattcccccttagccttctactgcttatctgtggccaccctgtcttccaacatagagaaagctgggtggggttgtggtgtcagaggcagcctcctttcctgcaggaatcttactcagcaactttaatacaaggatcttaggcttctacagaacagggttttggtttatctgtggatctctttgttgctctcctaacagtgaccacagagtaaatcaggtctgtaaaccagttctcctggccaatgctcactggatttgtgtaccacttcactaattttttagaaaccagaaaaggagtcagccactagggcaactagtggcctgggttcaactcataatgagaccacctgttagaatcaggccataagcctcccaagagctgggcagagttggccctggggtctgcctggaggcagctgctgcagcttccatgcctattcagagcagcctccagggggagccctcagccataccgtgccctggtccgagaggctcggccaagggagtctgttgagggcgcagaggccagcagccttattactggtctcatagaggtgcctgcaagtaggtagtctggtaaccaccagtgggctgcaggttgtccaaggggtcagaggctgacacggggacccctgtggttaattctgtggggtcacttaaggccatatgcagcctgttagtcctgggctaccctactgtgcctgccatctgatttcagtgacgtttcccttctgccgaaggaccccagagcaattttttgcgtccagtgctaagcatgtctctctccacgcctggcacctactgtcttcagggtttctccctctcagcctagtggctgtcaagtctggtagctgtacacttttactagctttcattttacctctggcaccttctggtagcgcagatctcttagctagaggctggaagtgagtcatgtgtgaaggggtcatgtctctcaggcagtgagcagcctggcagtggggtgggggacagggtgtgcaggtctgaggtcagaatgggctgacgacgcactccctctgcaggtgtgcgactctgacactgtgctggatccagcctgcaccatcgagatgcttcgagtcctggaggaggatccccaagtagggggagtcgggggagatgtccaggtaagatgagaccagggatatctgtggggaggggtctggactctttttcctaatccaattggatatgcctgggaaatgggtgtcttgacttcctagtattggggggaggttcctcgctggcagttttcactgacaccaaagagctcgcccccctcactgcccaacccctttcttgctcttcttccacatgaggggaagtcacttaaacaggtatggagcagagtctatactgcaggaggggcacagtattttgaggccatacatcctagaaggtacttcctttttggccggtggtacagcaagtagctccaaagtcagatccttgagcagcccttgctcttaggagatgggctgaagagctctggtcaatacggtaagaataagggccccaatctgccagagatactgaagcagcatcccaggtcccctacaactttccaaccacagaaatctcaggacaggtggttgtggtggtgttttgcattcttcccaagcccccttctctgccaccaccacaggctgcctcctgagaccgaaggtggctttgactgctagagccacttagtggggaaaatctctgcagataagatgacacagtagggaggtagagctggtgctggggacagggattgtgtgtggttggctcctctgagcctcaggtttcccagctccaaaggaaccgatggccaggaatctaagcagcgggccacagaagccatggtaaggaggcctcgtggtctctgatgtctgtcctccggacgtgcaaccttaggaggcccagcatctctattcccttgcagatcctcaacaagtacgactcatggatttccttcctgagcagcgtgcggtactggatggccttcaacgtggagcgggcctgccagtcctactttggctgtgtgcagtgtattagtgggcccttgggcatgtaccgcaacagcctcctccagcagttcctggaggactggtaccatcagaagttcctaggcagcaagtgcagcttcggggatgaccggcacctcaccaaccgagtcctgagccttggctaccgaactaagtataccgcgcgctccaagtgcctcacagagacccccactaagtacctccggtggctcaaccagcaaacccgctggagcaagtcttacttccgggagtggctctacaactctctgtggttccataagcaccacctctggatgacctacgagtcagtggtcacgggtttcttccccttcttcctcattgccacggttatacagcttttctaccggggccgcatctggaacattctcctcttcctgctgacggtgcagctggtgggcattatcaaggccacctacgcctgcttccttcggggcaatgcagagatgatcttcatgtccctctactccctcctctatatgtccagccttctgccggccaagatctttgccattgctaccatcaacaaatctggctggggcacctctggccgaaaaaccattgtggtgaacttcattggcctcattcctgtgtccatctgggtggcagttctcctgggagggctggcctacacagcttattgccaggacctgttcagtgagacagagctagccttccttgtctctggggctatactgtatggctgctactgggtggccctcctcatgctatatctggccatcatcgcccggcgatgtgggaagaagccggagcagtacagcttggcttttgctgaggtgtgacatggcccccaagcagagcgggtaaagtgcaatgggtaagggagggaaggggaatggaagagaaaagacagggtgggagggaggagggagtgctgtgttttagtctcttaatggtccaaaggacaaatctaaaatgcaaagaacggtgatgtagtatggcctgacagctctgtttagaggaggcaacactgatcccccagatgcagggctgcaggggattctgtgttttcagactgcctgtctgcttgcatctgcacataggcagtagcctcctcctgggctccagagggcactcagaagttgtgctaaaccaagttaagtcccattcagtggcaacttgtgataggtacctgagtgacggcaacctgcggaaggaggttctcccagcccatctgaacacaaccagaggtggcaggagaatttctactgagcgagctgggccggttagtgtatgtcacccccaccccacccctaagtagtcatcaatgcaataagattgcgcctgagatacaaggcccagaagcctgatctttgggcatcagaaaacagggtccaggaatggtgctttatgtgagataccccactccacatcaacattccagggatgagccaaaccagcagggagttagcactgaactgcttttaaaagtgcacattaaaaaggaaagtttgccaggaggaacaaagagattgtggtggtgctaaaggaggccataagctacacagaggccttgggtgttccacctggaaactgctcagacgtctagatgggttcttagcttgtctgtgatctctgctggggagataaaaagattaagccccaacatgttcagaaaagaagtgaagtcttgggtattttaacctgtatactcttgaattcctctcaaattcagctctgatctgaggctaagacacactccccacttcactttcttcaaagccacattttttgaggtatcactgcagtcacctcttctaccctcatcatcataggtaaggttttcaaggtggcaattggggcggagccccggctcttatagaagcttcagcaggaggcaagcgtgttctcagcacatatgggaactatgaggagcctctgatcaaattggctacaatcttggagctgcttggacggattccttggcagccgggttagcatgtgtgactttcaggctactgttcttgacaatcatctccaatggaaagcttttcagtgttcccaaagtgaactctcaaatccaaaatggttatctttgagaccatccattctcctcagtggcttctccagggaattcttacagccaagttgtgacagtcactgcatttgcctgcttctttccagaaaccaaactaggagatgaaactggttcctacatcctaaggttcttgctttctctctcatgcctcctgaggctgtttttggctgttttccctctgctgcttttggggaatgaggggaagccattttccagtgacttgcaatccaggctgttctcagcgttttgagtttaaaacctgggatcctgactaagcctttgacttaagggttgcttgcttgccctccaaatgtcctttctcagaggggccagctaacccgtgcagaaccagcactaaggtggacagcagacaagagggcaagcctctagtgtaccaagtgcttcctacaaagacgcaaggtgtgctctgagccacagatgggcaaaccctggtgctttccttcatctcccacgaactcaagggttttccaggtgtagctaacagttgccacatcacacagacctcgagtttctggtaagactgctggttgacatcagacccaacccatgaaggctggaaggcagcaggcatttgctaaggcagctgatccaggcaatcgttctgctggccaagaagttaaactattttgagcattagaatggaggaaatccggtcagccaagtgcagagttcagacttcgctaagggcttgtttttcttcagcatttacttgaagattaatgt

SEQ ID NO: 15471 - DNA, 41639 bp, Human
cagggagctggagcatttgctagtgacctttctatgccagaacttgctaagcatgctagctaataatgatgtagcacagggtgcggtggctcacgcctgtaatctcagcactttgggcggccgaggcgggcggatcacctgaggtcaggagttcgagaccagcctggccaacatgatgaaaccccatctctactaaaaatacaaaaattagccaggcgtggtggtgggcacctgcaatcccagctactctggaggctgagacagaatctcttgaacccaggaggtggagattgcagtgagcagagatggcaccactgcattccagcctgggcaacaaagcaagactctgtctcaaataataataataataataactaatgatgcagctttctctctctgagtatataatgcagttctgatgatgtgaggaagggcctcactgttggtgtggcagagtctgagaccatggctggcaatgaaaacactaccctttgatgcctatgggctctccctttatggtttcaaggagggcttctcaatcttggcagaattttggactggatagttctttgttgcacaggtggggggctgtcctgcacatcacaggatgtttcatccctggcctctacctactagatgccagtagaacatacccaccccacagctgcctgttgtgacaatcaaaagcatctccagatactttgcagggggaaaatgatttctccaggcctggcatatacataacagtatttaagcagctgcctagaattaattaaacacagaaggatgtctctcatccagaatgccctggaccacctctttgataggcaatcagatcccacctcctccaccctatttttgaaggccctgtgccaacaccacttcttccatgaatacttccttgattcccccatccctagctctatataaatctcccactcaacactcacacctgttagtttacattcctcttgacacttgtcatttagcatcctaagtatgtaaacatgtctctcttcacgattcacaaagtggctttggaagaactttagtaccttcccatcttctctgccatggaaagtgtacacaactgacattttctttttttttaagacagtatcttgctatgatggccgggctggaatgctgtggctattcacaggcacaatcatagctcactgcagccttgagctcccaggctcaagtgatcctcccgcctcagcctcctgagtagctgagatcacaggcatgcactaccacactcggctcacatttgacatcctctaaagtatatataaaatgtgaagaaaactttcacaatttgcatccctttgtaatatgtaacagaaataaaattctcttttaaaatctatcaacgataggcaaggcacggtggctcacgcctgtcgtctcagcactttgtgaggcccaggcgggcagatcgtttgagcctagaagttcaagaccaccctgggcaacatagcgaaaccccctttctacaaaaaatacaaaaactagctgggtgtggtggtgcacacctgtagtcccagctacttggaaggctgaaatgggaagactgcttgagcccgggagggagaagttgcagtaagccaggaccacaccactgcactccagcctgggcaacagagtgagactctgtctcaaacaaacaaataaatgaggcgggtggatcacgaggtcagtagatcgagaccatcctggctaacacggtgaaacccgtctctactaaaaaaaaaaaaaaatacaaaaaattagccaggcatggtggcgggcgcctgtagtcccagttactcgggaggctgaggcaggagaatggcgtgaaaccgggaggcagagcttgcagtgagccgagatcgcaccactgccctccagcctgggcgacagagcgagactccgtctcaatcaatcaatcaatcaataaaatctattaacaatatttattgtgcacttaacaggaacatgccctgtccaaaaaaaactttacagggcttaactcattttatccttaccacaatcctatgaagtaggaacttttataaaacgcattttataaacaaggcacagagaggttaattaacttgccctctggtcacacagctaggaagtgggcagagtacagatttacacaaggcatccgtctcctggccccacatacccaactgctgtaaacccataccggcggccaagcagcctcaatttgtgcatgcacccacttcccagcaagacagcagctcccaagttcctcctgtttagaattttagaagcggcgggccaccaggctgcagtctcccttgggtcaggggtcctggttgcactccgtgctttgcacaaagcaggctctccatttttgttaaatgcacgaatagtgctaagctgggaagttcttcctgaggtctaacctctagctgctcccccacagaagagtgcctgcggccagtggccaccaggggtcgccgcagcacccagcgctggagggcggagcgggcggcagacccggagcagcatgtggactctcgggcgccgcgcagtagccggcctcctggcgtcacccagcccggcccaggcccagaccctcacccgggtcccgcggccggcagagttggccccactctgcggccgccgtggcctgcgcaccgacatcgatgcgacctgcacgccccgccgcgcagtaagtatccgcgccgggaacagccgcgggccgcacgccgcgggccgcacgccgcacgcctgcgcagggaggcgccgcgcacgccggggtcgctccgggtacgcgcgctggactagctcaccccgctccttctcagggcggcccggcggaagcggccttgcaactcccttctctggttctcccggttgcatttacactggcttctgctttccgaaggaaaaggggacattttgtcctgcggtgcgactgcgggtcaaggcacgggcgaaggcagggcaggctggtggaggggaccggttccgaggggtgtgcggctgtctccatgcttgtcacttctctgcgataacttgtttcagtaatattaatagatggtatctgctagtatatacatacacataatgtgtgtgtctgtgtgtatctgtatatagcgtgtgtgttgtgtgtgtgtgtttgcgcgcacgggcgcgcgcacacctaatattttcaaggctggatttttttgaacgaaatgctttcctggaacgaggtgaaactttcagagctgcagaatagctagagcagcaggggccctggcttttggaaactgacccgacctttattccagattctgccccactccgcagagctgtgtgaccttgggggattcccctaacctctctgagacgtggctttgttttctgtagggagaagataaaggtgacgcccattttgcggacctggtgtgaggattaaatgggaataacatagataaagtcttcagaacttcaaattagttcccctttcttcctttggggggtacaaagaaatatctgacccagttacgccacggcttgaaaggaggaaacccaaagaatggctgtggggatgaggaagattcctcaaggggaggacatggtatttaatgagggtcttgaagatgccaaggaagtggtagagggtgtttcacgaggagggaaccgtctgggcaaaggccaggaaggcggaaggggatcccttcagagtggctggtacgccgcatgtattaggggagatgaaagaggcaggccacgtccaagccatatttgtgttgctctccggagtttgtactttaggcttaaacttcccacacgtgttatttggcccacattgtgtttgaagaaactttgggattggttgccagtgcttaaaagttaggacttagaaaatggatttcctggcaggacgcggtggctcatgcccataatctcagcactttgggaggcctaggaaggtggatcacctgaggtccggagttcaagactaacctggccaacatggtgaaacccagtatctactaaaaaatacaaaaaaaaaaaaaaagaagaagaagaagaagaagaagaaaataaagaaaagttagccgggcgtggtgtcgcgcgcctgtaatcccagctactccagaggctgcggcaggagaatcgcttgagcccgggaggcagaggttgcattaagccaagatcgcccaatgcactccggcctgggcgacagagcaagactccgtctcaaaaaataataataataaataaaaataaaaaataaaatggatttcccagcatctctggaaaaataggcaagtgtggccatgatggtccttagatctcctctaggaaagcagacatttattacttggcttctgtgcactatctgagctgccacgtattgggcttccacccctgcctgtgtggacagcatgggttgtcagcagagttgtgttttgttttgtttttttgagacagagtttccctcttgttgcccaggctggagtgcagtggctcagtctcagctcactgcaacctctgcctcctgggttcaagtgattctcctgcctcagcctcccgagtagctgggattatcggctaattttgtatttttagtagagacagatttctccatgttggtcaggctggtctcgaactcccaacctcaggtgatccgcccacctcgccctcccaaagtgctggaattacaggcgtgagccaccgcgtctggccatcagcagagtttttaatttaggagaatgacaagaggtggtacagttttttagatggtacctggtggctgttaagggctattgactgacaaacacacccaacttggcgctgccgcccaggaggtggacactgggtttctggatagatggttagcaacctctgtcaccagctgggcctctttttttctatactgaattaatcacatttgtttaacctgtctgttccatagttcccttgcacatcttgggtatttgaggagttgggtgggtggcagtggcaactggggccaccatcctgtttaattattttaaagccctgactgtcctggattgaccctaagctccccctggtctccaaaattcatcagaaactgagttcacttgaaggcctcttccccacccttttctccaccccttgcatctacttctaaagcagctgttcaacagaaacagaatgggagccacacacataattctacattttctagttaaaaagaaaaaaaaatcattttcaacaatatatttattcaacctagtacatacaaaatattatcattccaacatgtaatcagtattttaaaaatcagtaatgagaccaggcacggtggctcacgactgtaatcccaggactttgggaggccgaggcgagtggatcatctgagatcaggagttcaagaccagcctggccaacatggtgaaaccccatctctactaaacactagctcagcatggtggtgggtgcctgtagtcccagctactcgggaggctgaggcatgagaatcacttgagcccaggaggcagaggttgcagtgagccaagattttgggggattctgtgacatacaaaaaaaatcagtaataagatatcttgcatactcttttcgtactcatatacttccagcatatctcaattcacaatttctaagtaaatgctctatctgtatttacttttataaaattcacaattaaaaatgaaggttcacatagtcaagttgttccaaacacacttaaatgtctcctaggctgggtgtggttgctcacacctgtaatcccagcactttgggaggctgagatgggcggatcacctgaggtcaggagtttgagaccagcctggccaacatggtgaaaccccgtctctactaaaaatacaaaaattagctggatgtggtggcactcacctgtaatcccagctactcaggaggctgaggcaggataattgcttgaacccgggaggtggtggaggttgcagtgagccgagatcgcaccactgccttccaacctgggcgacagagcgagactccgtctcaaaaaaaaaaaaaaggctcctaataactttattactttattatcacctcaaataattaaaattaaatgaagttgaaaatccaggtcctcagtcccattagccacatttctagtgctcagtagccacgggggctggtgaccaccacatgggacagcatatttagtacctgatcattggttctcagatctggctactcagcagaaccaagaatccacagaaacggcttttaaaagcacagccccacagcccccagccccagccttacctacctggaggctgggaaggactctgattccacgaggcagcctatgttttttgatggagggatgtgacaggggctgcatctttaacgtttcctcttaaatactggagacagcttcgaggaggagataactggatgtgtcttagtccatttgatggagggatgtgacggggctgcgtctttaacgtttcctcttaaataccggggacagcttcgagaaggagataactggatgtttcttagtccattttctgttgcttgtgacagaatacctgaaactgggcaatttatatggtaaaaaattttcttcttactgctctggaggctgagaagtccaaagtcaagtcccttcttgctggtggggactttgcagagtattgaggcggcaccgggcgtcatatggtaaggggctgagtgtgctacctcaggtgtctttttcttttcttataaagcctaactagtttcactcccatgataacccattaatctatgaatggattaatccattattgagggaagaaccttcatgacccagtcaccgcttaaaggccccacctctcaatactgccacatcgggaattaagtttcaacatgagtttcggaggtgacaaacattcaaaccatagcatgctgtctcttaaatgactcaataagctcctgtggcatccacttctgcatgccttgggcagcttttagacatctgtccattttcctagagggacaagaccaccacctgtgatcctatgaccttttggctttaggcctaacaagcaggttataccctcactcactttcaaatcatttttattgtcttgcagacaatttacacaagtttacacatagaaaaggatatgtaaatatttatacgctgccgggcgcggtggctcacgcctgtaatcccagcactttgggaggccgaggcaggtggatcacgagttcaggagatggagaccatcctggctaatacgatgaaaccccatctctactaaaaatacaaaaaattagccgggcgtggtgacgggtgcctgtagtccccactactcgggacgctgaggcaggagaatggcgtgaacccgggaggcagagcttgcagtgatccgagatcgtgccactgcactccagcctgggtgacagagcgagactgcatctcaaagaaaaaaataaataaataaataaatatttatactgcttataaactaataataaatgctatggtctgcatgtttgtgtcaccccaccattcatatgttaaaacctaatcaccaaagtgatattaggaggtggggcccttgggaggtgatgaggtatgagggtggagcccatatgattgggattagtgcccttctaaaatagcccaacggagcccagtgacaaggcatcatctatgaaccaggaaactggccctcaccagacaccaaagctgttggtgcattgatcttggatttcccaccctccaggactctaagaaacacatttctattgtttataagccacccagtggctggtattttgttataacatcccagactaagacaaataacaaatacttgtatccctgacaccaggttaagagatagaatttgtttgttcctctggaggcccttgtcttcaccccatcactgccctgtcctccctggaggaatctgccagcccgaattctgttcatcgtaccctccttttcttagagtttgacctcctctgtatctcccccaatccatgtattgcttatatacaaggtattctgctgtatctgttctgctatggcttgccccttttgttcaacactgtttttgtgcgtcatctgcattgatgcatgcagttgtcctttatttgttctcactgctggatagtatctggttgggtaaatatatcacactgtaaatcacactatccaggttcctttaggtgacatttggttgattgcagtgttctgttgttacgatggtgctgctgtgactgttcttgtgcatggacagaagttcctttcaggtgaatttctcagaatggaattgctgggcaaaggggcagccaataatcaactcatttgatgccaaaagtggtggtgccagttcatcctcccctgcgaggtatgggtcctgattcactcttcaagtgctgtggtttgacagggccgggggtgacaaggggacacctgggaaggaaagctgggctccctgctggccatccaggccagtccttaccagggggtaggcaatgattgggtcaagtggttcctgaccactgggcctgagacttcaggcccagaaactatctaatatttcctcaaatgcatcccatgagcaggcactgtgtgagtgagcacacacatctgaagcctcaagctaggcaagcctaccatgacttgtggtccaagggctcacgggtgacctggagttagagggagacatggctgccaggtggctttagaaagaacactcatcatggccaggtgcggtggcttacgcctgtaatcccagcactttgggaggccaaggtgggtggatcatgaggtcaggagtgagaccagcctgaccaacatgctgaaacctgtctctcctaaaaacacaaaaattagctgggcatggaggtgcacgcctgtaatcccagctactcaggaggctgaggcaggagaatcacttgaacccgggaggcggaggttgcaataagcctagattgtgccactgcattccagcctgggcaacagagcaagactccgtctcagaaaaaaaaaaaaaaaaggaagaacactcatcctatgaccttgacctccaagctttgcctccctcaagcagaacagaatggagcctcccttaggcagaggcggaagtttgcctctcacctagttctccattcttttgttcagagcctgaataccctcaggctctgtacttggggtatttctgttctcttgttttatgctcacggttgtgaggtttgttgtgagtaccacgatcccttccttcagaggagtaaactgaggttccaaaaggtttagcagttgcccgaggaatattaaattggcaaaagcaggtagaatataaagcaaggagtatttggcaacggttcttttttatgattaaaaacagccgaagaaagacttctacttgtgcctttgaaggagtaactgcatttgaccttcccaccagtaacaaccatcaaatctctattaaattaaacacacacacacacaaacaaaaacagctattgtgaaggtatcagcgactaagacaactaaggtttgaggggccaggatcctggagagatggaaacttccctgaggtgagccccacattctcagacacttttccttggatgttttgagcactgctttaattcctgggaaaacaattccttccactgtgcacagactctggggccagacagcttgggttcaatcccagctctgccacttaatgtctgtgtatctgtgtaggcaagttaccctttggtgcgtcagtttcctcatctgtaaaacacaactatagttgatcctcattcgttaagagtctgtacttgttaatttgctcacttgctaaaatttgttaccccaaaatcagtacccctagccttttggggtcgtttcaaagatgtgtgcagagcggcaaaaaaatgtgagctcctccaggctcatgttcccagccaaggtccaacaaagtgctgccctgccttcttatttcagctgtcatagtgtaaactgtgtccttttcacagtctgattagtgccatgtttttcagatttttatgcttttttcttggttatttctctgttaaaattgtctccaagtgtagtgcaaagtttagcacgaggaggctgtgatgttccttacagagaaaatgcatgtgttagagaagctttgtcaggcatgagttaaggtgctgttgtcctgagatcaattaatttgttgttgttgttgtttgagacagggtctccctctgttgcccaggctgctggagtgcaatggtgtaatcatagctcactgcagcctctacctctctggctcaagcaatcctcccacctcggcctcctgagtagctgggactacaggtacaccccaccacacccagataatgtttttgatatttttttaggtggaattttgctcatcacccaggctggagtgcaatggtgcgatcctggctcactgcaacctccacctcccggattcaagcaattcttctgcctcagcctcctgagtagcacagattacaggcacatgtcatcacgccttgctaatttttgtgtttttagtagaggcggggtttcaccatgttggccaggctagtcttgaactcctgacctcaggtgatccacccgcctccgcctcccaaactgcagagattataggcacgaaccacaatgcccggcctcatgttttttatttttcaagttgaaatgaggtctctctatgttgcccaggttggtctcaaactcttgagctcaagtaatcctcccaccttggcctcccaaagtgcggggattacaggtgtgagctaccatgcccagccaagatcagtgttaatgaatcaactatatatattacataaggtgtctttaaacagaaataaggttatatattgatcgattggtaacaatgttgtgaccagcagcttacagggtacctagccttgtatttctcctataaataatttgctcgttgagtgtttgtggcaactttgtagcacataactaccaagaataaggactgtaataagagtacgtccctcacaggattgtaatgaagactgagtccatttacataaaggctgagagcagtgtcaagcagatggagaacactgtagaatgtgcgatagctctaacagtggttatcatggctgccctctcacttcttcagagacatgtgtttctaaggtctgcactctgccccaccctccccatccactgtcccccagcccgtttcctcctccacttacttcccagccctgtgccttctgccttctcttttctgagtttgctaagggcactgctggctcaagagcagtaactaacagtctctcgcctcttctctccatggcaaccagtgacctttggagaatgtaaaccttatcaccaatctcttaaagcccttcggtgccttcccaggatgacgtccagctgaggtccttggcaagacccagggcgccccctcctcgctccatcacctcccctgtcacctcccctgcatctccctactccagctgcaccactcttgtgccccagtggctcttgtctgattatttccttcatctccccagctggtcagcagagctggtggtaatcaactcagaccctgtcacctggatgtccagcagttagggactaaaaaaaatcaacaggtcacattctgtcctgcagatcatgataataagatctgtcagacagcagtcagcagtcagagccaaatcttctggacttcagcaggattctgcctcttgctatttcctgttgcctctcttagtgaccttttaagagcattgtggatgcctcccagcctcctgctaaccaccctgtaacctgaacagcctgcagcagccctgcccagtagaacttcctgatgtgatggaaatgctgtgtctgcaccactagccacatgtggccacaggattctcgaaactggtggtgcagttgaggagctgactttatattttatctcattaaatttaaatgtaaatagctacgtgtggcttgttggctagcctattggaaaacacgggcttagagagacacagggagaactcactgtaatgcactaaaagaaggtaaaaaaaaaaaaatcctaagaaatattcctaaaatactttaatatagggctgggtgcggtggctcacatccagcattttgggaagctgaggagggcagatcacttgaggccaggagttcaagaccagcctggccaacatggtgaaaccccgtctctactaaaaatacaaaaaatcgggtgcggtggcgggtgcctgtaatcccagctacgcgggaggctgaggcacgagaatcactcgaacccgggaggcgggggttgcagtgagccgagatcgcgccactgcactccagcctgggcgacagagcgagacttcatctcaaaaacaaaaaacaaaaaccaaaaaaaaacacttcagcatgattatttaaccaaaatgcaggttagttgttcaccggatgcagagtccaattaacaagagcaaggcctggtaccaaaaaaagtgaatttactccgaaactagcttgggtgaggggtacaaagcatcctgcctttctttaaaagtgctgcttccccttggaagtagaaagtggacacttttataaggtaaggggggaagtgtgcaagggcaagtgggggggtccctctgctagttccgtgcatactctacaggacagttgacttggcaccttcctggttagtaataagctgtagcagtggccaagtgggcatgctttcagtatgccctcccagtgaatgaaagtcctgaggcaacccccaagggtggaagtgccaggccaccacccactggaggtgaaagttccgtgatgggtttgctttggtctgcgaatctactgtcatgtggagagatctgtgctctggaagagcatacagttagaaaagcttgccctgaagggaatgtatggtgaaggggaggtgaaaggttatatttgcatttctgaagggctaagtaggaaaccgggaaccaggggagaggagaagagaagagaggataattttttttaagaaaagcaacatattccctttttcttagaaaaaatggagcactcggttacaggcactcgaatgtagaagtagcaatatataaattatgcattaatgggttataattcactgaaaaatagtaacgtacttcttaactttggctttcagagttcgaaccaacgtggcctcaaccagatttggaatgtcaaaaagcagagtgtctatttgatgaatttgaggaaatctggaactttgggccacccagggtaagataaaacaccttccacgtcataggtatcttcctctctccttccctgcctctcccattagaacctggttttcttcctgagcagcaacaatcttaggcatctttccatgtgactgagtatccaccacattatttttaatgaaatagtattagattgcatggatgtgacataatccatttaacccatcccctactgttggacattcaggttgtttccagagtttcaatattattttatttaataccctaatagttagagcaggccatgctgctatcacaaatagacccaaatatttaatagctcaaaccaataacgtttgtgtcctcctctctgggcagtacagggttggcatacctcctgaagtgaattaggaactacactcattccagcttccagtttggtctttatctgtcagtgccttactgtcctctgcattgttgagtctcagtcaccttgtccaagttccattggccagaaagggctagaagcacagaagggctggaagtggcatttgttcctcactcacattctggtgggaagaacttagtggtgtggccttagctgactgtaagggaggctgggaaatatagtctagcgagtgccctggaaaaagccggcacggcattccccatggaaagctgtcaggcacggctacagtctaccccctgccaaccagtatctgcatggaccctccttccacactcagatgcatttacccccagccccaagagagccaaccgatgcccatgtggtcaccacagccacctccgagtccaagatttccaggtgacatgcagtctcctctctcccagcttcaggaatggcttcttctgatctacacacagacacagacacacacacacagacacacacacacacacacacacacacacacgatggagaggggcaggataactgcaactgtaactccattcagaaaagaggcacagcactagctgcccgcagcactggagccctgctgggcagcactggatcaacctctgccctggcagaggagcatgttcctccacaaatccctgcttcagcctctcgagaggctcctccttgtctgttattttccttggccacaaggcaggcaggcagtgggaagtgtgccctcctccggggcaaggagccttcacagcccacttcctgctaataacagtttggggttccacagggtgttttaagactccagtcagctattttaggccagactcatttctctctctctctctctttttttttcttttatgaaatcacaccctgagacccaggctggagtgcagtggtgcgatctcggctcactgcagcctccgcctcccgggttcaagcaatcctcctgcctcagcctcctgagtagctgggactataggcgtgcagtgccacacctagctaatttttgtatttttagtaaagacggggtttcaccatgttggccaggctggtcttgaactcctgacctcagatgatccgcccgcctcggcctcccaaagtgctgggattactggcatgagccactgcgcccagcccagactcatttttctttgagagtaggcttttcccaaaagtaggcttctgagctattcactttcaggcagtcccatgtgccaggaaccacatccaaatttcctccgtggatgggagtctcaggctgccttatctccttgcatgtccccatgcccagctgtctcagcctaagggcaggtaccttgaagtcaagttaaacaataagattggagaccagcaatgccctcagcctggtttttgcagcaggactgagtcccttgttttggctcaatgggaagtctttgctgttcaaagccttagcttctctggctgagtgcggtggctcacgcctgtcatcctagctctttgggaggccgaggtgagcagatcactgaggccaggagttcaagaccagcctggccaacatggtgaaaccctgtctctactaaaaatacaaaaagttagccaggcgtggtggcaggcacctgtaatcccagctactcgggagcctgaggcaggagaatcgcttaaacccaggagatggaggctgcagtgagctgagatcatgccattgcactccagcctgggtaacgagcgaaattccatctctaaaaaaaagaaaaaaaaaaggccttagattctccctttgactttccacgtttgtgcagccttttatctccaatgctccatttcattccatctcctggcttattcttttcttgtcacatctactaaaagcaacaagaagccaccggtattcaggaacattctacctgtccccagagctatatgctcagtaggcatacagttggccctccaggttatctgagactcagatttccagagggctttgcatggctcacaaggtctgaagaacctctgagcctcccgcctgcggtgtctgttcattgactttgccacagtctcaaagaggcactgcatgctgcatgtttgaggtttttgctttggtggcatccatttccagcctcggcttccggcattcctcccccagcagactctctgctgctttccccttactccttctggcagttctgggaggttgcatagggcccttgcaggatgccccaagtccagctgcctctggcctctgggaagcacacccttgacctgccatgtgtaggaagacagcccgcttctgccagggcccaactctgccggcaggtagcaccttccaacctcttcactttggactttataactgtcaggtataaagtcggttgtgtccttacgtttctcaaattcttcaagacacgtcaaccagcctctcctacgcattctctccagctcagtctcaaaacacaccctttctctccagctcactctcaaaacacaccctatcaggccaaccactctttttaaaggacagctcctcaccaatccagtcaggtagccttccccacattgtatcctggaagtgggtgatggactgggtggggaagagggtcatatggcaaatctgtatgtcttacagtaattgtctagcagcccctggtgtcttactttaggccccctggaaactttcagatagtggagttgtctgatacatatcttataacctacagatattaatatatcctcacaggggcacaaaagctcttacaaggatgtttattataataatatttttattgttataatttacatgccataaaactaaccattttaaaatgtataatgcaagggtttttagtatattcacaagattgtgcagctgtcactactaattccagaacattttcattattccagaaggaaaccctattcatattagcaatcactcccccattccgcctttccctaaaacccagcaatcactaatctactttctgtctctgtggatttaaagtaattttaaatttgaaaaatagtatctataaggaaatgtatctagtcacaagcatacagcttgatgaatttgtaaaaattgaacagtcctatgaacataccctgtaagctcaagacatagaatgttaccagcccctgcaagcaagctgcctgctcacttctagtcattaacccctccctcttttccttctagtcattaacccttcagagtaactattctgattaccaatagcatagattagttctgcctgttgttttactttatataaactgtctcattaagtataaacatgtttgtgtatacttgtgtatttctttctatcacaatgatgtttgtgagattcatccatgctgttcctatagacaattctattttgcagcgtagtattccattgcatgactataccacaatttatctgtgatattacaaaggaatacttgggcagtttccagtttggggctataggatagttgtgatacaaatattttagtatagtacatgtcttttggtgaacctgggtacacatttctgttgtgtataccccttaagagtggagctgatgggtcatagcatgtaaatgcattcaactttagtagatactgtccaacagttttccaaagtgattgtccaacttacttgcctatcagcagtatctgaaaagtctagttgcttcttttcttggccaactcttttttttttttttgagatggagttttgctcttgttgcccaggctggagcgcaatggcacgtcctctgctcactgcaacctccgcctcctgggttcaagcaattctcctgcctcagcctcccgagtagctgggattacaggcatgcgccactatgcccggctaattttgtatttttagtagagacagggtttctccatgttggtcaagctggtctcgaactcctaacctcaggtgatccgcccgcctcggcctcccgaagtgctgggattacaggcatgagccaccgcgccaggccggccaactcttttttattttattttattttactttaaagacagggtttcactttgtcacccaggatggaatgcaatggcacgatcacagctcactgcagccttgacctccctggctcgggtgatccctcccacctcaggctcctgaggagctagaactacaggcatgggccatgcccagctaattttttaatttttggtagagacggggtctctgttgtctcagattcctgggttcaagtgatccttctcccttggcctcccaaagttctggtattacaggcatgagccactgcacccagcccatggccagctcttgatacgatctgtctctttcttttctttttttttttttaatttgagaagtgttaaataatctttctttgatattatacataaaccacaccaaaatgtctttcagtaagtaaaatgaaccattttagatacagaaaattctaattagattggcatagttaaggccaaaaatataaagttgacattgctaccttatcttcagcccttgcctttaagaggcaaatgaacacaaaatacaggtgaatcttgcttggttctgagacagtgaaggactttcccccagtatttaaatatatttacataaccagttacataaatctaaatattaaaaaaatctccaatagattttagatggcattcaccatctttgtgaaaagttgaacattactaatgaaatctgatcatatctttagaaggataaacagtgatagcatttactgaatcagaataactgttttttggggttttctttgagacggagttttgctcttgttgcccaggctggagtgcagtggtgccacctcagctcactgcaacctccgtcccctggattcaagagattatcctgcctcagcctcccgagtagctgggattacaggctcgccccaccatgcccagctaatttttgtatttttagtagaggcgaggtttcaccatgtcagccaggctggtcttgaactcctgacctcaggtgatccacccgcctcagcctcccaaaatgctaggattacaggcgtgagccaccaggcccagcctattttttttttttttctttttttgagacggagtctcactctgtcacccaggctggagtgcagtggcacaatgtcagctcattgcaacctccacctccggggtttcagtgattctcctgtctcagcctcccaagtagctgggaactacaggcgtgcaccacaagcccagctaatttttgtatttttagtagagacagggttttgccatattggcctggctagtttcaaactcctgacctcaggtgagccacctacctcggcctccgaaagtcctgggattacagacgtgagccactgcactgcctggcccagaaaggactattaattgtagttgcctctgggaatgggggctgcctgcttctttctgtaaccccttctgtgctgtttaaattttttttttttttttttttttgagacagagtctcgctctgtcgcccaggctggagtgcagtggcgcaatctcggctcactgcaagctccgcctcccaggttcacgccattctcctgcctcagcctcctgagtagctgggactacaggcacccgtcaccacgcccggctaattttttgtattttcagtagagacggggtttcaccatgttagccaggatggtctcgatctcctgaccgtgttatctgcctgcctcggcctcccagagtgctgggattacaggcatgagctaccacgcccggcctttaaatttttactttgggccgggcacggtgccttacgcctgtaatcctaacatttcgagaagctgaggcacgtggtggatcacttgatgtcacgagttcagaccagccactgcactccagcctgggtgacagagtgagactctgtctcaaaaaaaaaaaaaaaagaaagaaaaacttttactttttacatgttattttcatcaatttaatgaatttaaataacaaatgtataaatttgatattaataaaatggaagcatttggtaatcatgttttgggttttgtgcttcctctgcagctctctagatgagaccacctatgaaagactagcagaggaaacgctggactctttagcagagttttttgaagaccttgcagacaagccatacacgtttgaggactatgatgtctcctttggggtacctcttgacttcttttacttttctgtttccccctctaagaattttagttcactaaaatgaagaatttccctccagcagagctaagcatcaagtagcatgtagttgtaggtaggattaaaagactagggttccgggaggtgaaggttgcagtgagccaaaatcacgccactgcactccagcctgggtgacagagcgagactctgtcatagatggatggatggatggatggatggatggatggatggatggatggatggatggatggatagatagatagatagatagatagctggatagatagataagatagataagacaagactaggcttcaagctgcagtccagctctaccaggcttgttgtgactctgggcaagtcactcagcctctctgagcctcattttccagcttcagtggatacccatgaaggcaaatcagagaggggcctgagtgtgtatttgtccagcaggcagatggagggaacaacaaactagacccgtagttcttcagtagggataagataactgcccaaaagttatttagattacaaagacttgagccctgctcctgtgagacagtgatggggtaggtcgggtgcattcctgggaagcatatttttgaaaagctcacctgggattctaatgtgtatccctaggtcttattcctagagattttgattacttggtctggggtgtggcatgacctgggcagggcactgggatttttaagctccacagatgattccaatatgcagctagtatgagaacttgtttttttttgaaggagtctcactctgtcacccaggctggagtgcagtggcgcaatctcggctcactgctccgcttcctgggttcaagcagttctcctgcctcagcctcccgagtagctgggattataggcatctgccaccatgcccagctaatttttgcattttagtaaagacggggtttcaccatgttggttaggctggtctcgatctcctgacctcaaatggtccacccccatcagccttccaaagttttgggataacaggcgtgagccaccaggtccggcctggtgtgagaacttctgagttggatgaaacattagccccagatcctagaagccagggaagtgctggtctttatcgactggccaccaggtggcagatttgggcaagggtctgcctttgggtttagaattattgcttaggccttaaagtagttcttttttgccagtgggagaaaatccctcaaagatggttttctgggttggttggtttgtttgtctgtttgtttgttttttgagacagagtctccctctgttattcagcctggagtgcagtggcatgatctcactgcaacctctgcctctcgggttcaagcagttctcctgcctcaacctcccaagtagctggaattataggcacacgcccccacacccagctaatttttgtatttttagtagagacagtgtttcaccacgttggccaggctggttttgaactcctgaactcaagtaatcctcccacctcagcctcccaaagtgctaggattacaggtgtgagccaccgcgcctggctcctcaaagatgttaatcctcttgatggcaattgactaataccagaaaatgtcacgaagcgtgcattttggattcaatcatggaattgttgaggacaatcagccatcagactaaagcgatagaaatagtattggaaattgcagcgggagcactgaatggagaaggcactccacataatggaggaggcaaccaagtcttagagaaggtatcaagcctgactataaggacagtgagggaattgaaaaaacaaaaaaggagcaatggagcagggaaggattgaatgcctttcaagtagattcagtaattgctgttagcagcaaaaaatgcagtagtgcctgggcagggctttaaagtgcttgcacaggcagccctagagggccgggctgcttgggaactcttacaaactgacctaccaacttgagcatccacagcctgatcagaggtgggggagttaagggccttctctcccctagcctctactagagcctgtaactgcagggaaaccaagttgcaggctaaactctgcccacacatgcagacattgattagcaagctacaaaaacagtcatgaaacctgtttttataggattagtgaagccccagtttgaccagagtactttgcatgaatgttttgttagaagcaaatgtgccaatattctagcagctgcgtttggtttacttcttcttcttctttttttttttttttgagttgaagcctagctctgtcacccaggctggagtgcagttgtgtgatctcagctcactgcaacctctgcctcccaggttcaagcgattctcccgcctcaacctcctgagtagctgggattacagacatgtaccacaatacagggctaagttttgtatttttagtagaaatggggtttcaccatgttggccaggctggtctcaaactcctgatctcaagtgatccacccgcctcagcctcctaaagtgctgggttaacaggcatgagccacggcacctggcaaaagtcatcttttggtttacttctattgaactgaaaaagtcacaaatatatttatatttaattaaatatatttatataaaaatatggtatttagtattattatttttagagacagggcctcgctctgtcacccaggctggagtgcagtggcacaatcatagctcactgcagcctcaagcttctgggctcaagtgatcgttccacctcagcctccctagtagctgggactacaggcacatgccaccatactcggctaattattttattttatttatgggtctcgctatgtttcccaggctggtctcaaactcctggcctcaagcgattctctcacctcggcctcccaaagcaccaggattacaggtgtgtgccagcacacccagccacaaatctataaatttagaaaagaggactatttctaaagagggtcccactacctgtaggcaggaagcagagcctctggccataactgaaaaacaagcacttccaagaaggggcaaagggaacatgaatttatgctgagaggcgtagctaagcatacatattcaacagattatgggaggatctatgaatattcacaaagggaggatctatgaatatgcacacatgtggagtaagctaacgtgtgcagcatgtctcccatgttcaccttaggcagaaacttaacactaacatgtattacagggcaacaaaatgagactgcatatctacataacctagctatttggtaggctgaagcaggagcatcacttaagactgggagttcgaggcagctgtgagccatgatcgcaccactgttctccagccaggatgacagggcaagaccctgtcttagaccactctgtggtcagtggttatcaggaaggaatgctagtcagttgtgctgaaaccactaaaaaggaagggcagaattaggtgatgagttgataccagtggtgaagtgagtcttttttttttttttctttttgagatggagtcttgctctgttgcccaggctggagtgtagtggtgtgatctcagctcatcgcaacctccacctcctgggttcaagtgattctcttgcctcagcctcccgagtagctgggattacaggcgcctgccaccacgcctggctaatttttttatatttttagtagagactgggttttgccatgttgtcaggctagtcttgaactcctgacctcaggtaatccaactgctttggcctcccaaagtgctgggattacaggcagctccaaagtgctgggattacaggcatgagccaccatgcatggcctgaaataatttttttgaaagggctagtttctatttagcccttaggggaaaaaaaactaatggcagttagggagggaatagaacgagtcctgtttgaactcctttcccatcatggccaaaacttaaaattttttttagatatctctgggctccccttggccaaaagatagtttgttgagtcagttgggagcttagaattttgtttttatttctcacatcattgaatcaatttgaaccaggcgacaaaaccttctgctcccagtagtgggtcagagaaccttcctgattcctgccctgagattgtctctctgaagacaacattaggctagtaggctttccagattctgtaacccattctttcaaaggaagagatgcctatatttttctagccaattcatataccttgagtatcactcaagggcaaaattatttctaacaaatcatttactaattagcaaatgcttaagtgtagatttagaaagctaaagctatacagtggctgccatctatagtttggacttgtgattaactacattgaaatgctaactctgtaccctagagtatgaattcctgattagagtccttcaggtgctaactaatttatgtatttcatgtttgataatattattacttgagctttgtgggagagcagtcttttcctcccctgagatatagctagaagttacctcctttgtgaagccttcctagatactccaagcagacacggtccttcctttctcccttgcccagcactctgaggttgactctgtggagcactgatccctctgtgttataattgtctatttacacgtcagctaccacctataacacactgagttcctcaacagcagggacactgtccattctttgatcccagtgtctggaacagtgccaagtacatagtagggacttaataaatattgattcatatgtaaatgagacttttccaaaacatgctttcgttgatgcctctcagcatttatacaccttttaccaactcgctactggccacatagacaaatgaaagcagtaatccagatacacccaagaggacatctgttcttttttctctctgtggagtgggagacttaagtggcttcttaactggtgtgtcgtctgatcaagtggtccaggtaacaggtggatgccaatgtctggcccaggcatcaccccttactggcactggtcattacagaagacactctaccagagctgaaaggacctcttgtcactaggcagctgtggagtccgctctacttgacctagtaaaatctgcctggagactgttagagtcaccccactacctgaagttacctccaggctgacctcttttttttcccaggtggagtcctggcatcttagatattttaataaggatttgcttgttgacatgttctttattcactaaggtgtcagcatattactgtcttagaactgagggttcttcatcttttttggatcaggacctccctctaagaatctgatgactgctctggtccctctcccaataaaaacttccatactcacctgttaaaaaaaaaaaaaactttaaacaaattaacagagttttattcagcaaagaatgattcataaatcgggaaggctgcaaccagaataggttcagagagactccacggtgtgccacgtggttggagaggatttaggatttatgcacagaaaaaggaaagtgacatgcagaaaatgaaagtgagggcctggtgctggtgcggtgcctcacgcctgtaatcccagcactttgggaggccgaggcgggcagatcatgaggtcaggagatcgagaccatcctggctaacacggtgaaaccctgtctctactaaaaatgcaaaaacttagccgggcgtggtggcaggcacctgtagtcccagctacttgggaggctgaggcaggagaatggtgtgaacctgggaggcggagcttgcagtgagccaggatcccgccactgcactccagcctgggcgacagagcgagacttcatcttaaaaaaaaagaaaagaaaaaggaaaatgaaagtgaggtacagaaacagccaggttggttacagcttggtgtttgccttaaacttggtttgaacagttggccgcctttgattagccaaaactcggtgattggtacaagagtagattgcagttcactatgtacagagaagcccttagatccgaactcaaaataggtaaggaggcagttttagctacacttaagttaacatactcaggagtaccattccagcttcaagctggaagtgtctgcagccccctgagaccacttaatcccaagttaaaaacccctgctcagaggcagcatctttttttttttttttttttttttttttttgagagagatctcactctgtcacccaggctggagtgcagtggcacgatctcagctcactgcaaccaccacctcctgggctcaagggattctcttgcctcagtctcccgagtaactgggattacaggcgcgtgccactatgtccagctaattttttttttgtatttttagtagagatggggtttcaccatgttggcctggctggtcttgaactcttgacctcaagtgatccactggcctcagcctcccaaagtgctggcattagaggtgtgagtcactgttcctggcccagtgaggcaccatctcattggatatggagacaaaggatctggcttagcatcctggatttgtattttctttccaagagtccttaagtgatatctaacttttgcgagctgcagtttcctcagctatgagatgagtgacattaacctcctctcttcagatttataagaggatcaattaaaatggcataggtaaaagtgcatcctagcaagttggtatctactttagaaatgaaggaggtcatatgtatgtgaagtctccagacccaacatgccatcttatatgtgtctatttctacaagtgagctagtgacaacagtaattgctatttttgctcctacatgggtagggctgatcttgactaggaggagtcaataagactcaccagccgggcgtggtggctcacgcctgtaatcccagcactttgggaggccaaggcgggcggatcacgaggtcaggagatcgagaccattctggctaacacggtgaaaccccgtctctactaaaaaaatacaaaaaaattagctgggcgtggtggtgggcgcctgtagtcccagctactcgggaagctgaggcaggagaatggcgtgaacccgggaggcagagcttgcagtgaaccaagatcgagccactgcactctagcctgggtgacagagcgagactccatctcaaaaaaaaaaaaaagactcaccagctgtggccactgtctgtgctaattggctagtgcctgcatctcagaaactgctacatattttgactattccccctgcacttaagggcatgcacactcccaaaatagactcagattgtctaaggaataatgatgatgatgaagagaaagccctctttatctggtctatttgtagtcagttccaaaagcattaagaatttctgctgaactaatgcagctagtttctttcctgtcaccactttccttccaaaatagtttcaagatctgtgggggaaaaaatctatttacagtgaacagactggtgggaggaagttgagcattggggttttctgccctgtgtaaccttgccctaagttgggcagatggtatcacactacctggacatcatctgctcattcactatttgaccagttggtcattcattcacaaatgtcctttttgcaggagggatggaggtgctagacctgcagatgctagcatgaaaagacagatctcctgctgctaaggtgcttaaagtagtggaggtcaggggacaagcaagcagtcaggcagctctgaatgcagaggcaggaagcaccacgaggcaatgggacccacagaggggtagcagggtagaggtgagtgggtctcatgtggggagggaggaagttgactgcagagaaggtgccagggggtgaaaatagcttgagagctgtggagctagaagggctctcacatttgcttattaatatgccctttgaaaaagagtggcctgatacctggagtcactcaaaagatttccaattccgataggaaaaagtcaattttggcttcagtggttgcatgtgcaccccctgatttgctgtatgctgaggcattgtggtgatggacgcaagtgcggagaccttgagcacgcatctgcccctagttcttgccctgagtcctcgaaggaggcaggagagacatcaaggcagacaggcgccgctcatcagtgatgagaccagacctggaactcgcgtcttatactcagtcctctgccctttctgctggattgtggccccccagtataaggtgcaacacacaactggagcatttaagggccacaaagagaacaaattaccaatgattgtgtgttgattctttgagctctttttttttattattatactttaagtgttagggtacatgtgcacaatgtgcaggttagttacatatgtatacatgtgccatgctggtgtgctgcacccattaactcgtcatttagcattaggtatagctcctaaagctatccctccccccttccccctccctccaccccacaacagtccccagagtgtgatgttccccttcctgtgaccatgtgttctcattgttcagttcccacctatgagtgagaatatgcagtgtttgattttttgttcttgcgatagtttactgagaatgatgatttccagtttcatccatgtccctacaaaggacatgaactcatcattttttattgctgcatagtattccatggtgtatatgtgccacattttcttaatccagtctatcattgttggatgagctctttatctcatggaaaaataatttataaaactctgtatgagaggagtgggaaatagtattaacgggtgcggggtttctttttgggacaatggaaatagctggaattagatagtggtgatgtttgcacactttgtgaaatactaaaaactcctgaattatacagttttaagaaacttttatttatttgtttttgagagaagttctctgtgtcacccaggctgaagtgtggtggcgtgatcaccggttattgcagcctcaatctctgaggctcaagcgattctcccacctcagcctaccaagtagatgtgactataggtgcgcaccaccacacccagtgaatttgtaattttttgtaaaaacaaggttttaccatgttgcccagtctggtcttgaactcctgggcccaagcgatcctccctccttgggctcccgaagtgccaggatacaagcatgagtcaccacatgcagcctcagttttaagaaacttttaaataaatgaaatatagtcataccaaaacagtaaaaatgggtttcaggaaaaaaaatgtttttttaaacaaacttacgtattgtataatcccagcccttttaaaaaatgctttcaaaaactggcagtcaactcataaaaggacaaatacttatgattccactgatgaagtagtcaaaagtagtcaaaaatcacagaaacaccaccataaatgtataatttttattttcaattaaaaaaacatcttttttttagtcaaaatcatagaaatagaaagtagacaggtggttactaagggctatgggatggggaaattagtgtctaatgggcatagagtttcagtgttacaaggtgaaaagttctagagttatgctgcccagcagtgtgaatatactttattgttctgtacacttaacatggttaatatggtaaatttagcgttatgtgctttttactatagtaaaattaaaaaaaaaaaaaatggggccgagtgcagtagctcacacctgtaacataatcccagcactttgggaggccgaggtaggaggatcacttgaggccagaagtttgaaaccagcctggtcaatatagcgagacctcatctctacaaaagaaaaatgttaaaattagacaggtgtggtgtctgtagtcccagctctctggaggcagggactgagtcagaggatcacttgagcataggggtttgaggctgcagtgagccatgatcctgccactgctgcagcctgagcaacagagcaagaccctgttgtaaaaacaaacaaacaaaaactggcagctgatacctgagagtgaatatcttttatcgctggttaatgggattgagagaatgcttcatcttatagaaagaacagtgtctttggacccacagagacctggatttaagattagctctgccaattactgagtactctttactatgaacctctgttttcctcatctgtgaaactggaataatgaatcctaccgccaacaattgtagtcaagttggaaacaatttacacaaagtgccaaacaccaagcctggcacagtaggaaccgagtaaatagtggttaatatttttatcagtgtctgcattgctgacgtctccatcatttctatacacttgtttttgaatcagaaaaagatgttattttaaaaaaataacccagtagtgccccttgtcccattcctatcagttatattattattgttactaccctctggaatttcaataactctttgttttttgggttttttgttttgttttgctttgcttttgagacaggatctctgttcgcccagtctggtgtgtagtggtgtgatctcagctcactgcagcctcaacctcctgggctcaggtgatcctcccacttcagcctcccaagtagctgggaccacaggcgcatgccaccacacttggctaatttttgcatttttagtagagacagggttttgccatattgcctaggccggtctggaacttctgggctcaagccatctgcctgcctcggcctcccaaagtgctggaatttcaggcatgagccatgcctggcctaaatagctctctgtgtttgcaaaagtgtgttataagaatcattcagagcctctcgattggatggaggctctagaatgcacagaaaaaggctgccaccgtgtatctctgcaagtcatgcacaagatggggaacagcaggcttccccctgcttaccagttcaaatacagagaactagccctgtagctgtttctttcatatctcacccattctaaagagaccacaggccttagaagtaaaggactcttttgttgaaagagtgttttcaaatttaaatgagcatttattggtcaaagatgcaccaactagtcttttgaagaattcaaggctctttagagaaaaataaagccttggaggagtatctgagaagcttgttagatgcgtgggaagagtctggaaataaaaaacttcatctggagtttctgccttctaccaacagagctgaagctaatgctctcctaagacaagcaaagcagatggtttgcatacttccttaccttccttttacttcctctgtaatagacttgtcatgtctgatgtttgggttgacgtggtactctaatagagttagagtctgcattttttttatgtcctctagtatgttctggttgatggttgagggcaacaaaccagcagtcccagatgccagcaccaagacctgagacaggtcacttaactctccgagcttcaccaccattctcaccttgcagacctcacagggaacagggaaagctctatgagatacaacatcattatgattaatcctattctgattctgaaagcaaagctcttcctacacaaactcctatttctaaatactaaaagacatttctttatggtgtattttgtgtacttgtagaaatggaaagtgttgagataaaacatgaagcaatgatgacaaagtgctaactttttcttgttttaatttctttatgctttttttccacctaatcccctagagtggtgtcttaactgtcaaactgggtggagatctaggaacctatgtgatcaacaagcagacgccaaacaagcaaatctggctatcttctccatccaggtatgtaggtatgttcagaagtcaacatatgtaattcttaaagacttccgaaatgtgacattgtggaccatttaagaaatgtcggctgagcacagtggctgacacctgtaatcccaacactttgagaggctgaggtaggaggatcacttgaggacaggagttcagaaccatcctgggcaacatagtgagtccctgtctctgtaaagaaaataaaaataaagtcacagctgggtgcaggcttacacctgtaatcccagcactttgggaggccaaggcctgtggatcacttgagctcaggagtttgagaccagcctgggcaatgtcacaaagccccacctctactaaaaatataaaaattagccaggtgtggtggcacacgcctatagtcccaactacttggaaggctgaggttgagcctcagcctgagcccaggaggtggaggttgcagtgagccaagatcgcgccactgcactccagcctgggcaacagggccagaccctgtcccaaaaaaaaaaaaaaaaaagtcatcgtcttatgttagcatccttgtaagtgagcctttcctgatattttgcagcctgtctcattctcagtagaaaagtttactctagttacataacttctccctgctgacaatttggatactgtaagcaggcatcaggatattaagatctgaagtgagtagcttataacttttccaaatccagcctagacagttttcctctattaaattattgccctgactttaaaagaagctacttttgaccttgtagcgtttgaacaagttgcactttgtcttcaaagcaagttaaagtttgacctctacttgttttgagcctctcaggtaaagggttatttgaattccctttgcaggttggggttgtgtaccctgtggaggtggtagagtgttatatattgctgctccagggcatttaatccctcctgccttttccattgatgtgctttcaatctagaggaataaaagattgtgttggagacacaatgtggcctgcatagcatctgaaagcctgagaacatgcagggagagacatccctcatccctcagcagcctggctgctgttgaagtggttgtaagaaagtaaaagagaaatgcccacaaaacgttctcagatccagtcattcattagcacttccaaagagagcatgttgactgtgaattgggaaagggccagataaaactagcatagaattctttgaaagactaacggtatttgcattttttaaaaattataaccttactctaccccctaacattgacatcatttttaggcaattaatattttaccatttattattctgtgatctctaatgctttgttcagaataaatagtgtgtttcctttccccacactttcatccaagaagtgtgctagagttcaacaaaaacagcactagaaatcactgtcattctaggaaggccctaattcacagattgtattggtttttagacccagttagtgtgctggaggttggaggattttaacctctgtgggccaactagcctctgtggcctcagtcattcttcctgaccctggctgtgcttgagcctgtgtgttcttatccttcatctccgggggaacgaagtggatcagctcggtccagcgatcacttttggggatcagtggctttgtagatatcgggcaggcacttaccccaaaagaactttccccatatctgaagactgaaaacgtccatatcgtatttggacacactgcccagcaatacgctctagctgtgttcagaagcatgggaatttggaaagatctgctgagcatgccgtttactgtcacagatactatcttcctcaaaaaaaaaaaatatatatatatatatgggggacggggcaggttgagactgggtgagactgaagaggtgccttggccagagcaggccacacccagagaccacaggctccccggtccacctcaggcccctccccttcctgcgccgtttccggcagatccagagtggccaccgccggatgggagtcgggggaagggaggcagagaagcgggccttgaggacaagctctcagtgcttctgtgggaagtggcggcaagacggcagctcccagcgggggatggaggccgagtcagtctgctggtcactggaggccaggatgctgcctaacacagccgtcccgctccgggcctcaccaccagggcggctctccccactcccggcctgctgcccacacagactgcggggttccgggggagcaggacccaggccgttctgcgcctgtcttcttggaaggagcaggccggagcgcgggagcgccgtgtagctgtacctgcgaaggcacaggattccgcgggaagatcccgcagtttcgggccgtcgtcattgtttttatacctgtggcaaatggcatgaccagacacacggttatgtctggagaaacccctgtagaggagcaggaggttgtggacatgctgtggcccggacagtggctgccgagcagttggagcctgcacccgcccaacttggctaaagaagtccccatactctctgtggaaaagatttccagaagctgttgtgtcaatatcaaagcctcaaaacaacaacaacaacaacaaaaacatgaaattatcaacaataaagatcatccttgagtctgctttgaaaagtagggtgaaattctgcagaggcattcaactggcaagataccaccctcatagccagatctgcaggtctcagccatcatgccagggaaaatgctccattcaccactcctcagcttctgcttctggtttcagaggtctctgtattggaggggctttaaagcaagaagggtctttacccacttactcttattcacagatgtgaatatgcaggtccagtggggaaagtgacatgtcctaagtcagaatagagtcaacaagaaaacagggcccaaaatgacttagcctctagtgtataatgggcattgatgagctactggaaatacagagatgaagaaaacacagtcccatcttcaaggagctcaatctagcaagggagacagactctttgtaggtgggaccgggcttccctgcagcagaaggaagcttgaaattggtaacgagcctcagaagggacagaggcaggccaccatgctaccctgagaggatcgcatgtggacacggggctatgacctggccctgctttgacccactagctgtgctgtagggccaggtggagcctggagtggcctgtgctaaggggctactatgagctctttccactcccccaaggcattgcataaataatgtcactttctgtttgcacagcaaaatcagggacacaattttctagaacatggggtgcctcccctccccccagcccaacagaagttctacaatgactgatgggcccttgtttttgtttgagacggaacaccccacagggttccgagtggtgatttgtggcccacaggccactggcaagtggaggcagagctgcagagccctcgggagccacagagggcctgctggccgccacgacatgccaactcagctgctgctggccctcctgtgggcggcagtgctagtgatgtgcagaatcttaggactagtgccaaggaacctataaataccctgggtgacccaggcgtgcactgctgtggtggccttcacagtcagaagatgacaagctgagaaggggagaatcggcccaaggtgagatccacagaaaggccagggccaagatgcggccagcacctcaggctggtggtggtcttacgttgaccatgccagaggccagtccttgattgctccaaaccctctgttcgagggttccaaatgaaatgagcaggtcctcgtgtcaggacctaggttagtttctgaaaaagcatgaaaagcaggcctcctgaacttccccgagtgactgatgcaaagtgcgtcctgcatgcttcacagcaccatggagaggatcttcaggggcaaactgcagactatctgaatgacggcactgaccatcagcaaaccgcagagctgcctgaccaagaaattgcgagacagaagcaatgcttgcaggcgaagaagaaggggccagacacagtggctcacgcctgtaatcccagcactttgggaggccaaggcaggcggatcacttgaggtcaggagtttgagaccagcctgggcaacatagtgaaaccctgtctctactaaaaatacaaaaaattcgccaggcatggtggcaggcacctgtaatcccagctacttgggagactgagacaggagaattgcttgaacccaggaggcgaaggttgtaacgaactgaaatcgtgccacagcactccatcctgggcgacagagtgagactgtctcaaaaaaaggaggagaagaaggaaaggccaaggcaggaatgaaacaggccatgaatgttggagtgaagcaactggcctcctcgtgctaagcggctactgtgagttctttccactcccccaagacattgcataaataatgtcactttctgacactcaccccgctgaatgtcctgcctctgctcaagggtggtatgatggggacttggcagtggaggggaacagggaaaccagacatggtggtctccccgcttcctggctacaagtccctctgaagaaatccaaaggagtaaagagcttggagagtaggcctctgtagggtgcaagggcacagctggagacggagctcctgaggctgcagctgatgctgcccgctctgcctgaactgcaccaaaaacgtgatgaggccatagcgggagtccacggaggaggatgcctactgcccgacctctagcagagactaagcaaggtgcatgaaaacttgaaccacatgtgtcacacccatgaccactacatgaagatggcccaaaacctggcccaggaattgaagaaagactcttccaatttgctgtaagaaaatggcccagggggcaagcacggtagctcacacctgtaatcctagcactttgggaagctgacgcaggcagatggcttgagctcaggagttccagaccagcctgggcaacatggtgaaaccccgtctctaccaaaaatacaaaaattagccgggtgtggtgatgcatgcctgtggtcccagctactcaggaggctgaggtggaaggattgcctgagtctgtggggcagaggttgcagtgagctgagatcacaccactgcactccagcctgggtgacacagtgagaccccatctcaaaaaaaaaaaaaagaaagaaaacggcccaggaaggctggagggccgccgtgtccattgagagagtgctccaggcactccaaaaagaaaatgaccacaatgggaagaaaccagctgaccatgagaccaagttccaaccttttacaagtggcctgtggctcctggcgccccgcccacagctgacaggggctcagaagtgctagggggaccatgggccaccagggccaccaggagggaggcaggtaacgatgcgagggcttggatgcagaacaccagctggtttgattctgttttccctgtacctgggtcctgaatgcccagaggctcagggaaacaccagccagtgctgctgcctttaaagcacttttgactgatctcttgttaatttagcaactgttattggttgatgctgcagttgctcttattgaagtttgattgatagcattaggatggtaaggcactatttttcaaataaaggttgtttaatataaaaaaaattttgtttttttttctctcagcctttcacattggttcaaaatatctttcatctggctgcatttctgatttttgttttgtttttttttcttaattttatttatttttaattaaaaataattttttttgtcaacatggggtctcactttgttgcctaggttggtctgaaactcgtggcttcaagcaatcctcccacatcagcctcccaaagtgctggggttatgggtgtgagccactgcagcagcctgttttttttgtttgtttgttttttttaatttgacaagttttcaggtcctgtgaaatcagcagtcttacctcccaccttgcgcaccctgaggaggttgcagaataaaggagaattctagggacacgtgggcatcagtgcctgtgctcagagcacctcaggcagtgtggaggggtctagaggttactcaggctctgcctggcaacccgatagcagtatcagagtatagggccaaggggacggtccttgggcttggtgtggtttattagtccttttcctgtgaccctgatggtttggttcactcatttttatctccatactgggaacaggttcaagccccagcatttggttgataatgcaggaatccttgatacttttattgcccaagcttcccttcctggtgacctcatcctagcctcagtctttggaaaagccctccttgagtgctcaggcagactcaggtgccctttcttctgggctcccatgcactctgttcttacctccatcagggtgccacatgcactagtgttatctgctgccgtggccaatcatccatgaggccatgaggaagtggaatgtacatctggtataagaagacatggcagaagccagcctccgatctgtccacacgaatacggcattcccaaagcaacgtgcatgtgccattattcacgggatgagcttgaggtggatgaactagcccaccaggctctcaatgtcatgaatttaacactgaattaagaaaaatatgttttaaaaataatagtttaggtgattgctggggtgctaggagaggaaggaatggggaataactgtttgatgggtatagttggccttgtgtatctgtgggttccacatctgattcaaccaaccgtggatcaaaatatttgaaaataaaaaacaaaacaaaaatgatacaaataaaaaccaatataacaactattaacagcatttacattgtactaggcattataagtaatctagagatgacttaaagcatacagaaggatgtgcctaggttagatgcatgtatcataccatttcatatcagggacttgagtacccacggattttggtatctgcagatcctggaaccccttccctatggataccaaggaacaacagcactgggtctccttttggggtgatgcagatgttttgaagctagacagaggtagtggttgcacaacattgtaaatgtactaaatgccaccaaattattcatttttaaatggttaatgtgttatgtgaatttcaccttaacaactaataatattataggtaaggcacaagttacatctgtagcacaaaaatggccctaatttttaaaacactgctccagcatagcaggtatcacatgtgaggtagcaaaagctggagatcaaagtgtgatacctggagacttatcagtaagggtcaaatgttttttcaggttttgagaatcattcttggaattgttccagaagatatatcgtataactcttcttagatgctaagataagaaggcagatatacactgtagctcattttgtgttattttctagagctttactccagttaatttcttgggggcagcatttgtggaatcagtggttcatctgaagggctgtgctgtggaattactatgcatttgttttgtcttccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaattgtcttcactcttcattctttgaaggatttactgcaagaagtacatgaagagcagctggtcaacctgctcactgttctatctccaaatgagacacattaaagggtagcctacaaatgttttcaggcttctttcaaagtgtaagcacttctgagctctttagcattgaagtgtcgaaagcaactcacacgggaagatcatttcttatttgtgctctgtgactgccaaggtgtggcctgcactgggttgtccagggagacctagtgctgtttctcccacgtattcacatatgtgtctgtgtgtatatatattttttcaatttaaaggttagtatggaatcagctgctacaagaatgcaaaaaatcttccaaagacaagaaaagaggaaaaaaagccgttttcatgagctgagtgatgtagcgtaacaaacaaaatcatggagctgaggaggtgccttgtaaacatgaaggggcagataaaggaaggagatactcatgttgataaagagagccctggtcctagacatagttcagccacaaagtagttgtccctttgtggacaagtttcccaaattccctggacctctgcttccccatctgttaaatgagagaatagagtatggttgattcccagcattcagtggtcctgtcaagcaacctaacaggctagttctaattccctattgggtagatgaggggatgacaaagaacagtttttaagctatataggaaacattgttattggtgttgccctatcgtgatttcagttgaattcatgtgaaaataatagccatccttggcctggcgcggtggctcacacctgtaatcccagcacttttggaggccaaggtgggtggatcacctgaggtcaggagttcaagaccagcctggccaacatgatgaaaccccgtctctactaaaaatacaaaaaattagccgggcatgatggcaggtgcctgtaatcccagctacttgggaggctgaagcggaagaatcgcttgaacccagaggtggaggttgcagtgagccgagatcgtgccattgcactgtaacctgggtgactgagcaaaactctgtctcaaaataataataacaatataataataataatagccatcctttattgtacccttactgggttaatcgtattataccacattacctcattttaatttttactgacctgcactttatacaaagcaacaagcctccaggacattaaaattcatgcaaagttatgctcatgttatattattttcttacttaaagaaggatttattagtggctgggcatggtggcgtgcacctgtaatcccaggtactcaggaggctgagacgggagaattgcttgaccccaggcggaggaggttacagtgagtcgagatcgtacctgagcgacagagcgagactccgtctcaaaaaaaaaaaaaaggagggtttattaatgagaagtttgtattaatatgtagcaaaggcttttccaatgggtgaataaaaacacattccattaagtcaagctgggagcagtggcatatacctatagtcccagctgcacaggaggctgagacaggaggattgcttgaagccaggaattggagatcagcctgggcaacacagcaagatcctatctcttaaaaaaagaaaaaaaaacctattaataataaaacagtataaacaaaagctaaataggtaaaatattttttctgaaataaaattattttttgagtctgatggaaatgtttaagtgcagtaggccagtgccagtgagaaaataaataacatcatacatgtttgtatgtgtttgcatcttgcttctactgaaagtttcagtgcaccccacttacttagaactcggtgacatgatgtactcctttatctgggacacagcacaaaagaggtatgcagtggggctgctctgacatgaaagtggaagttaaggaatctgggctcttatggggtccttgtgggccagcccttcaggcctattttactttcattttaca

SEQ ID NO: 15472 - DNA, 35457 bp, Human
tgaggaatgaggggaaacatcatcatgacatttgctgcctctcacagcctccccatgcactacagcctgtggggcctgccaacccattttccctggttactgtgcagggctagatttacttccagacttaacctctgggtccacctctcctgacatgtgctgtgccgttctttgctgctgggattgagggaagggggcccactcactcacccactcctcaccttttaatacccacaaccacctgctcactcacccagcagttcctatgctctcccctatacacattctttcaccaggaacctcagtttcctcaattgcagaaccaaaataagaatggtcttgatatcaggaactactgtgaagggaagtgatctgaggagtacctgggcatggagacagcacaatataagtcagttatcgtcatggccatttcagagctctttttccagtaaagcccctggatgctgctcgcctctgctatgtagcctcactcccctgcagccgggcagaatggagtccccctcctctccagcctgacttctcctcccctgctccgcgtccccagggcagcgtgcaccgataaatctttcccagcgcgttgcattgttacagcgagttgccctcgcatccgaccggccccccgccccacctctggagatcttcaaacccaggatctgtgccttggtcgtctttgaagccccggcccctggcacagcgcctggcacctggagggcgctcaataaatgtttgcaaaatcgaattctctgttgagcaggtgtccacccctccactcgcggagggtgggttgcgcgggcggaagggaagtctggctgtgtgccagggtgcggggggacacaggcaggggactcagggagcgggagagcgggagcgggtacgacgccggctagcggagcccggcccggagggtgcggcggtgccagacgcggagggcggcctccgctcctcccccgcctcctccccgcgccgcgcctcctccccgcgccgcgcctcctcaggctccgccacccccgcccggcgcggcagccgcagggaggggtccgggaaggcggagccagcggcggcccaggctctgggcactcgcgcggctcccgttcgcggagcacacatcccggcgcgacgaggtaggaggccgcgaggggaacggacgagggagctgggcgccgcggcgggaggggcgggaggccgggccgagaccctcctcccgtgctcccggacagcctcgcggcccaccgagcccaccgcgggagtctcaaccccgcccctcggcccccgcctccctcttcccgcgcccgccccgccgcgcgccccccgctccctgctgctccgcgtcctccgggaccgccctccgaggtcccccggggtcgctgctcctgcgcccagtgcgctccttgttctcccacaggttccttcggagagcgagcgggagtcggtgctcggcctcctgcggggagcagcccgagggtgagtccggcgtggcgtggcggggcggggcggggcggaggctggagggcccggggccgctcttacgcctcttagtggcaccggggctcggcgctgcgggctggctccatgtttgcggaatgaatcagtcatgactctccttctcctcttcctaaggaggactttttgaggtccacgtgctgcagagcacctttggagggcctcatgagataggggtcccccctcctgcatagtggaagcccgactcccatttccccccctcctctctgcactccagtctggaggctccctttgggttgggtcttggggggtcggggacagggggcttgtaggcccagccaggtagttgtggaaggtgtgtcccagcaggagacttgagccagggctcttagaaggttgcagtggagggggcgcgctgcggaggacagctgacactgtcaggcagggtcacttggcacctccaaggccagcctggaagagcctgcttgaatatggattttgacccacagcttactgaaagcttccacgccgctgtttcttcatcaataaaatgggaacattcgcagtcatttctcaggactttgtgcagacaaaaagtttatcatagaaatcaccccacacaatgcttggcacatcgaggacactcagcacatcttagctttatttccttcctctctgaaaaaagtaagcagagttatttgttcccatcctctctgtccacagcctggtctcagagaacacagtagatgtgtagtcagtttgttcaataaatatgcttgatggagcttcaatacccacctccacccccttctcccagaatctgcagggagaggtcgggaggtgacaacgccagcatgccagtgctatcggaggactctggtaagtacctccccccggctggacctgccacagtcctgaagacaagagcctgcctggcagcctccaggccctggcagtgagagcctggggagagaatgtcctcacggcaggactgaagtgctgtttgaggccccactcgggctcctcgggggcagggagcacccactgcgtttgctatcctttgtttttctcacctctccccaggtttgcatgaaaccctggccctgctgacctcccagctcagacctgactccaaccacaaggaggagatgggcttcctgagggatgttttcagtgaaaaaagcctcagttacttaatgaaggtgaagtcccacgtcatcctgcgtggaagggtgtctagaggtctttctagctgtctgtggccgtctgaggtcatcctagtcatctccctgccccaggaaggccttcacttgcccactacacaggactttctcttatggtgccctgtcagtggcccagtctgctgccccaaatgtccccacagccgtgggtgggatgtgtggtgtccagggtgcatctgaaatactctgtctttgcagattcatgagaagcttcgctattatgaaaggcaaagtccaaccccagttctgcacagcgctgtggccctcgctgaggacgtaagccccaggtttctccttacagtgtctgccccactccccaccctgtagggctccttcatcttgcctcgcttgcttagtgtggggacaccgggaatcaggagcccaaaggtgaagaggtgttttcttcccttgtcctcctccttctcttcctctctctgggttccccgaaaggtagggaggaacccgtgagccttggactgggctgggagacactgtgacatggagctgcccacttactgtgtgttctttagcaagtctgcttcctctgctgtaaatgagagcattggattggctcagcagttcccaaactgccctgaggactggtgatttgaataggtcaataagacattatgtctgtgctttcctgaagtcaagggacctacagtgtgtccccgcatactggctcaggcttctcattttttaaaggaacgcttcttaatttcttgtggacctagtcgtctatgttgcgtggttggggaaaacccattctggttgattactaagatcagttcctgaataaactcacctaaccccaggagatggcctggggagggatgagtgcagcttgtgggtgcagagccctgggcccttctccactgtggaatgtgattaggggcacattagattgcctggctcccaggctcagcgctgcctgtcccaccagctctgtgatgttaagtaggccactcaacctctctgagctcccatttcctcattcataaaatagcatctgagagccagataagcccaggttcaaatcctagctgtgctgtatatgagctctgtgacttcgggcaaaatgtttaatctctttgagtctcaggattctcatctgtaaaatggcaaagtaacaagaccctctgcatcaagttggttgcgagggttcagtgagaagatccacataaagcagaaagcacgtagggcttaaaacggtggctccttggaggatggccccatagagctgctcctgacccctggtgtgatgttcccaggatcatcgtcgtcgggtggttgagggtctggtgtgcccctgggggctgcagctgggtgggcccttccaaagaggaaggacccagcagatatggggcaggggcacctctagccatcagtggcgcctgtctcattctctgcaggtgatggaggagttgcaggccgcctccgtgcacagtgatgagagggagctgctccagctgctgtccaccccgcacctgagggtagtcacacagagcccctgcccagccatgcctctgggtctcctgggatgggggcggagggagctctcctaatgaggctgaggagtggagactgagggagcgatcctcagcactagtgtctgggcagttgtctctctggcatggcgtctgccaccctccataccaccggccagctgcggcctgctgaccctgtgagcggcgggccagccttccttttctctggctttcccggcaggctgtgctcatggtacatgacacggttgcccagaagaattttgaccccgttctcccgcctctgcctgacaatatcgatgaggattttgatgaggaatcggtgaagatcgtccgcttggtgaagaacaaggaacccctggtaggtgctgctgcctgcccctctctaacccactcttcccctgcctctcacccccacccagaacactggacaagatcctccccgaagtcttcagagtgagtgacggcagctttgcctgcgctgctgctcatccctgtggtgcctctgtgtgcagggcacccctttctctaggtggatacagcccctctcaactgtggccaacaccctttgtgtagttaataacctgcacaattgtacagggtgaccctgatcatgctttaagccagaaatggacaaactacagcccaagggccaaaaccagcccacagcttattttttaaaataaagcttttttggagcacaaccaggcccattcacttacagattggctgtggctgcctttatagtgcgatggcagagttgagtcgttgtgacagagactgtgtggctggcctcaaatatttacatgtggccccttatagaaaacgtgtgacaatgcctgctctgaatgttgaggaagcacagggcattcctctccccagcagacagactgctatcactttggtcctggttcagcattgatttaccgagcaaagggacagcgttgtttatgagatgctcagaagtggtggaagcccagagaattgagattggctccagaggatcccacagctggcattctctatttccaactttccccaaatgacctccgacgagcctcttctgcaaacagacgaggatctctcctctgcctctgtttcctcacttgtaaaatggagtggccatccattgatttagcaaacacattgtgagccctcctatccaggctctgtattgggtgctggcggttcagagctgaataaatgatggatagcgatgctggaaagttctcagttctggggggctagaagtcctgaggttcttagctgatggcctctctttctagcaataattatcttacgtacttcaaatagatggcacagatgatgttaacaataagtgtgcaaatgtgtttgcagttacagccactaataagtggttaacatatgttgagtgcttactgtgtactaagtgccttgagtggaatccttgcaacaacactgtgagttaaatgctgtcccacatctcacaggaaacaggcttggagaggataagagatttccttgttaagtccacatgctttttgtaaacggcagaactgtgttcacacccaaggctgtccagccctagagcttagctcttaagctttctgccgtcctgctgcagtccggcctgtgtggtgcaggaaatcgagggctcgttagtgcctttctcatcctaagtgtcatctctgctgtgcttcatgggccaagtcctggtcccgaagccctggctggggtgcataattggtttccctcagcagcagcagaaggcccggtaaccctgtgattgggtagaggcagggtgagaattagctggcacgtgtcatcctcattattaaatgtctttgcaagtggtaggaactgtgatatgagagagatgtgatggagaacttactggatttggcatcacaaaaagctttcccctttaccagctgggtgaccttgaggatatttaacttctctgagccccagtccctcatctaaaatgttgcagcattattgtgccttgtaaactgtacagtgcagggctatattaatgggggatgttggttttgttttgtcttcagcattgggaaggtccccactgatctctctggactgtcagagggagggactggggaggctgtgttgggtccagagagtaggggtctgaggtttggagctgctgcttaagaacctgtctcttctgtctcgggttcagggtgccaccatccggcgggacgagcactcaggggctgttgtggtggccaggatcatgcgaggaggcgcagcagacaggagcggtgagtggcggcagtgcaaagctggcccagccccgatcatggccattgttccagagccctccacctttgctaataggtccccttacctccctcctatcaggtcacctgtttgggatttgctttgctttctggggttgtggctggaattctcatctccttcccaagtcagtagaaattttaatagaaaatataggccagctgggcatggtggtgcacacctgtaatcccagcactttaagaggccgaggcaggcggatcacttgaagccaggagttccagaccagcctagccaacatggcgaaaccccatttctactaaacacacaaacctgggaggcggaggttgcagtgagccaagatcatgctgctgcactccagtctgggcaacagagtgagactctgtctcaaaaaaaaaaaaaaaagaaaaaaaaaaaaaagccaggcacagtggctcacgcctgtaatcccagcattttgggaggccgaggtgggcggatcacctgaggtcgggagttcgagaccagcctgacccacacagagaaaccccatctctactaaaaatacaaaattagccaggcttggtggcacatgcctataatcacagctacttgggaaggctgaggcaagagaatcgcttgaatctgggaggtggaggttgcagtgagccgagatcgcgccattgcgctcccgcctgggcaacaagagtgaaattccgtctcaaaaaaaagaaaaaaagaaaaagaaaatataggccatgcacgggtggcccacacctgtagtcctagctgttcgggaggcccaggcaggaagattgtttgagcccaggagtttgaggttgcagtgagccgtgattacaccactacactctagagtgggcgacgcagtgagaccgtctcaaaaaaaaaagaaaaaaaaaaaaaatatatatatatataaatagtcatggagtactttggggtgattgagaaaaagctcatgcgttggtttagtccaaggactgtgacagttaagaatatagcatgggcttgcgggattactaactgtgggacagggttgacacccttccccaccatcccaggtcttgtcaagctactattacaaagagagtgtttgtgccccagattcgtttgggtagaaaggttgagaatcaccggtgtgtggaagagctactaagctgggagacaaacctcctggtatagggcgatgttacccccaaagtctggggggtcatcgttgcagagaatcctagaccagcactttgcaaacattaacgagtccacgaattccctgagcatcttgttaaaatgcagactgattcagcaggtctgagctaggccgaagattctgcacttttaacctgcctccaggtgatgctgatgcagccgggccagtgcccactttgagtagcatatagggccctaatatgcagagacattagtcattcaggcagaggctcatagtgtgtttacactcttaatgatgtcttcattggtgcctttgtctttccttgttaagacttaagaatgccattctaagagttaatgataattttaaagaagcagagattatagcaaaaagaacacaggctttctacatcataataactgtgtttgaatactggcttcattatttctcagcaatgtggccttaggcaagctgcttaatcttcctgggtctcaggtgccaacttgtaaattggagattttactgggtgatttgagccctgcatgccgagtgaggtgcccagcacttagcagggcttagttcgccccagtcccacccatcaactttaaacctcgagttggccctgcagtgggcttctcaggccggcccctgtggtgcttggagctctgagcgaggggtgctcaggtcctcctcctgtgctgatggtcagtccctgtgtctcctaggcctggtccacgttggagatgagctccgagaagtgaacgggatcgcagtcctgcacaagcggcccgacgagatcagccagattctggtccgtgctacaagcctgctagggatgtgctgggtcttcagacacccagagcaaggcacttcctggagccaggacagattctggcttagccttgctgttgtcctgaggaggtggcaggcaaagtggccttatggtgtgcccctaacagtgtgcccggggtatggggtggcagcaggaggaggggaacttcccttccatctgcctctcttagaccttctcctcagcacagccttccttccttcccctggttccctttcacaaggcccctcctgggtcctgggtcctgggtgtgaatcctggctctgcctccttccagctgtgcaaccttggacaagccatcagatcatctgagtttccatttcctttcctttaacgttgggatagagtttctttctcaaccaatgtgtggttatcattggcatgctaacatctggaaaagggtaaagcccttcagaagtgtaaggggattttaaggtataaaatgcttggctgaaaacctccatggtccattctggggagttgaagtcaaaactgaaattgtgaaaagccccaatcatagcttggtcccctttatcctcaggattcctcccctgacctgacactctgctaacttctgatggttttgggggcagaaacaggatgagatctgaaaagaggaggcccactgtttaaagccctctctgggctgggctcagtagttcacacctgtaatcccagcactttggaaggccgaggcaggtgggtcacctgaggtcaggtcgagaccagcctgggcaacatggtgaaaccccgtctctactaaaaatacaaaaaattagctgagtgtggttgtgggcccctgtaatcccagctgcttgggaggctgaggcaggagaattgcttgaacccaggaggtggaggttgcagggagtcgagatcgtgccactgcactccagcctgggcaatgagagcaaaactccatctcaaaaaacaaaaaaacaacaacaaaataaagccctctctgtagaggatgcggattgcaggcaggcccttcagtccttttgcccaagcttgcttttttgtggctttgggtgccaaccttcttgtgctccagagcaagggtctgggctttctgggtagtggagaggccaggaggtgatcttttgggccctgctgtcctggtccgactgcattcttcctttgttgggcccctggcattgggctacagggtctctgtagatgagggtgaagggagctcctagaaagctgggcatggcctgagactggggagatggaagcaaagagggaagtattaatcagagaccagccccaaatcaggcaggaaagaggcaaaggaaaccgaaatgggttgttcagatgacccaggagaaaagcaaggaagggagccctctggggccgtagcggtcaggagggatggagaattggaattcaacacgtagtgtccttgggttctcatggaaagtcttccgtccctttgacttttgaaaatacagttaccaacccgccactgctaaatttgaactggcttaaaaataataaaaatactaaaaaatacaaaaatgtacagttacttggttactgagttttgttttagttcattcaaccagggcaccatcctagaagagtgggcctcaggggaggctgcaagtctgactttctgaacatcagtttttaggcctgagaagtaggagttgaactcttggagggttagacctggtaggcgagaagcttctgttctctttcgtttcaggcccagtcccagggatccatcaccctaaaaatcatcccagccacccaggaggaagatcgcttaaaggagagcaaggtatggggaggtgggtccgcggtgccctctctcagcttgagagatgcagctcgctggctgggggctggatccagtccagtctcttgtaacagtcatttgcgaacagatcatagatctgatcctagtaatctgtgcccagtggaggactttaattccgtcacaaagtgatgcatttgtttgtatcctgcctctttctaaacaggatttgacgtggcttactaataaaagacaaggttattttaattgaaatagaaactcagggccatgaagaggaggagaaggtaccaagtgtgctgaattctgaaccaattaagcaactgccatttgtttaattgttgctgagcctgccttatttggtcacctactctgtgccaggcactctgccagatgctggagacagggactcttggtagctgcaaggcttcctggtgcagaagggcagcaagtctttcattgctatgtgataagtgctttgccaagattctgtacaaagagttacagtcaccctagagggtgtcacagaatgggggtgttggaactgaggcctgaagaaggtaaagacgagtaggaccttggtggggtctgcccatacagaggctccctggcactctggagaggagcacgttaagggctatgtggtggggctttgaggggaggatggtggtgggttttgctggggaggtgggttaagcctatgttctgaatggcctcgaatgccttgttaagggttttggcataatccttgcttagtgtggggcctcttagaagctgaccctgagacaaggattgaatgcaaatggtttatttgggaagtggccccaggaaataccagtacaggactgggaaagggaagacagccaatctgactaagggtgtgttatcaagcaggttaccactatgggcagctggagcttagtcctgctgggaacttggggaactacttcttcccctgtagaacacacgcctccatcatcccacccaggggccctgggagctgggcgatctatataccaactcctgccaggctgcacccgggggattaattcctagcaacttctgcctgctggactagagatgagtaggttccagtggccagagaaagtaagtccttaggcaaagagatgcaggtgctggcagctggaagtcagcccaggctgcactgaatggtccagccctggggcatatgggagggcatcccacagcccaagagataatcccataggttctaataagctcttttttttttttttttttttttttttaggatgggagtggtgcagttatatttgtgttttagaaagctccgtgaggcagccacggggaggagggtggagtgggtagaggttggaggcagggaggcctggtagaaggctcttgtaaaagcccaggtgagacgttaagacctgaactgtgagatggtggttgatgagatagagaggagggcatcactttgatttcatagtagagtttcctggcagccaaggcaaaaaggagagcataatgaattacatactgttgagcagagaatggaaggaagcatgccagtttttcaagacattcccatacctgcctctcagtacttaatgcatgaaagaagaaacattacagcatctagcacagaggagatgtcagtcgatactttgaagaatgtggatttgtaatggactacgtcttcaatgacagttttttacagcaagtgaagaaataatctttatatagctgtttcttatttgtgctctttggttaaatcccagggcataatatttcctcttacctggtggaaagtgattcttcctaggacaagcgaatgtggtccgcacatgcaactttgagggttctgacttgaggaaacctctttgaggaagagaacttggttttcctaaaggacaaaatgagtagcctgtcccccagcctgtccttcttgaatatttcttcttgatccagatgcttgatttgggctggccacttaagattacattcttctgagtgcttaggaccctggtaacatctgtggctggttaagggcatctgtccccacaacatatgccagaaagttcttactgttgtccagtggaatcttttctggttggcatacaaaggaatagagtttgtatctgtctgaggaagacccctgattgctttttttttcctgtttgccactgaagtgattgggccctaatggtctgaaaatagaaataaataaagttaatccatgccactaaattatcgaagagaacaaggaagtgtgaaaaatgctgtgtcctcacaccatcttctccagagagggtgactctagagcagaggggggaattagggcttggccgagtctatggcagacgaggcaggattgagccgtaagagctgtgggtgtcaattacccactgaaaagtgatggtgaggagtcagtaacagtagttttgttgatatttgtgttcttacccaaacatctagattacttatataacagatggctgctgccttccgtcagcgcagttggcgtatcaaaaataacacttgagttagaaattgtgcttgcctttactttttgttcccaggattagttgttgctgtgtgtatgctaagaggctgttatgaggacagctggtcaagtaaataaggaaatatttaggtaggaaagagacattcagtcatggggcttattaattttctgattcttgatggacttcctgactatagtatcccaaatggttgaagaacagttaagaacatacgtgcagtgtatttccaagtagctttctatttgaaaggccacttggtcctcctaagtgtggatggtcgttgtcatgtggcctttgatgtgacaatgacctgtctgtgctcacttggggaagggccgcctcaccagagccctccttgtgcaggtgttcatgcgcgccctcttccactacaaccctcgggaggaccgggccatcccttgccaggaggcgggcctgcccttccagcgcaggcaggtcctggaggtggtgagccaggacgaccccacgtggtggcaggccaagcgagtcggggacaccaaccttcgagccggcctcatcccctccaaggggttccaggagaggtgggtctggggtatgttgtgaagggctggttccagagtggcagaggcacaggtacatggcagacccccaagtctctgccctcacagccagaggggcctgctgagcattgttcccccaaggtaagtaccagttgcacttgtgtttggtcttttcccataactagtgatgatggttatttgagatttaaaggaatctatggaaatttatgttattaagttaatgtgtgtgtgtgtgtgtgtgtgtgtgtgtgtgtgtattttttttttttttgagacagagtctccctctgtcacccaggctggagtgcagtggcgaatcttagctcactgcaacctccacctcccgggttcaagcaattctcccgcctcagcctcctgagtagctgagattacaggcgtgcaccaccatgcctggctaatttttgtatttttagtagagacagggtttggccaggctggtctcaaactcctggcctcaagtgatccacctgccttgacctcccaaagtgctaggattacaggcatgagccactggatccagcctaagttaatgtatattttataatgcatgctcagagaatgctgataaacaaaatataaaaatacagaagagaggctgggcatggtgatgactcacgcctgtaatcccagcactttgggaagccgaggcagaaggttcccttgggcccaggagttcaagaccagcctaggcaacatagtaagaccttgtctctacaaaaaataaaaaattagctgggcatggttgcacacacctgtagtcccagctactcgggaggctggggtgggaggatcagttgagcccaaaaaggtcaaggcttcagtgagctgttatcacaccactgcactccagcctgagtaagagtgagaccctgactcaaaaaacaaaacaaaacaaaacaaaaaaacagaaaaaaactgaagaggaggactatgaaaggaaattccccacgtctcacccttatctaaactgcatagtttgtttccttactgtgctttttatgtgagtgttgcatacagaatttggggtcttgctttttttttttttaaacatttttggcgtgagtattttccatattatagcatcgtttttgtagtgtgattttagtggctgtatactaactcatcaggagctgtgccattcattcctaggcggcaggtatttaggatgaattgagctggccttgtgctggcatcttgcgggctgctgtgaatccagggtttctgccctggaggagcttatagttcagtggaaaagccagacgctcttcaaacacacagtttatataaacgtgatgggtgcaagggaggaggacatggtgctgtgtgagttcatattaggaggctgcgccctcatccaggaatgcagggaaggcttctcagaggaactagctaagtgatttcactgctttcctgtggctgcacttcgattaggttgttcccaattcttcacttttataaggctgcagtacttacttactttgcacatagactgttcctcatgtttcaaattatttctttagacttccaggaaggtcagtcttgggtcagagggtggcagttgtgacttccactgtgggttgtagccctcacatcttttggtgtgtggactgtggtaaggacaggaccttggggttcacccatttcagtggccctcaaggtgtggccccctggctgggggcttcagcgtcacctggggacttgttagaaatgcagatccatgggtcctgcccagaaactcacattctaacaaatgttccaggcgattctgagatgccgaagtctgagaacgaagctctgtctcctcgggaaccccagacccatctccattttagggttcacaggtcttggcaacatcttaccagaggatgtgggggacagctcttcagctgcattttttttttttttttgagacatggtttcactcttgcccaggctggagtgtagtggtgctatctcagctcactgcaacctccacctcccgggttcaagtgattctcctggattctcctgcctcagcctcccgagtagctgggattacagacgtgcaccaccatgcccagctactttttgtattttttagtagagacggggtttcaccgtgttggccaggctggtctcgaactcctgacctcaagtgatcctcccgcctcggcctcctaaagtactgggattacaggtgtgagccaccacgcccggcccttcagctgcatttaaatgtggaaatctagtgacctctgagagccccacctctccactcatggccacattggacagtctgcccgggctgagccttccgctgaggggagggtgttaaattagggtcacttctgtcctcggcctctcctgggagtcattctgctatttctcagctccctcagagatggggaggctggggagtagagaaggggctgcctctccttagaaattggccataggagagtaatgaccagctgaggattgtacaccgggctggatcctgtgtggccatcttgagctggatgagctatttctggagcaagagactcagtttcttcctcctggtgagccagtgagccctgtgaaagtgttcccttcgttggaacttagtgctaagcaggaggccctcagagtgtccagtgtgtgcccacctgtgggatccaggccttggcttcccaagttttccagaaggttcctttcaagtggttatctggcccagctcacgggcccgcccatccccttgtgtccctgcagacgactaagctaccggagagccgcgggcaccctgccgagcccccagagcctcaggaagcccccctgtgagtagattgtcagggatggcactccagggagggcccggggttagggcgagggaggattcaggctgggaagaagtaggcagtgggctggagggggcatcaggggtcttgtctgagctcatggactccagaggaaggagggggtgggaagtaggaggtggggggcagctagtccctggagaggagcttgtatatttggagtccatagatgatgctggggggtatgttaacagctttcccaaaatgtgcagatgtgtgtgtgttcacacgcgtgtgcatgtgcgtgtgaggatccacagctttcgttagattcccaagggctctctgaccttgaaaatggaagaagcactggcgttggaagggaatggagaaggccatgtgtgacctggtgcctctggtagggctgccagattgccagactgggcaaatacaaataaaggatgcccagttgaagcttgaatttcagatagatgacagattggtttctagtataagtatgtttttatgtagtttttattatagtataagtatgtcctgtgcaatatttgaggcatacttatactaagaagttacttgttgtttatttgaaattcaagtttaagtgggtgtcctgcattttatctggcaactctacaccgtgtagcactttacactttagaaaacatgtccacctacttcttggaaccctgtgaagtcggtagagtcagctatcttttctaagctgggaatatgtagggtcacaaggttaagtgagcagagttggggtcacattttctgaaggcctgtgatcagagccccagggtagggccccgtgcagagaggaagcttttccagagcatggtctctctggtactagagggcagacttgtaaccgagtgagcggcctgagcaggtgccaggtgaccagaacacagatggcctgcagctctgctccaccccgctccatcctcaggcatctgcgttttccagggccagactccaaccccagaaaagagagagtgggtcctattcccaccgcaggatcctagagtaagctgctccctgggcccctgacaatggccacttttccagacttgctgtcaggttagaagggcagtggccttgaggctgctgtgccactgatgagctggctttctctggtgctaatgagacacatacaagaagactaattagagcaggtcttggggtttaataacgtaccacagctcagatcacaggttcgttggaggaaagggaaagaggccagatggcgggctcctcaggcactcgggccgtggctgccctcagccgcagggtccccgcttccctccactaatgctgttccatctgtcttttgtgcaaaccgcagatgatcagccttgtgacaaaggtaggcccagtatctatccgctgtccacaggcgtggccccttttccgtggaacgtctggggcctgaggggctcgtgttctttccctatctgggcagctgtgcccctcccactgtctgcgcacctcttcctgctctgccagctggactgggctgttccttgaggcaggcaaagctggtggggacagggttcaaggccttaggggcacctccctgccctcctgacacgtgcggcccagcctttccaggactcggctacgctgtgatggggctggataggagacaaggggtgggagggcagggcaggctggagtgaatccctccctattcacactgctcacactcagggactggggaggcctgctggcctagaatccccctcagggcctggaaaggctgttaggggcctaagcatggagaactgagcaaaacagaggaccttgctttcttggggtgtccaggacatgggatttcccctgagctccccacgagacaccatcccagggggctcttcctgcctggccatccaggggctgggtgccctgggccggatgtgtctggtgggactcactggcttccctccctctgtttgcttcccagagacctgtgactgtgagggctacctcaaagggcactatgtgggtaagtagctccccctgacacccacatgcacgacctgccccacccaaggccccagagttagggagaggtcaaagcagggtgatctgagccccaggagtccttctggagcagtggagcctatgggacccccatctctcctcagttctctcaacccaagcaggagctgagcctgcccaggcattgggcccccacccagcttttacccagctgtggggcacactgccctggcgggaaaggcacacacacccctacattaataccaattctattatcaccatcattgcaattggagtttattcaatattaacaccactaccacgcagtgaggggtgtttgcggctctccagagccccttttcacttgttttggtcagttttttcaaaggtcttagagataggcaaaaagttttttttgttttttggttattttttagagacagggttttgccctgtctctcacgctggagtgcagtagtgtgtgacattgcagcttgcagcagcctcaatgtcctaggctcaaacaatcctcccacctcagcctcctgagtagctgggactgcaggcatctgacaccatgcccagctgattaaaaaaattttttttgtagagatggggtctcgctatgttgcccagctggtttcaagctcctggcttcaagcaatcctcctttctaaaaagtttttaaactttttttaaacttattttttgagatatggtcttgctctgttacccacactggagtgcagtggtgtgatcacaaatcgctgcagcctcagcctcccaggctcaagcgattcttccctctcagcctccctagtagctgggactacaggtgcatgccactatacctggctaatttttgtattttttgtagagacagggtttcaccatgttgcccagctggtcttgaactcctgagatcaagtgatctgcctgccttggcctaccaaagtgctgggatacaggcatgagccactgcacccagccccttaacttttgtcctgaagtaatttcaaacttactgaaaaggtgtaagaattatacaaagaactctcatatactccacacccagattcaccagttgctcctttgccatgtttgctcaatttcctttcccacatctctgaatttttttttcctgagtcatatgagacttagttgtagacatcgtgtccctttaaccctaaatctctcagcatgtatttcctaaggccaaggactttctcagggcagtgatcaaattctgagaatttaaaatgtatccaaatctgttatatgctgttatttaaatgttaacaattgtccccatcatgtcctttatgacattttcccttggtccaggatctaatctaggaccacacatagtagttgtagattcatatcttcatttcacaggtaaggaaattgaggctcagagagatgaagggacttgtccaaggtcagtcacatgccaagtaaaacagtgaccttaagccctagtttgtgaatgcaggggtcaccctttcatcttattattgtatttcctgaacaacctcttccagtagcaggaggaggttgggagaagtcagtgggactcagtcccatctccaggtctggccaggtgggaaaagtctctactgggagatcctgggacaactgggacaaatgccatggtgtccctctgcccctcctcccaagctggtcttcggaggagcttccggctgggctgtagggagagactgggtggctcgcaggaaggaaagatgtcctccggagctgagtctccggagctgctgacttacgaagaggtggccaggtaccaacaccagcccggagagcggccccgcctggtggttctgatcggtaggtgccatcctgggtttccaggaagtgatctggtttcctccctggagcaggtggggagggagctcagcagggaccctggtcagccttcttcttgtttcccagggtctctgggagcccgactgcacgagctgaagcaaaaggtggtggctgagaacccacagcactttggcgtcgctgttccacgtaagagggcccatgtgggagtgtgtgtttgtctgcacacacacaaatattccatggagacttaactccccagatccatccaaatccttactttgggtttaaaggatcaccaggcactgcctgctattggcaaattgtgggacaaaggcatgatgggaagaaatccactcccagtggtcctctgagaccctctgaggcagaagttggaggaccacttgcttggttcctgcctggggtgggagatgagtccagagcacattgtaggcaaagtggcagcctcaacctgacaccacggggcccccacagtagggggcattcctcctcatcacagtgaattttgactcctgtggccgctgccctctgcttggatgagagggcaggtcagagaagccacagagccctgtgagtggtatttctcggcactcccttatagccagattccagtttgtcagggtagctgggtacattcctgggtgatgcctcccctgccaattcctggggcttactgctgccaggggcaccctgggatgtcaagctccagtgggcagaggatcctggttctgaatgtgataaggaggatgaggaggaggagaatgaaggtgccaggtaatgcaccaagagcttttatgtgtagtgccctgcgtcagccctcccagtacccctgagaagagagattgttatcatcttgtgtggcagaggaagacagtgagggtcagagaggttaagtaacttgtccaatgtcacacagttggtaagtggtggagccaggattcatacccaggcagcctgccccagtcatgttcttaacgaggatgcacaatggcctctcacctgccgcctcccacttcgtgcccttggctgccccttttctttctgggactcactctcagtccccctggcctcagagggatgcagtgtgaatgcctggtggctactgagaggggtgctgtgggggccctaatggggcctcctcagagtgttctggggcagagcaaccatgaagccttgctttgatcacaccgctctccctgggcccctgggcccagcgtctagtctgtgggttgtcagagctgtcttccacagcccaatctgaagtggcagggatgtgggggaggtggtggccctggggaggccatcctggcagcacacctgtgatggacctggagggcttcagggagccacggccttccaagtttcaggtggactgaaacaggacatgcagaggttgctcacacactgatcgttcagaaccccttggatccaccccctggagaagaggtacctggatggtcaggcccacctgcttctaggcactccacagataggagactttcctcctttgttttagaaactgggggagtcagggaagccttcccagaggcagtgacttttatgctgggttctgaagagtaaataggagttttccaggcagaagagaaaggaatagttctctttacagaggaaacaacatgtgcaaagggacggagcagtgttggggaccggggagattagtgtggatggtgtgctggaaaatggagctgagaggttgggcagatcacgcaggtctcagatactcagctagggtgtttagaatgtaacccatagataaatacaagtttttaagcagggggatgacatggttggaaaagtgaccctagcacctctaccggaggttggactaagatgccacagaaagaacacagggcataccctgggtggttcccatgggccagaagacacagtgcctcaagatcccattttatcttttggaaaatactgtgtgtgtggctttgtgtgtgcccttgttctgcagaagacctgattttcctcagaagtgtgcatcccaattctgttatggaaatcaatgagaaaacaccatgtgtttcaacatttttgtttgagagccagccttgctgaaacacatccgatctatatagggacggtctgtcttcctgtctcctttttctggagatgagaactaattgactaaagaattaaaagcatacatcagggtcaagtgtatgtgtggctcctttgctctcaaaaaataaaaaacaatgaagaattaaaagttaggactaggggtcccttaagtgattctttaaaagccacagcatatgctgggcgcggtggctcatgtctgtaatcccagcactttgggaggctgaggcgggtggatcacctgaggtcgggagttcgagaccagcctgaccaacatggagaaaccccatctctactaaaaatacaaaattagccgggtgtggtggtacatgcctgtaattccagctactcgggaggctgaggcaggagaatcgcttgaaccgagaaggcagaggttgcagtgagccgaaatcatgccattgcgctgtagcctggggaacgagcaaaactccgtctcaaaacaaaaaacaaaacaaaacaaacaaaaaaaaaacacagcatcagggagtcagttagcagagtggttaagggtataagctgggcatttggcagagagaccgattctggctgtgctctctactggttgtgggtcactgtgcacagtgctgaacctctccgtgcctcagttttctcagctgcaaaaggaaaagcctccttttgcctacatcaaagagttgttgtgtgaatcagtgatacgcctgcctggaaaggcacagtgcctgatacagggacatgcaatgaggtggaagtgcctggtttagacacagcagcagtgaactcccaaatgagtgcctaagcctgctgctgtccctgcgtgctgtgatgtgacatctctttgcccagctttccttctttctttaaaagataccaccaggccccgaaagagccatgagaaggaaggagtggaatatcactttgtgtctaagcaagcatttgaggccgacttacatcacaacaagtacgttgcttgatgggccagttggccctccaggcagttgtgtgtttttgtatctgtattccactagagctcctgggaggactcccggaaaggatgggggaagcgggagagaagtcatgttgggaggtcccctttgctttgctaatttaggaaagctgaggaactaaaggccttttcccctttggtggtgttttaggttcctggaacatggtgaatataaggaaaatctgtatggaaccagcctggaggccattcaggctgttatggccaaaaacaaagtttgtttggtggatgtggagccagaagtgagttgctgggcctgctggccatttctggttaacggaatttataactaggggattgtacattttacacaacacttaacctcagtctaaggaatttttagtctagaacactggctgttcaatttctttgggtcttcctttgagaatcaaatgaaagccttgtaccccaaaacatgcccctctatccacaaatgctgcattaattgtagggagcttgtggacactctggtggcccacagacccaggctagtaactcctgcgtggaacagatcatgcaatagttggtggcgctgactggccattgcaatgtgccagagaattagatgtcagtacccaggtgaaactggggctgagctctcggtgccaggcctccccctccccaaccagggcaggtggagtcagtggcttagagaaccactcagggaggcagtgaggagagcagtttaaaggggaaaaagagggagggagacacggccctgggaagtgcttcaaaaacatttccactcctgcacacccagcatgctgtggactcagcaggggcttaaccatctttttaaccttgtcttttagaaaaacttccaagctttgaactcaatctggggattttttttcccctctatagaaacagatctctgattttatgctataaactgtaggctttattttaaagaagtttgcttgaaatatattccaaaaagcacgttatgcctataaaggaaaacactcatttggacttacagggagttagtgatcaaaattaaaagtctgagtttcaaaattttctttgaaaagtgattttattgatcactttattgatcaagggtgcagataatgcatatagcagtttaatactagtgtttccaagtggagcccttacttctagataaaatgcattaatcaagagtacaatttctttttctttttttttgagacagattcttgctctgtcacccaggctggagtgcagtggtgcgatcttggttcaccgcaagctccgcctcccgggttcacgccattctcttgcctcagcctcccgagtagctgggactacaggtgcccgccaccacgcctggctaattttttgtatttttagtagagacggggtttcaccatgttagccaggatggtcttgatctcctgacctcgtgatccacccggctcggcctcccaaagtgctgggattacaggtgtgagccaccgcacctggcccaagagtgcagtttctacagtctacagttttaaatgatctgttcagtaatctcatttgctttgcaaaccttttcttctttgaataccaagaggagatgtaatagcacaaagtttgtaataatgtagtccgattgatgacatttgactaaatagatacacactgactcctgcttcctcacccatcagaaatggaaggtggagaggagcctgagaaggttaattatagccggaggagtcagagctaagagagacagcaactgtctctgagctgaggcttaggaaccttctgttggcagtgagtgtgacttcagggccccgctgagttcaacgtcaaagtgaaggatgagaaaaggagcagttggtctgcccagttgaagtccattgtcatgggacccatgtaaccaggacctttgctgttgaggttatggtattgaagcacacgattattgagctttcaaaagtctatttcacaacaaaacacttcaaaagtatataatattcctgaactttctttctcaggcactgaaacaactgaggacctcagaatttaaaccctatattatatttgtaaagcctgcaattcaggaaaaaagaaaaacgccacctatgtccccagcttgtgaggacacagcagccccatttgtaagtttaaagttgattgtttcttttctgaaggcctaagggaggctgttacaggaacgcttctagctgcataagggtgcttgcagctgaagagggatgcgggacacaccttctacatgtgattgtctttccattttgcctattgaaaaacttaagagaagatgattacatggccagaaggctcaaggtgaacagctggaagtgcctcccaaaccaggcaggtggctttgcctgggctcacgcccctccactccctcacataagcgccctcccgcaaaatgtgacacctgtcagggacctcatctgagtgtgacagactgtactcatcaaactatactcctaggccaaatccaagtattttaaattgaaaccccaactaacaaggtcattatcactgctatcaaaccagtttgaatcatcagtgaatgaagggatttctaaaactagtggatgagatcgtctgatgtgtcctaaatgaacttctgtttcactgtcatagattctttgttcagcccagtctatgtcaggatggcgagaccctcacccaaaacctaaatatttgacagagttcttccaggaggtgtgggcttggtgactcatcttttttggttcttaacagggtcagttagcagaatgagttggaagttgttgtgggtggtgggggcagtcagaagcaactcagtcccagaatagactttacttgctgtcctatatagctggtttcatctgaaggaggccttctcggatccttccccttggtcaggaagctcccgctgagtcaagattttgatgcaatcctagttcatactaattctcagttttaactgtccacgttgatacactttttattttattattatttttttaaagacagggactcactatgttgtccaggctggtcttgaactcctgggctcaagtgattctcccaccttggcctcccaaagtgctgggattacaggtgtaagccactgtgcccagccttttatttttttggggacaggatcttgctgtattgcccagactggagtgcagtggtacaatcatggctcactgcagccttgaactcctgggctcaagcagtcttccttcctcagcttcctaggtagctgagactacaggcatgtaccatcaatgcccagccaattaaaaaaaatttttttatagagacagggtgtctctgtgttggccaggccggtctcaaactcctggcctcaaatgatcctcctgcctcagcttcccaaagtgttgggattacaggtgtgagccaccgtatctggtctcagtaaattatttagaatggcatacatacaaggaacattagaaattctctccttggccaggtacggtggctcacacctgtgtctcagcactttgggaggctgaggcgggcagattgcttgagcccaggaattcaagaccagcctgggcaacttggtgaaaccccatctctacaaaaaaattacaaaaattagccaggtgtggtggcacaaacctatagtcctagctactcgggagactgaggtgggagtgggaggatcacttgagcctaataggtcaaggctgcagtgagccatgaccatgccactgcattccagcctgcatgacacagtgagactctgtctcaaaaaaaaaaaaatgtagaaaaaagaaaaattttctcctttagaaactctaagggggaggctggcatggtggctcacgcctataatcccagcactttgggaggctgaggcaggcagatcacctgacgtcaggaattcgagaccagccaggccaacatggtgaaaccccgtctcatactaaaaatacaaaaattagccaggtgtggtggtgcatgcctgtaatcccagctactcgggaggctgagacaggagaaacacttgaacccaggaggcagagcctgcagtgagccaaaatcacgccactgcactctagcctgggtgacagagcaagactccatctaaaaaaaaaaagacacaagaaactctaaggggaataggggaatatcaacttaagtctagaatcatttagaaacatacaatattggctgggtgcagtggctcacacctgtaatcccaacactttggagggccaaggcgggtggatcacctgaggtcaggagttcaagaccaacctgaccaacatggtgaaaccccatctctactaaatacaaaaaattagctgggtgtggtggcacgcgcctgtaatcccagctatttgggaggctgaggcaggagaattgcttgaacttggaggcagaggttgcaatgagccgagattgcgccatcgcactatagcctgggcagcaagagcaaaactccatctcaaaaacaaaaaaaagaaacatacagtatgcccatcatataacaaaaaaatcagagacaacctaaataatgttcactgtcaggactcagttcaatatactccattatgtgacacttacaggatgtattgaagtattatagccagttaaaagccatatgttggggccgggagtggtggctcacgcctgtaatcccagcactttgggaggctgaggtgggtggatcatcagaggtcaggagttcgagatcagcctggccaacatggtgaaaccccgtctctactaaaaatacaaaaattagctgggcgtggtggcaggcatctgtaatcccagctactcgggaggctgaggcaggaaaatcacttgaacctgggaggcagagttttcagtgagctgagattgcaccactgtacttcagcctgggcgacagagcaagactctgtctcaaaaaaataaattaattaaataaataaataaaagccatgtgttggaggaatatttgatgacatagctaaatacaagaaaaaataaatcaaaataaaaaatcaggattctaattttgtgttacacacaaaatacactaaaacgctaaaggcaattctccctgaatagtgggctcatgactaaattttgttttgttttctgtgtgttttttggagggggagttaacagctttactgagataaaatttacatactgtacaattcacacatttaaagcatacaattcaatgatgtattcacagagttgttgcaactaccacagtcaatttaagagtattttcatcacttcaaaaagaaaccttgagcccattagaatttcccattatctgttttcctccagccccttcctagccacaggcaactgctaatctactgtcactataaatttgtctattctaaacatttcatataaatggattcatgcaatgtaagaccttttgtatctggcttttttcacttaatataatgtttttaaagttcattcatgtatcaatacttcattctttttttatggctgaataacattccattgtatagagtaccacattttgtttacccatttatcgattaatggacatttagattgtttctaccttttcagctattatgaatcatgttatgaatgttcatatacaagtttttgtgtgaacatatgttttcatttctcttgggtgtataccttggtatggaattgctgggtcatagggtagttctatgtttaactctaccatggcagctgtaccattttacattcccagcagcagtgttcaagagttcccatttctccacatcctcaccagcccttgttattgtctgtctttttaatcatagcactactagtaggtgtgaagtggtatctcattgtggttttaatttgcatttctctaatcatcagtgaagttgagcatcttttcatgtgtttattggccatttttatatctttcttggagaaatgtctgttcaaatactttgtccatttttaaatgtccattttttgttattgagttgtaagaattctttatctatttggatacaagtcccttgtcagatgcatgatttgcaaatattttttcccattctgagttgtcttttcactttctttttttttgagacagagtttcgttcttgttgcccaggctggagcgcaatggtgcggtgttggctcactgcaacctccagctcccaggttcgagtgattctcctgcctcaacctccaagtagctgggattacaggcgcatgccatcatgctcggctaatttccttcgtatttttagtagagatggggttttaccacgttggccaggctggtctcgaactcctgacctgggtgatccgcctgcctcggcctcccaaagtgctgggaggcaccacgcctggtccttactttcttgatagcatcctttgaggcataacattttaaaatgtgataaagtccaatgtatctattttttcttttgtcatttatatttttggtgtcatatctaagaaatcattgtcgaatccaaggccataaagatttactcctttgttttcttttaagatatttatagttgtagcagttacatttggatctgtcatctattttgtgttattttctgtggattgtctgaagtaggggtccaacttcattctttgcatgtggatagccagttaccccagcatcactggttgaaaagactattttctcatttaattattttaacacccttgtctagaatcaattggcaagaaaagtaagggtttctttctggagtctcagtcccattccattggtctacatgtctattcttaggccagcaccacactgtcttactttgattactagctttgtagtaagttttgaagtcaggtttttcaagcttgttttggctattctgggtcctttacatttccatatgaattttaggatcaatctgcccatttgttttactatattggctttgttttgttttgcaaatatttcaggattgaataagcagggggaaatggctcatttttcaaagagtcaagaagtcactgggagaataagaggcagcttcctaggactcaaggccaaatcatcaggtccacaggcagtgccagctttctaggattcagaaccctccctggcccatggttgttatttcaagagaagcagctgcattctattcccagtgtccttccagcctggccggttttgtcatctatcccatctcctttattgcccaccagaatgctgcattccaagcaggtgggctgatgatgaaatgcagctggcccgttcatgctccaccacactgcagctgtgagtaggcagcagggtcacagtgaggctgttcaacacagagtccccggttctactcccagagattccgacctagggggtttggagtggggcccaggcactccatttttaacacacagcctttcatgtggttttgatgtatgttggcagaccccagatgacatttggagaaattcctcacaaaggcatgggttttgtgtaactttaaatatctgtccattgtctggcacctgagttcctggtaggggacccaaaacatcctctgtttccttgctgaccacaagttaatggggcttctggcttctgacccggcaaagctgatccaacctgggggtgacggacagcacaggggaatctttcctatgtgatcttcgggactgtgactcttgctgaagacacaggtgggcgagttccatcgttacaggccaggaaaggagttcaggggatttatgactgctaagcaaatgtcacacgtttttactccattagagatttacttaagttctttccagatgcagatatttattaggtagattgtggttctttgtggcaaaaattttccttctgtaatttctcaaatagccaaatgcttccaggatgaaccgtgtgggtgcctggaggaggggaaactggaagcagcagacaggtctataggatgggtgtgtgtcagggagtggggaaggtggggttgaagatccgggggcagttacgggatagggcttctgagtatgaaagtagccctgcaagaatattctatatagaatatagaattgagaagtgtctcccaatttaatcgaattttttccctcctggaggagaaaaggagaagaaattatctcagccttctcttacatttctactatctttgaagtagcatgccaaacccttttcctggatcttgaggactcgaatcctgaaatttcagatgctctcactaatgtaggaattgggttttgactggtgacagagaagaggggggaatatttggaatgtaggtctctttgggagagaacagaactcaccctttccctgtggcagcatgaaaacactgagcccctagaagcagaggggagacagcaacagagaactaaaaagggcagtgagtgaatgccagcgacaaattttattttgtaattttacttagaatgggcctgccactttcctgttttccaaaaccaggctaattgtcagacaactactcacttgaaataatacttattagaggttcttttgaatgaagatgcaaacagtgcccacattgtgtaagatggagttgttgcctataccttaatgttaagtgtcagaaaagcaatctgattaaagagatcagctgccctaaggaaatggggaatttgattagaattgtccagtgctttcttaaataactccactttgctgtgctagtgtttggctctggtgtgaggaagtgaattgagttctgcactgtgaatttaggagtcttcaggagggcattagaatgatttcttctccttcttccaccagttgattgcagaaatgtttgctctgtttttatatagttattatttatagttctttcttataattatttaacctgtgtactgaatgtcatgcggcacaatactactacttctttggaagtacttctgaggcaggaagtgtgatattagcatatatacacagttatagaatcagcatccccaatgcacttcctatcgtggctttgagttcataggtcctcaggaggtattctgtgagtgaatgactgaacagtgattgtgtctactgcccattaactttctttgaagtttgacatgatgttgtccctatgctctgttcttgtgtacacagttggttatcagtgggacctagtcatccactcatcacttaaaagttaaaggttggaacattgctcaagacaaaggttataggtttgttataggagaacaacccagttgctccttttaccacccctttccttgcaggatgagcagcagcaagagatggccgcttctgccgccttcatagaccggcattacgggcacctggtagacgccgtgctggtgaaggaggatctccagggtgcctacagccagctcaaagtggtcttagagaagctgagcaaggacactcactgggtacctgttagttgggtcaggtaactttatcccagaacatccaagctggacgggaccttgaagatcatctagtccagactccctcattttaccatcaaggaatctcaagcgcagagagggagagaattctccacaaattccatcatcgagaagagtataagtgggaagtcttgtttgttgttggtttttgtctgttgtttttcactgcacctctttggatcatgatttgaaaggggcatatcagaaaacaacacatttcatttattaaagtatcacaggcaagctgaccctgattctttgtaccaaagttaagtagccactgtcttttgtgggtggtagtggttaatttatacagtactgattcgcagaatgtttaagctttttaaacatagtgacgcttagtagtttttttggaagctaacttgttttatccaaggggattttacatgtaactgaagttcccctgtcttcaagcactaaaacgttgatcttaaccttttttttgaagtgcttgcctggtaatagaaaacgggttctctgcctattttaaaatagtgaatatacgtaaattttctctggaaggctgaggcacacttcaccatcaacatgaattactgtactatcctgtactgcagtggtgccttcagggactcgaggaatgtaaggttgcctttcccctttctaaataccctcagattcctaacatcgagcccatgctttgtttgatttgttctattccatccattgtcccttttgttactgacagttgccttggtcctagccagtccctgccatgagatcataggggttcccattgtgctagatcttgggaaaccagatgactctccctgtcaaaactatggctacgtcactgtaaaccatttctgtcaagaataaaagtatgtagacccagagtgtgggcctaatgggttgtctctgagcaaaaatgattatcacccaggattcatgatatatcttaggtgctcagagaatttttttttattattaatagccagcaacagtctttattctgtgctggatgctatgctaaggcctttacatacattaccctgataaatacaccaagccaataaggtaggattcttatcatctcattgtacaaacgagaaaaaaaataaagcttagacagtttaaataatgtgcccaagcttgcacagatttaaaaaaaaaattgcaggccaggcactgtagtgcatgcctataatcctagcactttgggaggccaaggtgggtggattgcttgagttcaggagttcgagaccagtctgggcaatgtgtcaaaaccccatttctacaaaaaatacaaaaactagccgggcatggtggtgtgttcttgtagtcccagctactcaggaggctgaggtgggatgaacgaggaggttgaggctgcagtgagccatgattacaccactgcactccagcctgggtgacagagtgagaccctgcctcaaaaaattttaaaaattaaaaaatgcagagctatggtatttgagcctaaatcgcccaaataccagagatgatcgttaaccactatactatactgcctcattcttttgtggtcccataatcgaggctactcactaatataattcacttataaatgatgaatgtgtttacagctagaatttataatatgaagtgtgaccataacttctaagactgaaaagaggctacatacacgtgtacattttcaacttcttttactcatgaaaggaaaaggaggccaagttgaaggtgaagcaccagggagaaggtttgccacccatttagaaatttccattttaccttctacacaaggatacctttgcaacgctctagctcatgaactggtaggtccacgtaacaggatcacattcttcagaactttctagtaaaaagatggggacttctttacacttagagagtattggattcttatcaagtgaaattggtcttgagctgatctacagagagccaggccagggagggcagctgcccctgaagtgtgaccagcacatgcaaagttgttatgcaggataatgcctgtaatcctagcactttgggaggctgaggcagtggatcacttgaggtcaggagtttgagaccagcctggccaaaatggtgaaaccccgtctctactaaaaaaaaaaaaaaaaaaaaaaaaaaaattagctgggcatggtggcgggtgcctgtaatcccagctacttgggaggctgaggcaggagaatcacttaaacctgggaggcagaggttgcagtgagccgagaccgtgccactgcactccagcctgggtgacaaatgagactctgtctcaaaaaaaaagttgttatgcaggagagctgggatctgaagtctgctcacaggcaaaagcaaaacaaacccacatacgttaaaaattacttttgaagatcccctcaggaggcatcatggtggacatcctaatcaagtctcaaagccccatgtaggtggttttccctccagtgtgggaacacagtggttgggcacccaatgatgttctttctgcattttataccactccacaggcattttctgctgcttacataatatttttacacaattgtcagattaaatgatggtaattctctttacatgtattatgaagcagagtattaaaaagtgatccttagccaagtgtggtgactcacgcctgtaatcccagcactttgggaggccgaggcaggaggatcacttgggctcaggagttcaagaccagcctgggcaacatagcaagaccttgtctctattaaacataaaattagagccagcagcattggctcacgcttgtaatcccagcactttgggaggctgaagtaggcagatcacttgaggccaggagtttgagaccagtctggccaatatggtgaaaccctgtctctactaaaaatacaaaaattagccaggcatg

SEQ ID NO: 15473 - DNA, 450395 bp, Human
  misc_feature (1)...(450395): n = A,T,C or G
ctacttccatgtcctcctttttctttagatttccagagcctgatgttcttgcatcagcagctgcagacatgtctgaatagtttggagcatgtgatgggggcattattttcattggcgtttcccaagtcccatgaggtcattcctcttgctccatttgagcactcctctggagatctgagaaactgacaaatgatgacagatgagatcagttcatcccattagaggctgggtccacgtagggaagttttcctggacttattcggaagcattcttccccagtacaattttaaaaagttagacccaggaatatttgttggacttttttgttcacatagaacattcatagttggttataaggaaacatatcttaattttttgtttctttgcctctttttaacatggaattgtcagtactaaagcaaagttctgttgctatctcaaaggcatcttttcctattattaaaattaggtggatttttgaataacctttgttaaacagtgttataaagctctgtctgctttataaactatttttaataaggattagttttttatctttgtgtaggaaatactttccagccctagtctttagttttaggtttgcaggcatcgacttggaaccatggggaggggaggagggatggctgattacggtggtggctcatgtaggaagtggtgacagtgtccctgcgtgtggaggtgagcgacgtgctaggcatctctccaaactgtgtgcttcatcttttattggaaactgtgcagtgccctgtgattacattaactgggaccagcagttattggacaggcaaggaggaggagaaaagggagttagataaaaacaggtgaatattggtagagacacaaggatgtattaaaatgtatatatgggagaataagaaagaacagaaagataatttgtggttacagtggtgagtctatttctttttcatggactcatctctttcccagtgccacttaatcttgataatactcccgcgaagtacttgctttacacattgagaaactgaaacacgggtttcaagaactgctaggagtgcccacctctaagatagttgagagagaatgcaaatccaggtcagctagagcactataggttaggatgtgggaatttacccagagctgaagagagactctccccgactcttagagacttatagtccattgggaaccaccacactgaaaggccacagagatgggtggtctagggccctctgtagttggagtgtgcttcaggaggatgaaatgttggcaaaggaggatcagaatgtgtagaagaggagaatggtgagtcccgtgtgtgctcgaagcctggtggtggttcatgggagggttggtgggagatgaggtgaggctgcacaggtggacggagagcagtaagaagaattcataggcggtggagactcactgagggctcggtgagtgaggatgggccatgaggaaagacgtgtgaggaagtgtagatgctgcggtgaggggagagagagttccttggtgctaaattgggagtgttctgcgggtttgtgatttctttctactccaattaaaagatgacacagggaggagcttctgagttaagtggatctatactgagtctcccactttcctacctactgggcaagttacttgatagcttagaggtggaaaataaagaatatttttagagagtagagtcagaagtcaatcagatgtggactgtcagtgctggaattctccttttctgtttttcctactgcaaatagcggtcctagtctattttcatggcagggaaagaaataggcttatgttcattagatgtaaataaaaagagtaggagatacacagttaggtcctactttgaagaaaaaggcagggaaagatagaccttgttcatttttaggaaccccagacccccttttgttttgattggtgttcagctgtgggatatgcatcctgtaaacagaccaatgatgactttttttttttcactctcccagtgacagaaaaagaatgtctgtaattgttcgaactccttcaggacgacttcggctttactgtaaaggggctgtaagtaccggagaagcgttgtgcgtagcggagttcttggcagctttgttaatctgccgcttttcctaactgctttcctcatcattccctgattgtttgtccagagttgaaagactgtttcaggtaggctgtgaagttgacttagtagtaaaagcccactgaagataatggtggttcagggcagtgtggcaaagatggtcagtgaaaagcttactgaaatcgttggtttcagaaacagtgactccacgtgtcatgcaaaatccttgaatgggaattcttattccagttttaccagcattgtgttttgactttgggaagacaaagtaatttgtgttgacctatgataatcttgagtattctgatatatattggttctctagcacctcttcttctcaattgttatgtttttttctcatacattatagagagacgtgttttaggtacaaaggcaatgtccatgtgtagctgcattattactgccccttttagtcagtttcctaggtcaggctttttgtcctgtataccttctagtaaccaaatctaaatggtttatctcaaaggaaagatgttattgcttatgagtcttacttatagaactagatcctgttaaattttagtcttatgtatcgagggaaagaattattaaacttattttatttgactatgtcaagaatacagagctctcctaggattaattagtggttgacagtattactaatctttaccagttgtggcaagaagggtggttttatttgagtacacgatgagtagagctttttacaaatgaaggaatgcatgggaattctaaaggcattatatttggactcgctaaagaattctgtgtttatggtaaaatgacttcaattaagctcatctaggttttgttctcatatgatatatttttgaaactttttgtttattcatttgccattgtgttctaagtaccacatcgagtacaacaggtgtcagtgtgaggtggtagagagaggagggctgtcagtatagaagaggtacatacgaaaatgttgcaaaggtgtgttgtatttttataggatttaattctctccaaaaccaaactcagtttaaaaaaatttttgtaatagcctaaaactatgcaatttgtaacacatttgatggattatctgtgggatctggtcccccaacccttcttgtcagtcatggaaatagtcataggcagatgggctgtgcacctgtgtgtttcttggcagaactgagttcagcgcccaatgggttgtgccctctgtgcttaggagctcctcccgtattgggaggcaggattgtacttgagtaatttgggatgtgcattttaccctttctccttctgcgcaaacgcctgataaactttgggatatgagttttgcaaattttggtgaatataggcccccatgtattccaatgattctcctgtatttctggttctccccagcatatttttgtttggcttttaagataacagattttggttttgttggacacattcatacccaatttgttttccaaagctcatgcctgagcccagccaaatgctaaattcctacttacccactcgggtattctcatgcatgttagataaacagaaacaaagccatgcttagtatgctggctggaaggtttactgaaggctttgccagtcacaatgtttccctattttataggataatgtgatttttgagagactttcaaaagactcaaaatatatggaggaaacattatgccatctggaatactttgccacggaaggtaagtggaatttggaaatgctgtttttggccattggagctgtactttcaagcatgttgtcttgatttccaggggcacattcttccagtgcctgccccatcccctcctgtgcccatggcagtgacaagatgcatagccaaatccaaactcatttacctgtagatgcctctgtcactcatcagcagtggtgcagagggagagacaggccaacgcacaacgtgtagaatcacctttagttactagtccctttctcagaaaactcatatggttattttcctgtccctctcttggtgtccttatgtcactggcttatccatgacttaaggaaataataattcatggaacccatagtgagcaggaaaggagttctctggaaggctataaacaacactgatgtcaggtgttcctgctagcgaatgtcatgatagctggagccacactcaagtgctaactgctgctttctggcctctggctctgcgtgcatgcacatatgagcacatgctcacacacacgcatgggtgtggctgcctgaaagcctggatctttcatgggatagcacgtggggcctttccttgctgtcttgaaacacacttcccacctcctctgcttgctgaaacctgtttactgcacatggatcatgcacagctcccgaacctctctgccatggagaattcactcttctgacttctcgcgcactctcagccttacggaagaggtagtttatgttagaatacaggagagctgtttttaaaggtcccttggtagatgtgggagtgttgaattagagtgacctaaagcacagagtctcttcaatttttttgggcatgctgatggaaaagggagcacaggctgtcccctaggaggtcacgcgttctgcctgcctccattcaccagtggctgtcttgcaggcttgcggactctctgtgtggcttatgctgatctctctgagaatgagtatgaggagtggctgaaagtctatcaggaagccagcaccatattgaaggacagagctcaacggttggaagagtgttacgagatcattgagaaggtaaccgcacacaatacagtcttttcagctccatgaaggacttaaccacctatttcacaaagtatttgaacaggaatccttttactatgtagggatgttctcttttcttgtgtcttaatgaaccgttagctctgaatcattttctttgctttaagaagcacttaattttcatggtctttctgaaagctctagccaccctcagctaaacattaatgatagcttaagaaatatcaggtcaaaaacagcatcagcgactttctgggtttgcttaagattaggcttaatgagattaactcacgctgttgagttacaggagcaatcagaatgctgtggaggctggttagatgttgtacatgctaagctttctcgcactaacttattctaatgatatttaaactttgccgttgctactccacattgcctactttgattttgttgttgttgttattcttttcagtttatcctaaggctttagctcactttcaatttattggtttccttcaagtgtgggagctgggtttcagctttttctgtctcatgttggcagccatagggccatccaatttccagtttctataacttttttttttaaatatagagacagggtttccctctgttacccaggacccaggctagaatgtaatggtgcagccataggtcactgcagcctcaaactcctgggttcaagctaacctcctacttcagccttctgaatagctgggactacagtctcatgctaccatgactggctaagtttcatattttttgtagagattgggtcttgctatgtttcccaggctggtctcaaactcctgggctcaagcagtcctcatgccttggcttcccaaatcccaaagtactgggattacaggtgtgagccaccatgtctggcccagtttccataactttgaaaccatcacttatttactgttttcattcctttgttggtttaaaaaaattctcctctgcttttttttactcagtttttttgtttaagttttatattcagttatttatattcagtcattttaatgtactgaattaaaatgaactgaataaatctgaattcaggtgtttatttgccctgttttactggaaatagccaaaattatttttagaattagaaaaaggtgattaaataggtgatgtgcctgtggtggatgctcaagagttggatcttcccacagtctgtgaccaagtagaggtgctatgtcctggagagacttggggatgtgagtacatggagcaggccgtttgtacagtctctggaatttgcccgaccagcaggcacagtgcgggcagctggagggaaccaaacatccacacccatcctcagcatgagctgatctgccctgggcctttaagaggaccaaaaggggcaacattttatagctaccctcaatcttaagatacttggattttttttctctcactgttaaatccttagcaccacaggtctcttactcctattttgccaggtaagtgtattatctagaattagttctcctcctttgttaaatgtgacataatatgctactcattagtggactgagaggaagggctcaggtactgtcagtgtcctcgggataacctgcccatctgctctgctgccagatggcttctattctaacaagcccctgtatcaagaaatcagtgatgagtactgggctgcctgtgtgtgtagagtgagtccaccattgcaaggcatttggaaatgccatccatccagatgccatctgtagacacaagtataaaatagaggaaatagaacaactgtctcagaaccgtttgattgcctttctttgtcagaatttgttagtgctgttcttaagtatgtgccaatctttaactgaggatattttttcaatctagaatttgctgctacttggagccacagccatagaagatcgccttcaagcaggagttccagaaaccatcgcaacactgttgaaggcagaaattaaaatatgggtgttgacaggagacaaacaagaaactgcgattaatataggtaattatttttacaaataatttcctgatgctgggttttgtatttgtttttcaagtatcttttaaatgtgtctaaatgtttctcaaattcattgacagatgatgttttataggaatcttcattcacaaggctaaggaaaattgacctaaatcaaatgaagatgccttcatgcctgttacaaacattaaaactatcatagttcctggaaaagaattagacacacttacatagggcatagaattcaagatttgacagctttgattttcttattgctttcttcacaaaattttagtctgagactaagagagcatgtttttactaggtttaaatatgcgttattattttatgtaattataaccattttaatggttttgcccattaatgggcttttctaagagccttgcatctttcccttcccagcttgttgacaacttccttgactgcagagcatcacagagatgaaaattgaagaaaaggaatttaagtcaggataactctgccgttgttaaaggagcacgttttaagtttgaaaaggagttgaagctactcattttttaaaaatctaatcttgattatttgaaacatttaaacactatctggtactttgatcagcattatggtgtaacaagacctggtgcatatgtggtaaaatgaacactgcataacttagaatagcttgctagaagtagactctatttctatatctgtttctatgtcagtgctctgtgttttaggaagaaacctgctagagcctttgtatttaagtgactatagtcctcttcagagtagtcttcttggaatattctcaacataatccaatggtgtccctttcctgaaaaccttatctttgaatcagctttgtctctcatgtaacctcagttgtaaataatacctgccttcttggataaatttgatttaaaaaaatagacaaaagccatgtaatcatttcttgtcagggatatagctaattaaatggaagttgggctcccaaacaacggaagttaagctcacaagagagtaacataggattcataaacagtccctgaagaatcagccatagactttgtccctggatttgtgctggttgtcattcagatgcatggttttggagaacagtatgatggtattttagtgcagaatcatcactgctactagaaaatacaaacccaagcttacagccctttgatgatgtgtcagtagcatttttacaaatgaagaataacacatttgctttttgtatgctatatttctgtataagtatatacattgaccctttatgtgttatttttcatataagtttggcctaaaacacctgctatggatactgtggcccctgttgtttgcatgctaagttgactgttaccctgaaatacttacctaaaatttaggtgatatgctttccaccctattagagcaatgtgaaaaaagtggataacccctcaagttaaaattgagctgtaaagtggtaacctttcttagttttccagatcttgagcgttcccgctggcctaataacctatgcgtgtcactggccctagactgaactaccttcagtgtgttcttggatgtgccctggctggaaaagcaccacagctccctctcactgcctctcatccacaccgcccggcccctgggagcacacgcagccctttttcgtgtgtgttcattttattatacctgagcctatctagctaagtttgggataaacacaagagaaagcaaagtgctgaaaatcaacccagaaaacacaaatggattattactcaaaaacgaaagttttacttgtatgtgatgaggctgctctgagccttatgagataattgatacctgtccaaacaattttttaaaaataacgattgtattattttgtactttttttctaagtgggtgtagtaacgtgtagtgctcatgccagaaccgctcacatcatttgctatctcttaattgatctttcttagcaagtactctccaagaccgctagaagatgatgctttataagctgaggactttttgtcaaagtcttatgtttatcctggaggctttctctattcacattttatctagtgtatcagtcagattcaaacacatcttgggtgttactaagtaagcttctaacagctagacaattgatttctttgagagagctatgtctgaattgtttcttcacttcacctttggaactgaagcttgtagccttgggtgacgccgagaatttaaatgtcgtcttgtgatttaaagtatctgtcaagcctacaaatgatgcagaaggctcaggaaagcatatacgtccggacattttattagacttttcagtgtgggaccacaggcggcagctgtcagcagcatgaggtcatgctctagatacagagtgggtttctaagcctgttttctagtcatatagccctcatacccctggtagtatgaaccattatggacctgtctcccataatactttacattttcatgcatcctgtgtggattttaaggtatccagaagatatttgggaagatcaagtatctagcagttctccttctagatgaaaaaagggaagcagagcaagtaaatggagtgtctggcaagtgccaggcactatactaggagtgttttctgaaaactctttttttaatatttacatatgaacattcttatagctcgaggaggaaattctacatttcccagggctataccctacttaatgaccaaactggtactaggtctcagggctcttgacttctggtgtggggcttatttagagggattcacatagcttttgcaaaaaatgctttctgaaatttgatttagaagaccacggagaatggtactacatttcatccattccaaggtgcacattgtttttacattttaatgtctctgaaatggggatgtcgtatagttgttgactcttagcttttaattgtcagcattatcttagtggtatgtaccataagagttcatctttagatttggtgacattaattatctttggtgtttggaggtgttggctctttttagagtttggttttttaaaatatatatatctatctcgtagtttgagaatttatttttaaagtttaactttttattcataccttagaaaaaaaacacacagtcaaatcaagttccaagacatgtgtgtctcctgtgagccagtgaattgtatgtagatagacaatcatcttgtgtataggttttagtagtttgaaattggcatgttgccagaatcctgcaacactgtgcttgaatttatgctaactagctgtgttttgaggagttggcgattttctcttttagcttaaaaatttggcatcagctggtctaaagtgaaatttcagatgtagcccttgtgaatttcgtagtggtcatttccttattaccactgaataaaacgtctattaaatagttatgcaatagatgtggagttttcgcagtctgtaattttttttaatggatgtaggatgagtgagaacaaaatcctagtgtgtattccattttaaagtaattaagttggcattagctttcctcttaaaccatttctgaattgaaatttaaagtctttcccccaccctccctgcattttgttacccatcatttgatacttttaaaaccatttcttatggtcttagaggtttattttttaaattttaatacattttattgtgtataaggtaaacaatatgatgttatgagatacatatagattatctttgaagtttaattttaggaagtgactcaatatgtcacttgcccctcctgtaattgcctgtacattttcttgttcattaaaaggaaggcgagttgccattctcaggtgaagctgggctgtgagggtgacaacactggtgatgttctcaatcttactgctgtttttcacagaagattcagtcctgtatttcttgattacctgcagctaacattgccaggtgctccactataagcttgggcaacttacattccacacttggggcatgagttaattatgagacaaatcagagaatgaaacagatgaggaagtaccaattgtgcagtgtagatgttaattatgactggcttttgtaatagttactagcaaatgttatctattatgtgcccgatactgcactaagtcctttacagatgttttatatttaattcccttggagaatttaaaaggcattatccccttttaaagataaaactgaggcacagagagatgaagtaacttagtctaggtcatacagatgtgagaaagctgaaaatctgagcacttaaccacaacacacagtgttcatttctcagaaggaacaatatgagttgtaaaggaccagggaagtcttcctggatgagaggagtttaaaacttgagccttcagagtttgtttaaaacaaaaatgactgagaatagaatgggtcaggatgtcccaacgtggggagaagccgtgaggtgaggttgagggagcatgttcttctgtgtggcgagggttcctgagaagggcctgaagggtctcaagggagaggtgcccaggcgtgtgctccagggacaaggcctcagctccctggttctctggatgatgaggggctctggacgggctgtctttgatcccacctgggatagcttaaaagaccgtcttttgtcatgcattcttgttgtctgccagtgtttttcatacaggcaaacactgactgaccagattctctgtaaagctattgagaaccagtaacatgctcactgcgggttggtaccatgttgaatcctgtgatgggtagcttggtggatgtgatctcaggatatatggtgtggaaggatacattgttcctgactttttcaaaaatgtctccagagaaatctggatttgatatcaaaaccagtgttctccttttttaaggaggaaacaggttgagagagctgacagatttggtttagtaatattttctagtgtgaagcattatcttgtattaaaatcaagtcctgccgtaagtaccatagactatataatattttggtttctttgaatgttgattatactcaggtagtagaaagactaaacccttttgtagtatactgttaatttcaactatagtaaaaaatgaaatcccagaggttctcctctcagtcattttatggccgtcttgttagattgcgagattaaagaagtagacctcaatttacaagtttggattgacattctatacctggctcttctccaagagttgatctcattttatccaaaaacattagaaatcaagcacaccaaatgtggattgacacaataaataatttgctacattagttaagccacaattaactgggttaaacttccctggtctgtctagtgcgagtgctccaactgataattctctaaacaaaatctcacttccgtatccaaactaaaaacagcaacaacaaaacccttaacctgtttcttctcagaagcctttagttttgtatatttaaattcatgaaagtgtcagtagtttttttttctctctccccctgccatggctagaaaaaaaaagactgagtttttccataatatctttgtgtagcttcagttgtcaaatggcattttgcttaaattgaaaaatataaaataaagcagcaagcgagggcttaaaaattacagccagcttctgcagctgttgttgaagtaaaaaactaccagtaaatccttttgcattagttacactaaatttgtaacagtctatattgcatgaagttgctgaaagtctctggggatgaagaaagaataaatctaacatagagggaaatgattaaagttgcaatatccctctttgcaagtgaaaagaaaatgtagatctcccttctggacctaatctaaggacttataggaaggaagaatgcatttgtaaaattttaatgggaaacaaagagtttgattattctagtcctaccaggcagagcttttaatggcattttgagagggtctcagttttatccatcactgttgttaaaatacagacttgaactagtttgtaaatgtatagaaaattgcttcttgttcccccctcctttttttttgttttagagatgtaacaggtatttgcccatgtggtattgtgatttaaaattattcagtttgttttggctttaaaaacaatatgtgtttgttttaacaagagaaataatctgattcccttgagataactgttgttaacagccttgcctatgtctttttcatattgccttaaaaaattaacatttggatgaaaagccataattttgcgctttaaaatttgatcttggaggtgctttacaaaatgttctacatggcggtccttaggaaggatgtactttctgaaatacacaaacgaaatttttttactgtttccttcaaccccttcattcccccaaaaacccacaacatggtttttcttggtcttaatttttgtctatcttgaatttcattttgtacctgttaggaggatttctcagggatgaaaagggaacctgctagtaggtctgagcacataaatgcagcagttctgctccttgtcccttaggtaaatgccgtcttctttgctagccacgtgtagcatctgtgagaaggatgtcttcttccctgtcctgtgaggagaatccttactcctccccctggctgtaggaacagtactggccaagccctcccttgagattgtcacctgcttagttgaaggctgttgattgatttcccttttctataatccttaatccattatcttaaggtgctgagacaaaactagttgtgggggccaatattctgtggagaaggatttttttcttgccttttctcaatgagagagattgagttgggcgttggtggaaagcacaagtcgtcgctaaccccccaaggcactgagaggatggcaaggtgatctgagagacaggccagtgccctggcggacacctctggtcttggagttgcgagagccctctcctcgccaccgagggtgtggattggaggggaggcatcctgagaggcgctcggcttggtccatgactgctcacccagggcaaagtatgagtaggaaagagcccagggcttcctagaaaatagttctcctgctgggagggaaagagaaaatactatctcgcttaacccatagagataactttactgaaaaatgagaaggaaattgttaagaactaggagtactttcgttccaaataagcctttaaaaaaaaaagcctttttaaaataacaaccaaagaaagatttttttgaaatgtggattactttaaatttttcacaggaaaagtgactccctcagtgtattcctttgaaacctgttgtgagaatcagctgctgtcttaaaggaagggagggagctagctatcccagtgggtgtgtgtgtgctgatttaggggcaccattggggtccactgccttcctgaagtgttcactgttactttagacgatccaaggcttatcttaatgttatacaaggataacagagataaagaaaaatccactaaaaattgggaagtatttattttagcctttagttataaagacattcccaactagttctattcaatctgtacaagaatcaaaatcaacttacttttcctactcctcactgttaccctattcctctgtgtgagccaataggcttaaagtggcagatataaccaaggaggttgaatttaaggagctcacagaaggaaagagaaattcacatgttgtctcttcctccacttcagggtattcctgccgattggtatcgcagaatatggcccttatcctattgaaggaggactctttggatgtaagtagtttttcaaagttgtatttgctttgctataacagtattaaactctttctttctactatcattgataatcagggatcatgttttgctaaaaaacagttatgaaaaaactgtgtttattttctgtttatatttatatttaagaatggatgtcagaaagccttatctttaaacatcaaaacagtaagcttagaatattgcctcatgataatacttttattcatctagaattgtgcatttaaaatgggatagttttaatctgatttagctttaatcattaagtatgaaatattagtggaacctattatgacctacattaaatggtgatggttaatttcactataagttactaaggagacatgtatgattttctttctagcacaaactttagaataaaactaatattcaagtgttaagcattgtttaaatttatatagtgaggccaggtgcagtggctcatgcctgtaatcccagcattttgggaggcggaggcagaaggatcgctttaaccaaggagttccagaccagcctaagcaacacagcaggacctcatctctacaaaaaatggaaaaattggccagccgtggtggcatatgcctgtagtcccagctgcttgggaggctgaggctggagaattgattgagcctgggatgtggatgctacagtgagccgtgatcgtgccactgctttccaacctgggtgacagagtgagactctgtcttgaaataataataatacattcgtatagtaataggatacatgtatacttaattctctgatgtcccaatgctgccgcatgaacccaccccatcatggcataaagccactgaacagaccagcagtgggagctgatttgagggtcaccagcaacctgtgaagtggtttgatatgaaaatatgagctgaacaatgagattccacttgtcagaacttttaacaagggctttgttactggcaggcacccatagcaccctttcaggcagtatatttaatatttatatttagccaatgccaggggcagatggcacggttaattactcttttaaagggaggcaataaagtacagagctttctatacttgcaaattgagagggccataactcctatcgtgaacaccaggatactctctaccccttcatgagaccaagggcaggaggcagggggagagtccgtagttctgtatgtttccaaggcaccactggcaagagaccaccctctggcgtgagtgcttcagaattcatctcggtacacctcctatccttgttcatgttactgcctgcaggcagcccagagtcccaggtcatacctcatctcctggagtctaattctcacatgctctgaggaaatctctcctctacccaagtgtttcagtcttccccctctcacacgtctttatttttctccatggaacctctcatcattggaaatactatgtgtgtgtgtgtgtgtgtgtgtgtgtaaattgttgtgaaatacatcatttaagtgtacagttcagtggcattaagtatattcatattgttgtgtaaccatcaccactatccatccacagaactcttttcatcttcccaaaccaaaattctgtgcccctttgaacaactactctccattcccacacctacctcatcccctggcagtcattctgctttgtgtctctatgaatttcacagctgtaagtacctcgtgtaagttcaatcatatagtatttgtgatttttatgactagctcatttcatgtaacataatgtcttcaaggttcatccatatcggaccatgtgtcagaatttcgctcctttttaaggctgattaatattccattgcatgcctatactacattttgttgattcattaatccatcagtggacagttgagtagcttataacttttttttttttttttttttgagacgaagtctcactctcttgccaggttggagtgctgtgccaaacgaggctcaccgcaacctccaattccttggttcaagtgattcacctgcctcagcctcctgagtagctgggattacaggcatgcgccaccatgcctggctaatttttgtatttttagtagagatggagtttcaccatgttggccaggatggtctcaatccaacttttgactattgtgaatagtgctgctataaatgtggatatacaaatatctttttgagatcctgcttctaatttttggggacatatacccagaagtggagttgctgaatcatatggtaattttacatttcactttttgaggaacagccatactgtttttttacagcagctgcatcgttttatatggtttgtgatttttccatattcttgccaacactggtttttttttttttaatagtagccactctaatgggtttgagagtggtatctcattggagttttgatttgtatttccctaattattagtgacaatggacatctttacatgtgccttttggtcatttgtatatcttctatggagaaatgtctattcaatcctttgcccattttttaatcaggtttttttttcagtgttatgacataatttgtattttttctacctccctttagtcccttagactgtaaggtccatggttaaaaacctgtttaaaaaaactgggcatctccaccttcaagaccttgctttgcacatattatgcactcagtaaatgtttgaatgaatgaacaagcttaagataattttctagtcatcaataagaatttctatttaaaagtcatgctgatgagatagtggctacagtagccatgaggggctgagtacaagttgatgttactaagaagtagaaaatgagtaagccaaaacagcgcatcggtggacaggagagcagagtgctcctgcagaaaggctcctagaacccttggatgtgtgcacataccttatgaacacacccacagtgtctgtacttgaggcttcctttttttctgatgattttctggttcaaaggtatctctaaccttgaaaaaagcctcctttttctggaggtaactcagaaatgagcctctgttttccccttatatcagatgttttctggagtccaagagatgaactttaactctacatacacattgagacttctggtttacctagaccaaagagtggtttgtgacgccaaactgagaagggttttatgggtgttttcctgacttgccttggtttaaccttctaagaatgattctttcttaactaattttgaacttcatcttttagtataatgactgtaatttattcagtatctactgagcagaggtgcactttctatgtactgtttttgttcattattcaaaaggacactccatatttctgactagtgtctactgaggaagattctactccttccttgccttctcctccctctcatgctttagttgggttaaaaccattcctattcttattaaaatcgtatttggtggtggggagggggataaaagcagcgtcctagcgcaataaagtagatatacagtagagctttggtggagctcccaggttgagtttttaagtctcagggctccaataacaatgcagatgggacagggacacagaaaatggcccaacaattagaagcatttggcctggcttctctttatttcatctctcatataagtgtgaggggatccacacctggcccctatcagtttcatcagaccagtaagtatggccaggttcggactccaaatgctgtaaacaattaggatttatctctgtgttttgagtttgtcatatgctgccaaaataacttctaagctccataatatagatgagatcagtggtctttgaacaaggtggagtgatggtgtgcaccccagggggacactagatgatatattaaaatgctggaaaaaaagttgtggtttcctattttttcagttaaaaaagtactgagagattagctttattgataatacgtaaggattgccactggcatcctcaattttttttcctggcacactgaccagaaattggtctgagaggaatgggtaggaggagggaggcatggcgtttcaagtgagaaaggttgttactgagactctcactctttgatttgcttttagccaattgtgaaatattgccattcatgtgtattggttaaatggacttgtggactagagttagttttcattaaaatgactctcacagatgctgacttaatagaattcctgttaaaaaaataagtgaattgaggataacaacattgtaagcagaagctgcaataatttgccttgctcaatgtgtgtgctagttccagctcttctcagctacttgatagttaaaacagtgatctgatctgacagacacagcaaatttcaaaattattcacaagattattataattaaccataaactttgtcctaaatgtatatggtatcttgaaatattagctgtggtaacatgaaattgtaggaattaatgagattttaaaaactaagaatcttgagtaagagaataaaaatctacaactttaccagcaatttattttttaaagaatgtagtaatctaatcatttactctaaaatttcacaaaatctactgcaaattcgtgaatgataaatgtctttgatatttgttagtaaaggacaaaaagtgctgagttacttggagagcatttggttttcctgctgcaataatatagagaacgcagtgtagcaataattaagttgaatatgggtggaagacctatacaaaaccttgccaggatttatatgtgtgtgtgtgtatttaaaaaattttttatttctataggttattagtgaacaggtggtatttggttacatgagtcagttctttagcggtggttcgtgagattttggtgcacccatcacccgagcagtatacactgaacccgatttgtagccttttatcccttcccaccctttcccccaagtccccaaagtccatcgtgtcattcttatgcctttgcatcctcatagcttagctctcacttatgagtgagcacatacgatgtttggttttccattcctgagttacttcacttggaataatagtctccaatctcatccaggtcactgtgggaatgtaaactagtacaaccactatggaaaacagtgtggagtgtccttaaagaactaaaagtagaactaccatttgatccaggaatcccagtactgggtatctacccagaggaaaagaagtcattgtacaaaaaagatacttgcacacacatgtttatagcagnnnnnnnnnnnnnnnnnnnnnnnnnnnnnnnnnnnnnnnnnntaattaaacaaattgtgaaacataagagatttactacatatttggataaaagtgtagtttctaacgtgtttcaacgtatggaataaaccaaaggttattgttattgagaggccatcaaaagaaagatgtactggcaaagatgtgtttgctcagagcaaagcattaattctttaacacaaaaggttttatgaaataagtatgtacagtcactgatggaatggctactgtggaatgaaaatggaatcagataaaattcattaatgatgcctgcggcagagactacattttccagcctctctgtggatgggtgtggccataagattaaattctcactggtggaatgtgagcagaagtgaggtgcgaccttgtgcattacccattgagaaggaaatctcttgccctggttcctcagcccttcccattttgctggctggaaatggtatgaggctggagctactttgggggctatttattggcaacatcagagttgctcccctcgattgggcccctggatgactttgggaaacagaatctgcagattccctctggaatgtttttttgagaaaaggttatatattttgaactgttgcataggtggtagtctctttgtttatcctcaccctactaatcgtacagaacctgatattaaaagtagggtcaatacatggtgctccagcatgacacagtgcagggctgtcctcagagagagaggaggagggtctgatgctgctggccaaggagagctaacaggatttgaaggtcaagggatttggattcattcaaaccaatacatgtgtcctcattcaggttcttaaggtcccactctttcccatcagcgccctaactttcatgaaagagacctggttagtctaggactacaacattcattgaattctacaacccacagaattaactttttaggctgcatatgtcgggctgctatgagagaagaggttctcttagtctgtcatagagactctcttgtcttctgactttgtcttgacctctgattttgcaattttcattctttaagcttcccagtgcagtgagaaagtggctgacctatccttaatcttgtattatttctgctctaatggtatatttcagtagctgcttgatctgccacagacttggctttaataggcagttgttacaaattgatcacaggtaatgattttaaatcagctctattgagatacagtttacatacctacaattaaatgtaccaattttaagtgtacatggtgatatattttgacaaatgtatataagcatgtaatcaccaccccatttaaaatattgaacatttacatgatctcaaaaagttccagccctccatatccccaggcaagcacgcggaccttctttctaacacaatggattaattgtgcttgcttagaatttcatatgaagactgtctttttgtctggcttctttcattcaacacaattattttgatattcatccatgttgctgtgtgtatcatctgttcattccttttttcgctgggtatttcattttatggatattccacaatttgtttattcgttcacctgttacaggacattttcattattttcagtttgaggttattatgaataaagctgctgtaagggttttgttctgtgcaagttttggtgaacatctgtttttgtttttcctgggtaaatagctaggagtaaaattcttagattagagggaagatatatgtttagctttataagaaattgccaaacaatttccattttacactcctgctagtattacctgcgagttttcatttttgcgtatcttcaccagtgtttggtactgtcagtcgttttaattttagccattctagtgggtgtgtattattgataatatctcattgtgactttaagttatatttccctgatgactaatcatgttgattttcttgtgcttattggtcatttaaaaatcttcctttgttgaagtctctgtcaaacttttgcccatttaaaaaaacatgttatatgctttttaaaattactgaattctaagagttttctgaatatataatttggatataaaccctgtttcatagatgtctgttgcaaattttttttttaccaatctttgtcttgcctatccattttcttaccagtgttagggaaaatagaccctaggctggcctccaataattcctgcctcctggtgtctacacctttgcctaattccctccccttgagtgtgtgtggaacctgtgacttgattttaaccagtagaatatggcaaaggtaatggaatgtcactcccttgcatgatataagagtccatcttagcagattggagtgagagacttttctccattgatggctttaataagtaactggctatgttgtgagaaggcctatggagagggccatgtggcaagaaattgcagacagcctctagtagctgagagtggccaagcctacagccagcaagaaaatggagacctcagtccgacaatcaccaagagatgaatcctgccaacaacctgaggaaggctggaaacaggtacttctccagtcaggccttgaggtgagactccagcttagccaacaccttgattacagcctcatgaggtcctaagcagcagatttagctaagctgtgcatggatttcttatgagaaattgagatgataaatatgtgtggtattctacgttgctaaatttctgttaatatgtttcataactatagaaaagcagtataaacaccttttgaagagccagaagttttttgtttttttttttaattttgttgaagtcaaaatttctttctcattttcttcttcttttgctgtgattagagctttggtgctctctaagagatatgtacttactctaggactgggaagagtgcctcttgtgtttacttccaggagttttgtagttttagcttgtaagtttaagtctgtgatccattattgtgcatggtatgaggtaaggattgaggtccagtttatatcccgtatagttatctagtgtttacagcatcatttgtgaaaaatactactacttcatcattgaaatacctgtgcttttgttggaaacctattgagcatatatgtgactcttcctcgaccctctaatttattgcatttgtgtatgtatccctctttgtgcccaattccacattgtcttcaatatgataactttataacaagtcttgagatcctccaactttattttttttaaagactgttttggtcgtttcaggacctttgcatttctgtatacattttagaatcaggctgtagattcctccagaaagcctattgggatttttatggagattttccgaaaatttatgtgtggatttaatgcaatttgacactttaatgggattgatatttgcattctatgaacgtgggatatctctcatttacttaggtctttaaaattactctcagcagtattttgtagttttcagtgtacaggacttgtgcacgtcaaatttgctttttctgattataatggctccttttgattcttccatttctcttcattgtatttatgcattccttttaatcctttaatattgttatgatagctcatttaaattcctcctctgctaattccacttctttgtcatttatgggtctgtttctatttgcttacttcttttgtttgttataggtcacatttttctgttattttgcatgtctagtaattttttttattgtatgatggttattttgtgattgagtgtctagattctgttgttttcttttaaagaatattgtgttttggcaggcagttacttgtgagtttatagtttactctagaactactgcagctttcctaccaagttataacctgttggtgctgctgcctaagaccccaagtgttccctatggtttttccactgtcagtgctggaacttaagtatcttccaatcatgcatgagccctgggaatttttttttttatcttacagcactgatagttgttcttttttcatatatatgagaaaaaatatatgtatctattttagggttttctttccccaaatttcatgtcatgtccctgtacatgtgcataaattagcatttgcttaaagagccaaggggacccttacagatgcttgagctctttctctgtgcagttccttctctcccatatgctgctttgcagctcctagccacccagcattctctaacattctttgtctcctcatagcagtgagaacatcatcctctgggttcctcttccctgaatcacaatttgggaagtacctctggttagaaagcttcagctgtcatcggctcacctcatgaacttctcttcttctgaggattgtcttcctgtgttgcctgttatccagtgtctgaaaacagtgtgtttcatacactttcccagttttctggctgtttataaatcttgtatactagttactttaccacgcctagaggcaaaatgtaagtaatcactctgcctctgtctttgataaatattaatttccagtttaaagacctgtatcacttgggtttttcttttgtaataatttattgcccctagtgtgtggccagttatctctgattttgagaattccagggaaacttagctggatcaggagaaaagaagaccagaatagtgcatctgtttcacctctgggttccagggacgaggcaggatgatgactgcaatggcaaggaaagccattgaatgatcacttcagtagctattttggtcctacttgccatggacagctaatatcttttttccactgatgattaggtcatcagtgccttcaaacccaagcaaaagaaataattaatgccagtttttcacctttggaatatttcttagaaccacttctgataccaactataggaacagtcagagttccatgcaggaaatggtgaccgtcaagttctgctcaggagataaaaaccacatctggtctctgaacagagtggtttcaatgttaagaattgttaattaagttatggagtttgctaactaggtaactaagagtacagtaagaaaactctagggcagggattggcaaagtacaaccctcaggagaaatctgacccaacatctcttcctgcaaataaagtttcattgaacacagacatccccaaggctaggttaaagaagtgattgtcaagggaattgcgagcagacaagaagcaaacaagaaggagcacatttctttctttgtctccagctttggagtctctcattctctctctgcccctctcctgctggcagggcctagagccacctgtgagtgaggagtgtggttggtagttcctactccagtagcataggctgaacacagaagggagcctggacagtgagagatgttaacagctggcacagaaatgaatttcaagtgtaaagatttaaaataggaaattaggtgcttgtgaaattattgggaaagtggaaggagcggaaggagcagaagccagcgagccctagagaggcttcaggtccatgccctgcagctttgttcccggagtcagagcactattgctgctacccaggagacctcagggagccactgccaacgtcctggcatccttacacccatgaagccaggtcgagatggtagaatgtggtctcttcatgctctctctcctctctgtcttcccaatcttaagcaaatgcatcttgttgatagaattcatgcagcatcttggtaagaaaggagtctaagaaatatggctttaagccttccagtctctgaaatacagggaagaacatggaagaagacagaaataaataccgaagccagcagataatatctagcaccagctcacctgtaggcaggaagtaggcatcaggaggacacgggatactacaagatcgcacggatgtggtctattccataaaagtcagacctttaacattcagtcgattcttcatggtactttgcagtgacaggtagagtgaccatgaacatctcgtggaccacacagaagttgactattttgtttctgttgttattctcatgacaaagaacagttgtccaggttaaagatgatgaaggatggcataagggtcaagacaacatctggggcgctaacagggtgaaactcctgctttctgtacttagaaaagtctttgccctatggtaaattctcatagtaagtcgtagttaactattttcaacttttcttttagaaaagtccagttttccaatttgatcttttctctgatgacaggtggttcgtggtaagcgatctacacatgtataatatgcataggcataatgtcatcatttgttgctttaagatgaatacgatgttttcatgtgggatatgatgaaggcttttttgggtttagagagaccactttgaaaagatatgtttagaaataattaaattgtttgttttgttttgttttgttgtttgtgttgttttttgagacggagtctcgttctgtcacccatgctggcgccatctcagctcactacaacctctgcctcctgggttcacgtgattctcctgcctcagcctctcaagtaggtgggactacaggcgcgctacaggcatgcaccaccaggcccggctaatttttgtttttagtagagacagggtttcaccatgttggccagttgctgtcgaactgaactcaagtgatccacccaccttggcctcccaaagtgctaggattacaggcgtgagccactgcgcccggccagaaatgcttgtattgttaacgtgattttttattacacaaaatgtgggtcacatattttaaacagaatactaagcagcctctccagtaacaaaagctcatggtccgttgagtgctttttcatgagtgcctagcactttatataaattatctctcttaaccctcttagcaactctgtaaggtcatgaaatattcttttttcaaggttattgctaaaatttttgatagaaactttctatttttttttcctaccatctgctaaaaaattcctgatactcttgcctacttggtaagattactttgtaattaaacttgcttatcaacattttttgtgtgtgtgaaggtagtaagattgtggtatactagaaatgttgcttgaacaatttttttctaatttgtttttaggcatgtccaattaataattcttttaatcctttgaaggcacttgcattttaaggtcagagagacaattataaaacattttttcttagggttctgtagtaagtgttattgaggaatgtcagcaggatgaggaaacagggctggcggggaggggagaagctgctgtgttgtgtaggtggtaaaggaaatgctctctaatgagatgactttggagccgacttgctgggagggaaccatggggctgtctggacaggagatggcacctcccactttgcctggagcagtctcaatttgcacctgttttcctggcatagatttaagactcccctttttactcccaaagtgccttggtttggagggtaaaattgtatgatcaccctgtatctggaggaattgtgcttcaggcagatggtccagcaaatgcagaggcaaaggccgatgctccccactgcatttgagcagtgtgtggctggaggggagagtgaagagggagccagagagacagcatgaactcatcctgtagcagtgtagagcattgttaggagattctgagtgaaatgggtgtcattggaatctgagaagagtgacatgatctgatttaccttttaaaaggatatctgggccaggcacagtggcttatgcctgtaatcccagcactttgggaggcagaggcgggcagatcatgaggtcaggagttcaagaccagcctggccaatatggtgaaatcctgtctcaactaaaaatacaaaaaaattagccaggcatgggggggtgtgcctgtagtcccaactacttgggaggctgaggcaaaagaattgcttgaacatgggaggtgaaggttgccgtgagccgagatcgtgccactgcactccagcctgggcaacagagtgagactccatctctaaataaataaataagtaaaagggtatctgttcttctttgtgtctctgtgtatttgactcctctaggtccctcatgtaatagtcttattgctctttgacttggtaatgaatactctaccattaaaaggagtcttggctaggcacggtggctcacgcctgtaatcccagcagtttgggaggccagagtggttgggtcgcttgagcccaggagttcaagagcagcttgggcaacatggtgaaaccctgtatctacaaaaaatacaaaaaaaatttagccagtgtggtggtgcttgcctgtagtctcagctacttgggaggctgaggtgggaggatggctttagcccaggtggcagaggctgcagtgagtcgagcctgggtgacagaatgagactctgtctcaaaaaaaaaaaaaaaaaattttaaaaagagtatctggctgctggagtgagcagagactaaagctgaagggaggcaaaggcatggaggcaggagcccacctagtagctggggatgctgatccaggcagaagatgatgggggtgttggagtggaggttgtggtattggtgatgggaggtggtgagattctgggcatatagtattttgatagtaaagctgacagggtttgctgatgtattggatgtgggatagaagaaggataagacccgaggggtttggatctgagcaattggaaggatcaggttgccatttctgagaagaggaagaccataggaggagcaggtaaggtgggggaataaggaatcttttttgggcattttaaggttgagataactcttagatatccttagggcagttgaatatgtgtgtttgggaaatcaggggaaaggtctattatggagaaaaatactgagtaatagtctgtgtagtgttttcaattctgtgaggctgaatcaggtcaccaggattgataagagatagcaaatctcaagaattcagctcttgtgggtggtggggtggggggtacttcattgtttaaaagtttgagagaggagaggcagcaaaggagatcaagaaaatatggccattgaggtaagtagagaagcaagagagtttgagaaaatatggacattgaggtaagtagagaagcaagagggtttggcattttggaaaccaactggaacaaagtctttcaagaagaagggaaggaactgctgtattaaatgctgctaatgggttcagtgaaatgaggtctgagaaataattattggatttagcagcgtggaggtcatgggtgacttgtcaggagctgtctggggcattatggagatgaatgcttgattggagtgagtgcaaggaattgggtggagaacaactggagaaaacaaaagaagtttacagtgagttttgctgaaacttcttgtaggtcttaggttagcatggtaatggatttccctatcatggtgagcaaattaatgggtaactttatttttccaaaatgtgtagtaaactatgatttttaaagtaattcaaccaataaaatgaatattctttcttttaacatttcctctgtttaattgaaagtggtagatatttgttattaatggtcttgaaataattatttgaatcagtcagaactttaaacttaatgtaccaagctctttataatctaagaatcttatttttgtttatgcttttcacaaaacaaaggtgggtagtattagtattcctgtattctactgtagctacataacaaatcattcccatccaatgggtttgtttttgatagatagtccatgtttgtgaaatctagcttttggaaggggtggaactcaaaagtccttgtccgtcttttgtgctaatggtactcttgaaagccccaactcacagagagagacaggcatgcatcatctgtcagggagcctgacaactcttgacttaccactgttggctttctaagtgaagaaaatcagtaattacatggtgcatcataaaggtatatcatgaaaaatgttgaatgtcaacagcgatgatggttcttaagctgagataacaacctactttgttgtgacaatggagtctcagggtattgtaagagaaaaattattatatgaaaggctaacatctgtcaagttccttcgtcagtgaactttattctgtggtcaaatttctaagcatagttcttcctatataaggtaacttatgtagacctggacatgttttatttggaatgacttccatgatgtgtctaagacagaacctttgatgtagttcacttgattaatgggattatagccatcaagctttgttctgaggataattnnnnnnnnnnnnnnnnnnnnnnnnnnnnnnnnnnnnnnnnnnnnngcaatctaatagttttaaacctcatttgcccacatttaaaattacccaattcatttaatgttgaaaaatatatattaatgaggaaaaagaaaaatgaaaaatgttctctgggtagacttccattacccagagaactggaataagtagaagtatatagtttatataaatttttggctcttttaattcactaataatacaataaccttgtgtgtatgtagtgtatatacatatatgcctgtgtgtatattggtagccattttttaaaaaatgcaactactcacaatagatattcatgttaacctagttttttctctcgtagctgagattgtatctctagatcaactaatatgtagctgcagctcggttttagagaactatgtagataacattttgtatatttctgtgatttatttaaaccttctcttacttttggacattgaggttgtttctaacctttaatgtctaggaaaagatctcattttgttttctactgtttattttgttagaataaattcctagaaggctcctaggtcaagagaaatatgccttcttgagtggaggtaatctatattcacacacacttaacacacatatgtacatataaatccatatactccttcttgccctccaagtaaattctgccagtttaattgtaatttatttactagggaatgaaaagagcttaccacagttctgcacgggtaatataaatgttggaaatgtgggtattttctcagtgttgtttgtggaattaaaatcctctgaaatgaggttgcatttaatatgttctaaatttgaggctatcatagcaaaaatgatatcttaatagatggctgcatagctcataacctgaaacactgatgaactttccatttacatagctgtctcctgcctttcctatttgatgtgccataggaggtgaaccatgaaaggtagtagctgttgctgacactgcttctgtttgaatgattattttcttttaaattttccaatcttaattgtacgatttaagaacatgttgaagaagaatgattcattggcaggtaaaaactaaagcctactctataagttggaacatggttattatttcttagagattagctctctactctgctttcaatagggaagttcttgacttattaaattgccagtctccttcatccagctgaatggtctagttcttctacttaaatttaaattataagcctactggaaagtatttttgtccaactgagcatattcatttcgttattcaggtacttttgccccttattaccaggaaattaaatgtaaaaatagtgtgaaacaaaatgattggtatacttaaacacccccagacacccatccacccacacattttctatagagggttaatgagaagtgaaaatgtttttctgtgctatccattgtaatagttgctagtcacatgtggttattaatcacttgaaacataactagtttggttgaggaactatcaattttaagtaatttaaattttaatagccacatgtgactagtggctactgtacaaggcagcagagtgtagataattttcaagggtccccgacccccagggcacgaaacagtactggtccatggcctgttaggaactgggccacacagcaggaggtgagtggcaggcgagctcccatttaccacgtgagctccacctcctgtcagatcagcagtggcattagattctcacaggaatgggaaccctattgtaaactgggcatgtgagggatctaggttacatgctccttatgaaaatttaactaatgcccgatgatctgaggtggaacagtttcatcttgaaaccatcccccacaacctgtgttaaaattatcttccacaaaacgggtccctggtgccaaaacagttggggactgctgccctaggacaagggctggccagctctggcgagtgcgacaaatccagctcaccacttgtttttataaataaagttttattgaaacacagccatgcacactgatgtactgtcaatgatcacttcaatgctacaaaggcagagttgagtacagatgcccctcgactcatattgggtttacttctggataaacccattgtaagttataagttgaaaataacgtttagtactctgataaaccgattgttaagtcaaaaaatcgtaagttaaaccatcaaagtcagtgaccatctgtagttgcaacacaaaccgcatggcccacaaattgtaacatatttactatctggttctttaccaaaagtttagtgaccccctgccctgtgtaatcagatggaaactgactcaattccagttccattgccagctgtagctatatttctgaaacagtgtttttaaaaatgttaacaagcatttttgggagaattggatctatggctaatttgagaagatgcagagttgtaaataatgaagtagattcatctactacactttttacacaatctttaatccccttatttcactataaatcatgcagaggtttattatatagaatattttgttaaccaaatttatttgaccagtgattttcttttttggtaactcttgttataagggacacagacttagaaatgctgctttttaaaaatagtgagttttcctcttaatagatgatagtaaaataagaagcatgtgaaagagaatcctcagagtaggacaaaggagaaacggattgaattagtctattttgtgttgctataaagggaatacctgtgcttgggtaatttataagccaaagaggcttatttggcttatggttctgggactatacaagaagcatggcaccagcatcaacttggcttttggtgaaggcttttgtgctgtgtaaaaacctgtagataaggtcaaagagggaacaggtatgccaagagggcctgaaccccacaatggggagcaaatctccacatgagatttggggtgacaaagcatatccaaaccatagcgtgcatatttaatttctgggtttcattaaagcaacagatatttgagtacttttaataggtctggcagtttgcccaggttgtagacataggattacatgacagtatgttctctactctcaagtttctgtttgtgctgttataaatttgagcagtcatcattaaatctcagctatacatttaagttctgttgtgacagttgccacaaaggaaacgtctaaggtgctaagtatatatggttaggaaaaatcttgcaaactttttctgtaaaggactagatagtaaatattttaggctttgtgtgccatatgctgtaggtgtcacctattcaattctcctgttgtaattagaaagcagctgcagatgacacataaacacacatcacacagacaaatatgtcagtgtgattatgccatacatacatctatatctatctgcatttgcatacttctcaagcacttttcaaaaatgaccatacaaatcataaagtgttaacagaattttggagaactgattttcatgcagctcatgttctgtgagtgctatgcccttgcccaagaccttcaaaaaggtcatcatacaaatcttatattcttggaaaattaaaaacctatacttgcaaatccagtgtcaaagaggaaatcacattggaaattagaaaatacttagaattgaatgattaaaaaatacttttgcatcaaattcatgggatatgaatatcccaaagagggaaatttttgtagccttaccgattagattacaaaataaaaaagacttaaaatgaacaagctatacatacaatttaaaatgttaataaaagagcaagagaagatcaacaaaaccaatagtaagattcttcaaaaaaactaatgagataggcaacaagcaagttgatgaaggaaaaaaagcaaaaagataaaaataaacaattttaggaatgagaaaagagaagtcacaggtagagcagtgagtagaataacataagagtacaatgaagaactaatttgaagcctagatggaatggccaattacctaggaaaaatccattgcattcaaaatcaggcttgaataaatagaaaatgtgaatagatttgcaactattaaaggagtggcctcattacgtacaatttctcttaaagagagaacaccaaatacccatgtgatgcctagagtgtagttttgacaagcattaaaagaataaaggattccaaatatatatatatatttgggattcaaatatatatatatatatttggattcaaatatatatatatatatttggattcaaatatatatatatattttgggttcaaatatatatatatttgaataatgtcttattttcctctgggtagatacccagtagtgggattactggatcaaatggtagatctccttttagttctttaaggaatctccacactgtgttccatagtggttgtactagtttacattctcaccagcagtgtaaaagtgttctcttcactgcatccacaccaacacctatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgcattgaatttgtagattgcctttggcagggtggtcatttcccattcgtgggatgtatttcccatttgtttgtgttgtttacgatttctttcagcagtgttttgtatttgggatgtatttccatttgtttgtgttgtttataatttcttttagcagtgtttatatttttcccttgtagaggtctctcacttccttggttaggtatattccttttttttttttttttttgcagctattgtagaaggggttgagttcttgatttgattctcaccttagtcgctgttggtgtatagaagaactactgatttctgtacattaattttgtatcctgaaactttgctgaaatcatttgtcagttctaggggctttttggatgagtcttaagggttttctaggtatatgatcatatcatcagcaaacagtgacagtttgacttcctctttactgatttggatgccctttatttctttctcttttctgattgctctggctaggacttccagtactatgttgaatagaagtggtgaaagtgggcattcttgtcttgttccagttctcagggggaatgctttcaacttttctccatttggtataatatttttgactgtgggtttgtcatagatgactttacattgaggtatgtcccttgtatgccgattttgctgagggttttaatcataaagggatggtggattttgtcaaagactttttctgcatctatttagatgatcatgtgatttttgtttttaattctgtttatgtggtgtatcacatttattaacttccatatgtaaaatcatccctgcgttcctggtatgaaacccacttgatcaaggtgtgttaactttttgatacgctgttggatttggttagctagcattttgttaaggatgtttgcatctatgttcatcagggatattgttctgtagttttctctttttgttatgtcctttcctcattttggtattagggtgacactggctttatagaatgatttagggaggattctctatcttgtggaattgtgtcaataggattggtaccaatgctttgaatgtctaatagaattcagctgtgaatatatctggtcctgggcttattttttgttggcaatttttaaaattaccattttaatgtcactgcttgttattggtcttttcacggtttctatttattcctggtttaatctaggagggttgtatttttccagtaatttatctatctcctctaagttttccagtttatacatgtaaaggtgttcatagtagccttgaatgatcttttgtatttctgtggtatcagttgtaataactcccgtttcatttctaattgaacttagttggaaattctctcttcttttcttggttagtcttgagaatggtctatcaattttatttatcttttcaaagaaccagcttttcatttcatttatcttttgtatttttttgtttcaattttatttagttatgctctgatcttggttatttctttttttctgctgggtttgggtttggtttgttcttgtttctctggttccttgggttgtgagcttagatggtctatttgtgctctttcagacgttttgatgtaggcatttaatgctatgaactttcctcttagcactgcctttgtcgtatcccagaggttttgataggttgtaccactgttattattcagttcaaataatttttaaatttttctcttgatttcattgttgacccaatgatcattcagtagcaggttatttaatttccttatatttgtttggttttgagggttccttttgaagttgacttcccattttattccagtgtggcctgagagagtacttgatatagtttcagttttcttaaatttactgatacttgttttgtggcctatcatatggtctagcttggagaatgttccaagtgctgatgaatagaatttatatcctgcagttgttgggtagaatgttttgtaaataagtgttaagtccatttgttctggggtatagtttaagtacattgtttctttgttgaatttctgtcttgatgatctgtctaatgctgtcagtggagtattgaagtcgccactattattgtgttgccatctatctcatttcttaggtctagtagtaattgttttataaatttgggagctccagtgttaggtgcatatatatttaggattgtgatattttcctgttggacaatcccttttatcattatataatgttcctctttgtctttttacactgcaattgctttaaagtttgtttggtctgatgtaagaatagctacttctgcatgcttttggtgtctgtttttttctacccctttaccttaagttcatgtgagtccttgcatgttaggggagtctcttaaagacagcagatacttggttggtgaattcttatccattctgccattctgtatattttaggtggagcatatatgccatttacattcaacgttagcattgagatgtaaggtactattctattcatcatgctatttgttacctgaataccttattttattgtgttactgtttgataggtcctatgagattcaggctttaaggaggttctattttgttgtattttgaggatttgttttaagatttagagcttcttttagaagttcttggctgggcatggtggctcactcctgtaatcccagcactttggaagaccaaggcaggcggggtcaagagatcaagaccatcctggccaacatggtgaaacctcgtctctactaaaaatacaaaaattagcttggtgtggtggtgtgcacctgtagtcccagctacttgggaggctgaggcaggagaattgcttgaagctgggaggtggaggttgccatgagccaagattgtgccactgcactccagcctggagacagagcaagactccatctcaaaaaaacaaaacaaaaaaacaaacaaacacaaaaaaagaagttcttgtagtgctggattggtagtggcaaattctctcagcatttttttgtctgaaaaagactatctttccttcatttatgaagcttagtttctctggatacaaaattattgactgataattgtcttgtttaaggagctaaagataggaccccaatctcttttagagattgaagttcttttgtctacttgttcaattctgttgctgagagattccagtgtgttttgtatttctttaagtgtgtctttcatttccagaggttgtgattgtagagtttctgctgagaaatctgctgttaatctgatagggtttccttcataggttacctgatgcttttgcctcacagctcttaagattcttttctttgtcttgactttagataacctgatgactgtgtacctaggcgatgatctttttgcagtgaatttcccaggtattctttgagcttcctgtagtctagatctctagcaaagccggagaagttttcctcaattattccctcaaatacgttttctaaagtttcagatttttcttcttctttgggtacaccgattattcttaggtttggtcgtttaacataatacaaaacttcttggaggctttgttcatttttttgtattgttggattgtgttaatttgaaagctttgtcttcaagctctgaagttcttttgtctacttgttcaattttgttgctgagatgttccagtatattttgtatttctttaagtgtgtccttcatttttagaggttgtgattttttttatttatgttgtctatttctctggggatttttctgtccatatcctgtaacattttcaaaatttctttaagttggtattcacctttctctggtgcctccttgagtagctaaataagcaaccttctgaaggttgagagatttttttcttggtttggatccattgctatgagctagtgtgatcttttggaggtgttaaaggacatcgttttgtcatattacctgaactatttttctggttccttctcatgtgggcacattatgtcagagggaagatctggggctcaagggctactgttcagattcttttgtcccatggggtgttctcttgatgtggtgctctccgccttttcctaggcatggggcttcctgagacctgaactgcagttattgttatttctcttctggatctagccacccagcagagctgcctggctccaggctgccactggggaatgtctacaaagagtcctgtgatgtggactgtctacaggtctctcagccatggataccagcacctgctttgttggaggtagcaagggagtgaagtggactctgtgagggtacttggttgtatttttgtttagtgcacttgttggcctccagccaggaggtggcactttcaagagaccatcggctttggtagtatagggggatacaagcttgccctagggtcacctggataagtatgggggtttctcaggcagtgggcagggccatagagctccgaagagattatgtcctttgtcttcggctaccagggtgggtagagaaagaccatcaggtgagggcaaggttaggtgtgtctgagctcagactgtccttgggcagggcttgcttcggctgctgtggtggatggagatgtggtttccaggccagtggagttatcttcccagggggattatggctgcctctgctatgtcatgcaggtcaccagggaagttggggaatgctggcagttacaggcttcacctagctcagctaccatgaagcccgaaaggctggtctcattcctaccgtatgtcccccaaatggcactaagtttatttccaggcagtgggtgagcagggctgagaacttgccccaggctaccagcctctcgctgagagggttttcaggtttcacacttccccatctgccatggcttctgtgctcctgtctgcactcctgattcaacccttcttccgggttctgtccaggaaacttcgggttcacttgaaattattacaaattcagctggaggtcttttccctgtggtctttccctgattccactggtagccctccccaaggattcctgagacaaaaccagaaatgtgtactctggggactgagagatcccacaggactcttcccaattcttcttgtacctgtgtttttcgctcagctctctaaatttgcctcagctccaggtaaggtcaaatcctcttctcataatctggaccttcaggttcccctgtggttcaggggcagacagttcccctttcacattttcacactttgggcactcacagttttttagctgtctcctgaagctcgcagcagtaatccactctcttccaagggtctgtggattctctcgactctcctggtatgttcctgtggtagttcttggagcaaaagttcacaatatgagtctccacatgctgctttgtttgtccaagtgggaactgcaagttagtcctgcctcctgtctgtgattttctcctataccccagttattttattagatgcagaccaaaaaacccccaaataattaacattcatttatcattgaccacccccaacaacacactttcaatgctggaattgaactttctgaaactgataaggtacatctaccaaacccatgccacccaacaatcttccagtccttcttcctagatgcataaatacgaatcttttccttatttctatcctttagtgaccacttaattttcttttctttctttctttcttttttttttttttttttttttgagacagagtgttgctgttgtcacccagtctggagtgcagtggcaccatctcggctcactgcaacctccgcctcctgggttcaagtgattctcctgcctcagcctcccaagtaactgggattacaggcacccgccaccatgcacagataattttgttatttttagtagaaatggggtttcaccatgttggccaggctagtctcgaactcctgacctcaggcaatccacccgcctcagcctcccaaagtgctgggattataggcgtgaaccatgaccacttaattttcaagagtagtatgtggtactgcttagctcatcagattctccaagtccctaataatttcctatttgggagctggagaggagatgatacttctaggatgcttcaatttcagcaacattcattttctttttctgagtcatgagcaccagggttcaccctaaaatattagccagatctcataggctgaattaggtcacagggtacaaagtgttgtgcagactggtgcatgtggctcccattgaatataataacagccctttgacacgtgtggcagctgctgccagagcctccagccaggatctgggctagagggtggtacatgtataatttaagtaataacataaagattaaatatgtaattggaaatgatttcatagaataaaactgaagcctggtttatcttgaaaagaaattattgcagacatgtaaatagcttactgtaaagtttaattacagttttagtagcagacaagactcaattgataaatctccacaaggagagtcaagtaggactgaaaatctcactgcacttgcatgaaaacaacaaaagctaacatgccaaaccgaatgcaagctttgttcatttcctcaaagttaattgttttgactataatcatacagttattatttaatggccatacacaatttatttatcattttctaagagattaatttgaaggtctttttcttgttatttatgtggaatttacaggaaagtcagatattagattgtagttttagggggtgattatttttataactcaattgatttaaatgttaggttttgtcatttcgttgaatccatcagttatcatcagtattcattatttcagttccctctgagaaatgagaggatagttttgtgagtagaaaatgatttgaagagtttggcagaataaaactgaaaactgattcatctgacaaaactcttttaagttcggtacagaaacaaggactagatagttgtctcactaactccattcttggtgttcccttgactttgctgtttattgtgtttttttgttagaatttcttgaatttattaatttttgttacagttccatcatgaaacttactgaattatgtagatttaaattgttttccatggtatttctttattaatgtagaatttgaaaaattcacgcagttctggggagactattttaacttataccctctcctccttcctttttcatctgagcttcctctcatcaatcttaatatttacacctaaaatcttatgagttgagacaatatagaaattaattattgatctgtaaattatgtgaaagttcccaacatagaagcattttatatatattaaatcagtgttagaattcgtggctaggtacccgtagtgtaaaattgtatttaggagctgaaagaccgtgagtgtgaatggatgtttaggtggcaattggaaagatttcccagtattctgaagaacataagctatttgacctatttgacataagtcttatgcttccttttacttagatttctggtttgctttcttttggtacatgttatacctgatactgttctacagcggtcttcagtaattttttaaatcttgaaatagaatggaaagattgagagtgacctgctgaggtaactggaccagaacaggttaggagcgcgtgtttataaacacgagggagggtctgagtaggaggacctgaggaatatgtagggcagtgtggaaagggaagacatggaaatgacattgatacagctggttgttcatgccgggtgttgtcactgccccgagactgcctcattgccatgaggaaagatttgtcattttcgggaagaaggtgtggagcggctgggaggcagcacacaatagccctcctgtgggtaggatgttggctagccttgggtttacctcagtgaagacccatgtttaggatgcttgaaaacatctcattagcaactttgtctgttttaagctctggagcagtgaagaattctattaatggcagtaaactttttttttttttaagaaggaaacccaattatgtccctccattaaagttctgatagttagactttttttttttttttttcccagcaagatctctatgtagggtagggagatttcatgctactgggagcaagatgatgcttagtagtagttgatgccttaagactttgcagggtcacatagaatagcatagtcctgggctacatccaacatgcatttcaatcagttcttgggtggtggaaaagggcttgctcaatccgcttcttagcattgaaatgaaagaactcccagttctcagactggcaatgatgtgattaaaaacttgaacttgggtttctgttttccagtcgtggtaggctaggttaccctgaccacttctcctgctgaaactaagtaagattgttgaataaaatagttaaaaatacatttttttctagcgttgaagaaaggagagtaagggattctcaggtaaactgaaggagagcaggaactcagagaggcgagaacggccttggatgcagaagcaccttttgtggaggcttttcagggagcagaggacagggtctacagtttagggagcttcctcccattaagctgggggccttgcaggggcacacctgcagggtaaggtgacagaagacagccaggtttcctgaggatttgaattctgggttctccttactcatatggactcaggaccctcagactctacatttctcaaaagccaatgcagctcctcttcataggagggcacttttattctgtatgctgttaattcactttcaaaaaatcataaagcacaagaaagaagacatctccagctattagcacgaaaagacactataaataaactacaaaaattgaagatactcgaataaccagatatagaatataaaacaaccatgctatgttaaaaaaacagacagtaaccctagggatatctgtggagaccagcaaactataaaatgtagcacagcagatgtgagaaatgagtacatagaacttctggaaatgaaaaatatcacaacaaattaaaaattctaaggaaaggttgaatagtatattagttaatactctaagaagaattagggaagtagtaggtaaataagaaattatctagaacagaggtcaacaaacgtttttctgtaaaggatctgctagtgaatatttttggttttgtggaccacatatggtctctattgcatagcctttcctattttaattttgtttttacagacctttaaaaatgtgaaaaccgttcttagattacaggctatgggatatatttggcccacgggccgtagtttactgaccccaatctatatatacaaagaagagaggagtcacgagaaaacccagaagggcagttgaggcatacagagtagaatgaggaagtttaccgagcttgatcagcctaaaggcaagagaaaaaatagggcagagtaaatatttgaggaaataatagctagggattttctgaaggtggtaaaaagatactaatctgtagattcagaaagtccagtaagtcctaacaaggatcagtaaatacattctctccacgattcatcatagtgaaacttcaggacagcagacactaagagaaggtggggagtaggggatgggtacagcattgcttcctcagagagagaggtgacctctcaccagcaacagagggaccagaacacagcagaatgccattttcaatgctgaaagaaaatacctgccaacccagagctttataggcagaaaaatctttgaagaatggggttaaaatcaaaacactcacaaaagttaagagctgagagtttgctaccagccaacccatactaaaggaaattttaaaggttgcatgttgtacggaaaaaaatattcttgggtggaagatctaagctgttcaaagtataaaaagcaaagaaagtgggaaatcagtgataaaacttagattagtattgaatatatggaacatcatcttgaggggttttaaaaatattgacttgaaatataatacaattgcctgtgtaaattgagaagagtgtgaaatagatatgtttaaaaatcctcatattaccttggaaaataattttcaagcacagttttacagttgatagaaatatgaaattaagacaaaattctttactacattttaagtcgaataattgaacaaaatgttagaaataggcacaatgtagcttgctgcttgattcttgtaatcaagggggaagtggagatcaatgaactaatggtgacatttcactgctttttagtaaaattgtatgaagccatagagaaagggaaggagagacttaaataataagaaaaacctcaacagatctgtgatgcttatgatgggaagttcttttgagagaagtggagtagtgggtgattgggcctaggagtggggagtggaaggattattgatgttgccgttgggcctccatggtatcactcccatgctgttggatttattggtctaagtgtnnnnnnnnnnnnnnnnnnnntcttatcctaggtacctttgtgtctggctcttcaccagtgcaggaagaaggtaccttgaaatgtgttaaaaaatgtttacttagtaactaggaaagatgctcctaatgtaacttgctttgtgaacaaatacgtatgaaatctacataagtgtgttaagtgtcagatttcatcatctctgggctgagtgttggtggaaacattagaggataaattagctatgagatatgttctgtttctgatttaatcttttcatttttctctttttgtttttctcaaccttttctgctacttagtgctttcttgcctctgtctcagatttttatgagccaaatattcttatattctataatctgtgttcttcccaaccagaggtgttatctgcagagactttttttatcagactgaaatccgtcctgcctttttagaatgagctcatttttcttcactccagctaatgctgacatttaccaaatccagtcctgattaagtaagcttccatcaccaagaaaactggaaaaaaggtaggattcataagacagtggattcccatccagtgcttgtagctctgttatcctctttagaagtatctgagggttaacaaaattggaaattgtagaggaaacaaatttgcactgaatttagacctaatttacctgaaaatgggattcctttaaaatccacagtgagcccacagttttgtcctgtgactgagattcagtcacaccttgaccatgtatttatttcataaattaagccttcaggccaggcatggtggctcacacctgtagtcccagcactttgggaagctgaggtgggtggatcacctgaggtcaggagtttgagaccagcctggacaacatggtgaaactccatctctactaaaaacagacagtactaaaaaacatctctgctaaaaacataaaacactacctgggcatggtggtgcgcacctgtaatcccagctacttgggaggctgaggcaggagaattgcttgaacccgggaggtggaggttgcagtgagccgagatggcaccattgcactccagcttaggcaacagagcaagactctgtctcaaaaaaaaaaaaaaaaattaagccttcaagaaatgtatatgccaagttggagatgtgtcaatagagctaagcagatttttggtaactgccaaattagtttcttatggagaggggaagcaaagaaatggaaatagtaacaataagataagcaacagtgagaggaatgatgaggagcagaaggaaggagaaggctaccacatgaaagtgggaaagttgagatctgaaattattatattttgaaacctagaaaagtaatgaatctcattctgtcctctctcctctgccctcccatactttgggaaatggtgaaataatctgaaacagaaatgtttatacagggtgagcatccccagtccaaaaatccaaaatccgaaatgccccaaaacctgaaactttttaagtgctgacaggaggccacaaatagaaaattccatatctgacctcatgtgacaggtcacagtcaaaatgcaggcacacaacacatagtttcttcagcatctccaggggaataaaagaccctcttagctccctttagctgatacttgggtcccatccccaagatatctcataatgtatatgcaaatattccaaaattcagaaaaatcccaaatctgcaaccctctggtcccaagcatttcagataagggatactcaacatgtagtacttattgtagggttatttcagatgtgctgtcatattagttaaagtgaaaaattgatttgcaaagttctgatcattttagaattggtgtttaagtccagtagaaatcttcatagttaaatatatttaatattttgttataaattaagtaatgagcaactgaattttaaagaatatattcttagaggcaccctcacttcaaaagaaattgaatttcaacaaaatgccaggactggccacgcacagtagctcatgcctgtaatctcagcactttgggaggccaaggcgggaggatcgcttgaggccaggaattcaagaccacctgggcaacatagggagactttgtcattactaaaagtaaaataaaaattttaaaaaactagctgggtatggtgatgtgagcctgtagtgccagctacttgggagactgaggtggaaggatcacttgagcccaggagtttgaggttgtagtgagctatgatcatgccactgcattccagcctgggcaacagagtgagacttagtctccacaatagcaacaacaaaaagccaggactatgatttttttttttcaaaagttcttctcagtgtcagctcagaagtgataaaaggttttccacctttttttgtgtgttttttattaagaagaaaagatttgaaaggtaaatagaaaaatcttgtaaattcaccaaatcaccaaatacgtgttttgaaacatagtagtttttctaatttatcagtctcattttctaattctatccttatgaccaatatctctgcctttgctctggatttatcaccttcatggacttttggacatgggagaattttatcctgatggaagtaaaactgcacggacttctcttgtgttatagaaatatgtgtgtgtgtgtatacgtgtatatatacacatgcatatagagatatatatgcatatctagatgagcataaatgcataaattatgcatagattataaatgcataaattatgcatagatatatgcgtatacctatatatgcatatatctataatgcatgtatgtatgtgtgtgcatatatatacatgcataaatataaatatacatatatctatattgtgtgtgtgtgtgtgagaatggagtgccatccttccccttcctgggctgtaagcttgtttgttagttaagacttcatggtagaaactggtgtattcatctttaaaatattttgcacattggtggtgcttaaacggcttactgaattggactctccaagaagggtatttcttaatagaaaactgtcttgctttatttgttttcgtttacacttaactagttgacataaccctcaggacaaggactgtgggcatttctttccttgctggtcttacaagctactgatatatggcatttatgactttggcagagatggtgggttaaatcaaggggccaggattccttcatcacctaaggacttgtggtttataaatacagaagaggaaaaggagacaaatgaaattacagaaatggcctcagcttgattgagttataaccttcactgtctgatttttataactctaggcaagtactctaccttttttatttcacttcaatgtaatttatattttgctaagttgttaggtggcccagttaaccttaacaagatacttaatgttaactagttttctgaatattttcaatggtgcctctattagagagtattgtatgtaggtgaacaatgtatttcccaagcacaaattacagtatttcctcaaattatatgttctaaaggcaattgaggtatgtatgtaattatgtgttaatcaagttagtgatttgctattaattgggtaagtacaannnnnnnnnnnnnnnnnnnnnnnnnnnnnnnnnnnnnnnnnnnnnnnnnnnattttcctatgaccaatcctcttaagtttttcatttctatttcaactcctgtaaggttaacaagaattatcattttaaaagaaattccttccatctgcagatgtgtgttgcttctgatatatttgaatcagctgaaatctaaaagttttttacataggaattatctctaaagatataaaatggtcttatttttccttaatggtgttaggaaaacctaatagcaacaatggattgtgcatgatcaattttatgtagtcacattttgggggatctttaagcaagaataggcaacaagaaaatgtgcatttagtgttggaagggatgagagattagttgtggatctgaggattattcttgcctcaacaagtggagaattggagatactcttcatgaggagtgacactcaagtttgagccccgtaatcaagagacaggagaaatgttaataagagaaaaccttttattttgtcagatccctttttgaggaagaacaaatgcagtttttgaaagcattaagcatttagaaaagggtgcagaaatgtagtaggacaaaatgtgccttaaaacatacagcctctttatgtccaaagcttccacacaacatgaagtaattgtctgaaattacaagtgctactatagtgattgaactctagctgctaattgagccttcaggtttaaaaatacacaggcctcagcaattcaaagattattaaattacaccttcttgtgggaaccaacatcaatgtgtttgagcagtgagtagtgaaggtctttggggaggcaggggcagagggtgtctcattacagcgtttgccactgcagatctcttgagggttgttgctttttctcaagacgaaagattttgttaacacttcattccacagaatgttgaaaaaagtggagctctcttgcatcacatgactgttactgcaagttttgtgttgatctctgaataactagaaatttcaaaaatttacttatgaaccaaaaggcataattggtgtataactcaattatttttatttaatcctcacaacagcctatgatgtgaatggctgtgttcccattttacggatgaatatgttaggctcagaagtgacctgtcaaaggtcacacaactaagtagaattgctgagactgcatctactggctctgaagtttgtttgtttgtttttttaaactatgtcttagccatctgatgtttcaaaggttatacagtcaaaattgaatcaatgtgattgtaatgtgcctttccaaaaaagaagatgaatactggatactcactgaacacaagtggtttattctttcgttcagcaaatttattgtgcaacttttgggtgctaaccacaattttaggcagctgggaatacacgattagaaaggatctagaagattccttcctgtcttggtcaattttctgttgctataacaaaatgccacagattggggtaacttacaaagaaaagtttatttagctaatggttctggaggctgggaagtccaagagcatggtgctgacatctaatgagggccttcttgctgcatcataacacaggagagggcaccatattgcaagagcacaagagcatgtgtgtcagctcaggtttctgtacatcttcttttaaagtcaccagtaccattgtaggggtcccaccctgatggccttgtctaatcctaattacctcctgaagcctccatgtccaatcagcatatgaatttgggggttaagttttaaatgaatgaaatttggggaacatatttacatgatagaagttccttaaatagaactcagagctcaactgtgggaaggtagacgaatgaataagatagcataagtacattgaaagataagtaagaggatgatgtgttaaggagtggtttggggagtaaagaagtcacccttagtgtattagtctgttttcacaccgcggataaagacatacctgagactcggtaatttataaagaaaaagaggtttaatggactcacagtcccatatggctggggaggcttcacagtcaaggcagagggtgaaggaagaacaaaggcgaacaaaggcatgtcttacatggcagcaggcaaagagagaatgagagccaagcaaaaggggtttccccttagaaaaccagcagatctcgtgttacttattcactaccacaaaagcagtatgggggaaactgcccctatggtttaattatctcccaccagtccctcccacaacacgtgggaattatgggagccacagttcaagatgagagctcggtgggaatacagctgaaccatatcacttagatagggtggtaaacagagtcctcagtgaggagctatttctggcctgagactccaggagaatgagatgggaccaggggtggatatgccagacagaggaaatagcaaatgcaaatccgccaaggtggtacagtggcagaatacataggaggtggtgtggcagagcctcaggagcaaaatgagcccagtgaggtcaagaagcagacaaggaaagaccatgccatgcagggccctgtagaacatggaaggaagcaggattattctagatgcaatgtgaccccattgacagggctgtggattgaattatgttcccccaaaatttatatgttgaagcgctgacccccagtgtggctgtatttggagtaaggaagcaattatggttaaatgaaatcataagggtagagccctaatctgataagattagtgtccttagaagagaaacacctgatctctctctccaccatctcaacgccatgtgagaacacggtgagaaggtggctgtctgtgagccaggaggagagcttttatcagtaacataattggctgacaccttgatctttgacttctagcctccataactttgagaaataaatgcctgttgtttaagccacccagtctgtggcattttgttatggcagcctgagcagaccgagatggaactgaaagtattgtcattaactgagatggagctatctggaggaaatgcatcatttggtgaggccactctggctggatattagtcctcagtgttctgaaacacattcttccctgttggattctgtcataaatgtagttgatgatgccagctctcaccatcaaggctcataagtgctatgagccagatgcaagggttttacttaacaatgaaaattttacctgtcaggtaaactgagtctatggcttgggctgacataaagaagccatgatcacattgagaagccatgttatccatattgcatggtgaactgggactccagatagaagggcacttcattctcccactttactgtttaatggtgtcagatgtgtggctatggttccacaaagcctgactggacactcctaggccaccctccctcttgctgacttagaaacccatgctgtctgcctctaaccatctttatagtctttcattttagacctttttctgacccacattaattccttcagtcaagttacagttgaggtccattgggtctgggagccattcattctctttaagataacatcacacagctttgctttaccctttatgttaattaatcctgctgtatgtcctgattgtggaatgtctctccaagcccacagccattactctgagcttctctttctgtagtccacacctgtaaatgcacttacgttttcatacttccttgccttttattcattctcatcgctttgcctgagtattctttcctctcttcctaactcaggacagcactgcctgtattagtcttctaggctgctatgacaaaataccacaaactgggtggtttaaatagcagaaacttgtcatctcacagtctggaggctaaaagtccaaaatcaaggtttctgcaggatcagtctcctctgatggttgaggggagtctgctccaggcttctcctccagcttctgagtgctcaggcgtcaccttccctctgtatatgactgtgtacacattgtcactttataggacaccagtcatgatagattagggcccaccctgaagatttcatcttaacttgattacctgtgcaaagactctgtcttcaggtaaggtcacaggctgagagtactgggggttaggactccaacatacgttttattgtgggacattatttaacccataacattgccccttctttcctccatgagggggaacatcacatcaccagcatcctaagcccttgtttgataacttggtgatcatcactcttccaggggagcataattggtcacctatgagactaataggtctgttggccactgtccttgtaactcttctgtcatgtttattctctgacttgcctgtcacccttactagaccatagtctccttgaggacaggatcaaaccagcattgtaccctgctcctgggcacatagaaagtgttcgtagacagaacacatgggcagtctcaagtaaacatattggctgttgattgttgtaacctcttcagtctaagaataatttggctcaataaaaaaatttttagaagaagcaatagaatagcaaatcatatcattgaaaagcatagaggtttaaaatatttttaaaattaagactagttaacacactataatgaaggcacagttacattaagtctattttcttggtatgaaagatgaaaaaattaatgattttccttttaatcagccgtttaatcttgtagatagtcttcataaatttcttccaatcaccattagtaatactctttcctttttgaaataatagctcgaaatataaatatctttattttatttgctatttaaagagctgccaagtatttgcgttaggtgagatggtgcatatgatctgtagcagtttgctgtagctttcgggaggctatttgaaggaatagcttaagctatgaggcaaggcccatcagaatgtcatctttcattctttctctttgctctgtggtcacctgcccccttccaccctctgcctttttactgtgttagatcagcgtcgcttctgttttccagcataaaacccctgacctcaagtgaagaaatactggtttaacatatacggtgtaaattgttctgctttctataaacttttatactaatatttttattattttgatatttgagagggaaagagtaatataatattgcagttcatatggcagccacagtttaattttatggcaaagtcaacgactttagagttgctgaagtatttatagtactgaaagctttgtgttggcaatttctttcaaaggaagcaattcttattattatatcatggacatgcacaccactctcatgctgtttaagacacctttttgtcccccccccaccaccaaacagggaactgggagggaaaaccaggcctcaaattttgtgtgcttgcttctcatgttttatttctaagtgaattagaccatatggtcacataaacccaaagctaggtggtacagggatttaagtttgtggccttgaagtgattctagttttgctttcaattagtggaaaataatgcattcatagaacaatttataactcacacagacccattcgtgaaaagcccactccagatattgttgcgtgtgtccaggagaagtggcagcgttgatctccatagagatgactaatcagttgagactgagccctttcccttttccatgcgacagcatttatttgttgtgacactaatttcaccatgtcagttttccctgccagtgtgccccagccctaatcctcatttcacatgcatcactgttctcccctcattgaaacttggcttgaggctaacaatattaagtggcggaactgtggtttgctaaacacaactagctgatgctcatgtactcctatgaatagaaaggatcttccgaatatttccttgagggaatgggctctacaggaaatcttgagacagcccttatgttgatacatgtaaaaatatgcttcttaataatacatgttggtgataatcagataaatggagtgttgactgcgaacctgagcaatgtgcctggctaatgaataggatgtttattttctgttactactctggacataccaaaggcaactgcatcatctattaaaaaaaaaatccttagggtccgctttctcatccttcattttaatttacaagagcagtaactacttctgggactgactggagtattttctggggattaagtctggttcaaaggcctttggctgtgctggaggccataggtttcagtgtgaaataactgcctgggtgtctgtattgtcatagcttaattacagtatttgcatcttgagttgttgactgtgggttttctaagactttgagagtgctaagtgtgatttgcttttcagtttctgacccagcaagcaaatcccaggcaatgttaagtaagaaaaaacatacctgtggtttttgcagggagaaaaactcatcttcaaaattgacagcatcactgtccaacaggactttctgcagtgatggtgaggctcatctgtgctctgttcagcacctccgctcacgtgtggctagtgcaaccgaggaattgaattttaaattttatttcattttaatttatatgtaattaggcacatgcagccagtagctaccatattggatggtgtagatggagaatatctttgaagaccaaatacagttcttcctgatgatttatagtaaatttaatgtacttaggtctactccaggtatttttggtcttaagttgatttgaggattttttgaagtcatgtaaactttatgaaacatcattttgtcaagtgctggataatgattatatttactctaaaagaagatgcttgctgcttatgtgtgaagagagtaatttggtgacctcctacttcattcacaagctggaggggacaaatactatacctatactaggcactgtactttctcagtgggttgctcatatacctttagtgacccatggaatatcattacaatgttttgcaggggtattttcaaaatgccaccaccaccaacatataggcatgatgtcctccacttcttgcagctttacatagactgagatacaggaaaagctaaagtgttttgcgtactctcactcagtacaatacttctaacaccagaaatgtggggagttttcccaacatagcaaaccaagcagttttctagcagcaaacaccaactgggtgtcctacaatttaactcagttggagttggatcccacagattaagggctcagccccacaaggctctccccgaccttagaatccaatcgcaagccccaccccctgacaccccctcatggttcgattaatttactagagtagctcacaaaactcagggaaacactttacttacattttcatatttatcataaaggatgttatggatgaacagccagatagagagatgcataggtcaagtatgggaagaggctcagagcctccctgccctcctcaggaacctgcatgtgttcagcaacctgaaagctcctgaaccctgatttttggggcttttatggaggcttcaccacgtaggcatgactgattaactcactggccattggtgattcactcagccttcagcccctcccctccctggaggttgaggggtggggctggaagtcccaactctctaatcctgcctcggtctttcctgtttcaccctgaagctacctagggaaaccaagggggtagggtgacctaggggtcactggtagccatctcattaacatgcgaaagacatcactcttgagattccaaaggtgtttggggctctgtgccaggtaacagggatgaagagcaaatacatatttcacaatatcacacacattacagacccccctgacttttgctctaatgtttctatcctttgcctcatgctacctttcacctgattggcttccgctggccttgcgttaaatccctgcaggtgtagctcactgggtaggatgggccttaggtaaagacagaatcctgagctgctctgtgggccagtcccctgggagtacctttaatttggtagagattcagaggaagattgacagtctgcgtcttctgtgatgagggtgccttttactcctccagcttagccgggaagctgccctcttccgtgggagaagttgtgctctgctcacccctctgagcttttcctcactttcccagcgaggagactctagaagttactctcagagtcacagtctgtttgccaccaatagtttggctatgcttttatgcctaagtgacaaactgtaagtttttacttttaagtaaaactcctgagtcacggaagcatgtttagtatctaagaatgtttgattctcaaagtattgaaaaagaagattctgctcacttgttcagcctctacttgatccctgttagcacagaaagatgcagtcagatttctcttgagcttggtgatatcctttataataacctttagagatccgttctattaatgaggcatgatattgttactccaattgtgcacacaagctgggggacctccctttcagaatggcatgtaaagaaattccttccctcctggaggcttcattatataccctacatgcagtgctcggcagtctgcttttaaggtgagtcattgtatagtatgatttctcagacttcaagggcagataatacacatcacgagcctcagaacagcttacttttcagccttaccttcctttacagagagagagataaagagagcaagagagtgcatgggaatacgagcgagatcacctctttgtctttttagaaatcctgtacgtgggcattaaaattaatttagagtttcttattatgtcctttcaataatagcaacaaaataattataatgacaacaatgaagtagccaccttgtgtcattttgtctttggctaagtcttgaattcctgtaatttaggtgtgagataagttggatgtaaataacattatttaaatcaagattatagggaggctggacgtggtcgctcacgcttgtaatcctagcactttgagagtctgaggtgggtggatcactcgagcccaggagttcaagaccagcctgggcaacatggtgaaaccttgtctctgcaaacattgtaaaaattagccaggcatagtggaatgtgcctgtagtttcagatactctggaggctaaggtgggagaatggcttgagcctggaaggttgaggctgcagcgaggcaagatcgtgacactgtactccagcctgagcaacagagtgagaccctgtctcaaaaaaaaaaaaaagatcatacggaaatccgactgcttcacaaacattcttttgttgttgatggaaaaaccaattgactattaagagtgatagagacaaacaaactttaatgctgtatctaaatatctgaaaacttcatcaggaaatgtatgaatttaaagcggataaactcagtcaagcttgacacagacactagcagtctctacttccggttaacagctgtttcaggagacagcatctcaaaatgagttgtcagaaaatctgcctgattttctcgagggaccgaagctacaattgggaattgagctcctgatggagtaggcatcaaataaattggacccatgaatatcaataatttcttaaaagtaaatactcagtaattctaaatactagcctttaaaatggtgacattatgctgtaactgcagtaagtcctgttagggcgctgttattagtcccataaagtgctcattcagaaataaaattctaacatgtcaaaaatcgaacccaaaactaagctataaaaaatttttaagtttaatgagtaacagtttgtcttaagccttttaaattatgacttacatgatctcttaaggcccccttggaagtttgaactgatgaagttttcttttaaatggatcttcaccaaagagtggaattgaaaataagtccatgtatcttagtttgtctctgccattgtctcatgcagttgtgttttgtttattttagtttttgaaattaaaaatgactgaaagacctgtaccaagcatttctttcacttgccttctctaaatctgttcaagtttattcagaattataattttaactctttgatatctgatcaagcagaggcctcccacattagggagttaacgactgtgaaggcttaaacttatggacacttaccatagtgtttagcaattgtttagaaaccgtaagaacaattactagatcattagcaagcacttttttttggatgggggagaagctgcaaaatatctcctgaaattgctcttagggatgttccctctaattttaaaaagtaaaggggaaaaatgaatttgcattcactggtgtgtgctgtttcagtgtcagcaccatgagttaggattgtattgtgtgtcagaactttgctctgtgctggggatgtaagaccaaagtcaccatgctcatggcttcagtctcatgaagcatgacccgtgtaacattttaaaagagacaattcataaacacacttagagagcattgtagaaataaaggagaatgtgagaaggagtgtgctaagattggggaaggttaaacttgaacagtgacttggggagaaagcacttagggaaaatgaggtatgtgaagccattccttaacagaaatcgccatagtttggggagtgttctactaaatatttgtactgcaggctgtgtaaatgaatgtcccatgtgaagaggtaattgtggctgagatcgaggatgtgacgtctcgagactccccttttggagattctcaaatcacagaaccatattaacatctctgagacatcctcctgccaggaaacctgtttaaatccgtttattgcaggattttccaaactcaattgagcatggagtccttgtaatactccatggaatgatttctgttaaatggtttcagggaatgctgtctgttggaggcatcagacagactggaaagcctggctgaggtcaggcataggaggccctataggccatgctcaagttttgaagatttcctctgtgcaaaaattttagtgtcctcacatcccctatcagaaatggaactgctataattatactgagcctctctgctttggaaagacataaaaggaaaagctggacctttgtcctcaaggggctcagagattaatgagaagacagaaatacaaactattgtgatacataacaaaattattttaaatggagcttttgcaaaatgctttctacaaagacagcgcaccccctcctgttctgcggggattcactaaagcttcaagtccagatttgcatgcctggaggatggacgaggaaagatggatgagtatggggggaagaggtgggggacgtagtggtgccaggatcaaggactgatggaagtccacagtgaaggccgtgggagttggtgagaaagaggtagaaggtgaaactggcaggatttggggagtggattttgaggacaggaaggaatatctcagaattatgaaagcttttgtctcaaacaacttagtgtcaaatacattccctgtagcagggcctttttttctaaccccctgctgtgtttctgtctagactcttgctcagcacagtagacattaagaaatatgagttgacagattgttatattttataatgtacaaaatcctatgctactaagttttaacaactacttttagttaagtgttttatatgcatggggtatcctcgggatagaatcctaatcctgtgatgaagattgtcattgattccatcaaatcacatataggtttgtaaattcttgctttaggaattgctgtctttaatctgccctacgttcttagtattcccggaaatatcatcttattattattattttctaaatctaatatcaatggacacaaaacagatatgacaatccatgaagcataaacaaacatgaacctgacatccaactaggagattccttttggttccacctgctcttcccctaccacaatctcgccttcactcctgttctgaattttgtgtttattattccctagtttttagaagcagtttctccccatatgtgcatgtttttctaaacaacttttggtttagttttgcttgtttttgaacttgaagaatattgtggctgggtgtggtacctcatgcctgtgatcccaatactttgggagaccaaggcaggatgattgctggagcccaggagtttgagaccagcctgggcaacatagtgagtcatcatctctatgaaaaataaatgtagccagacacagtggtgcatacctgtagtctcagctactcaagaggttgaggctggaggattgcttaagattgggaggttgacactgcaatgagttgagattgccccactattgcactctggcctgggtgacagcagcaagaccctgtctcaaaaaaaaaaaaaaaaaaaaaaaaagattaaaaacaaatggctgcacttgaaagcacagattgagtctatagcttccagcatgagcgatgcagaagatgggtgatatctgcatttccaactgaggtactgggttcatctcactggggctagttggacagtaggtgcaggacagtgggtgcagcccaacgagcatgagctgaagcagggcgaggcatcacctcacccaggaagcacaaggggtcagggaattccctttcctagccaagggaagctgtaacagatggcacctggaaaattgggtcactcccattctaatactgcacttttccaatggtcttagcaaatggcacactaggagattatatcccatgcctggctcagagggtcccacgcccacagagcctcactcattgctagcacagcagtctgagatcgaattgcaagatggcagcaagcttggggtggggcgcctgccattgacgaggcttgagtaggtaaacaaagcggccaggaagctcaaactgtgtggagcctgttgcagctcaaggaggcctggctgcctctgtagactccaactctgggggcagggcatggccaaacaaaaggcagcagaaacctctgcagacttaaatgtccctgtctgacagctttgaagaaagtagtggttctccaggcatgggagtttgagatctgagaatggacagactacctctttcaggtggggtccctgacccctgagtagcctaactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattgtgtaagacctttgactatttgactcagccatcccattactgggtatatacccaaaggattataaatcctgctgctataaagacacatgcacacgtatgtttattgcggcactattcacaatagcaaatatttgggaccaatcaaaatgtccaacagtgatagactggattaagaaaatgtggcacatgcacaccgtggaatactatgcagccataaaaaagggtgagttcatgtcctttgtagggacatggatgaagctggaaaccattattctcagcaaactatagcaaggacaaaaaaccaaacactgcatgtactcactcataggtgggaattgaacaatgagaacacttggacacaggaaggggaacatcatacatcggatcctgttgtgggatggggggaggggagagggatagcattaggagatatacctaatgtaaatgacgagttaatgggcgcagcacaccaacatgggacatgtatacatatgtaacaaacctgcatgttttgcacatgtaccctagaacttaaagtgtaataataatttaaaaaagaatattgtgatcctctggtttttcctgaaaaaatgtatccatgttttaatacaggtatagttcctcttcactgctgtgtattgttacatcatagcatcatgttttcatcctttcttctgttgatgaacatttgggttgcttgcagttttttgttgttatgacagtgtctttgtgaacattcttgtatataacccctgctgtgtgaagctttttctaccatttatatatggtaagagacagggtccagtttcatccttctgtgtatggacatccagttttcacagcactatttattaaagagactgtccttttccctatttgtattcttggcaccagtgttgaaatcaattgaccgtatatgtgagttcatttttgggccttctattggtgagtctttttttgtgtgagtatcatgttgttttaattactatcactttatagtatcgtttgaagttaggtagtgtgatacctcccactgtgttctttttcttcgtgattgctttggttttgttttgttttttttttcagttccagatgaattttaggattgttttctcttcatgaaaaatgactttgaaatcttgataggtattatattgactctttagcatgccttgtgtagcatggacaatttaacaatattaattattcctgtctatgaacattgtttttttcatttatttgcatctttttccatttctttctttaacattttatagttttcagtgtacatgtctttcacctccttagttcaatttattcctattttattttatttgtagctattgtaaatgggatttttctcttgatttctttttcagaatgttcattgttagtgtatagaaatgttcctgatttttgttagttgactttagattttgcaactttattgtatttattagttctgagttttttggtggaatatttagggttttctctatataagatcatgttgtcagcagtgattgtttcattttgtactttccaatttggatgccttttatttctttctcttgcagaattgctctggcaaggaatccaacattcaatagacatgttggatttttgtcagatgcttttcctacgtctaatgagatcatatagtttttgtctttcattctgttaatatagtgtatcacatttattgatttccatatgttgaactatccttgcatcccagggataaatgccacttcatcttggtgaatgattcttttgatgtggtggcaaattcaatttgctgtattattgaggatttttgcatctgtgttcatcaaggatattggcttgcagtattttttttttttgtgatgtccatgtttggtttttgcatcagagtaatactggcttcataaaaggatcccttcctcttttattttttttgaaggcgtgtctaaaaaattcatgtcagttcttcattacagcatttggtacaattaaacagtggagccatctagccttgggattttctttaatagaagacttcttattactgattcaatctcctcacttgttagtggtctatttagattttctatttttcgtgattcagtcctaataagttgtatatatgtagaaatttatccacttattctaggttatccatttttggggaatataatttgttcataatgttctcttatggtcctttggatttccgtgctgtcagttgtaatattgcctctttcattgctgattttatttattttgagtcgtattttgggttatctctctagtctagctaaaggtttgtcaattttgtttgtcttttaaaaaatccaactcttagttttgttgatcttttgtactatttttctagtctttattttatttatttctgctctgtattagtccgttttcatgctgttgataaagcacacccaagattgggaagtaaaagaggcttatttggacttactgttcctcatggctggggaggcctcagaatcattgtgcgatatgaaaggcatttcttacatggctgcagcaagaaaaaaatgaggaagaagcaaaagcagaaatccccagtaaatgcatcagatcttgtgagactattcagtatcaccagaatagcacaggaaagactggcccctgtgattcaattacctccccctgggtccctcccacaacatgtgggaatcctgggagatacaattcaagatgagatttgggtggggacacaaccaaaccatatcatgctctgatcttaattatttctttcctttcactcatagtgagcttagtttattcttctttttctgtttccttgaggcataatattaagttgtttctctgagatcattcttctttcttagcataggcatttattgctgtaaaaactttcctcttgcaactgtttttgctgcatcccatgagctttggtatgttgtgtttccttttttgtttgtttcaatatatttttaaattttcctataatttatttattgatccattggttgttccgaaggatgtttaatttttatgtatttgtgaatttttgttttgaaatttctcctgttactgaattctagtttcataccattgtagtcagaaaaggtgcttggtatgattccagttttattaaattttctaagacttgtcttgtggcctgtcatatgatctgtcttggtgaatgcttcatatgtgcttgagaagaatgtgtactctgttgttgttggatggaatgttccatatctgtctgttaagtccattaggtttaaagtgttgtttaagtccaatgttcccttattaattttctgtcttgatgacctattattgaaagtggagtattgaagtcccttgctgttattatattggaatctatctctcccttaagattctttaatatttgcattatatatttaggggctccaatgctgggtgcatgtgtatttacaattgatatatcctcttgatgaattgaacccattgttattatataatgtccttctttgtctctttttctagttttttacttataaagtctgttttgtctgatttaagtatagctacctctgctcttctttgctttccatttgagtgaaatatctttttctatctcttcactttcagtctatatgcacccttgaaaatgagatgaatgttttgtaggcattatatagtttagcctttaaaaaaagcatttagggctgggcaaggtggctcacacctgtaatcccagcactttggaaggccgaggcaggtagatcacgaggcgaggtcaggagttcaagacgatcctggccaagatggtgaaaccccatctctactaaaaatacaaaaaaattagccaggtgtggtggtgggcgcctgtaatcccagctgcttgggaggctgaggtagagaattgcttgaacctggaaggtggaggttgcagtgagccaagatcgtgcctctgtactccagcctgggcaacagagtgagactccatctcaaaaaaaaaaaaaaaaaaaccacacaaaagaatcatttagtcactctgtctttttattagggaatttaatcaatttacattcaaggtaattattgatagataggcaaggacttagtattttgtcagttttgttctggttgttttaagatactttgttcctttttccattcttgcagccttcctttgtggtttgatcgttttctgtaatgacgtgctttgaatccattctatttttctttgtctactatagatttttgctttgtagttactataaggttcacatggagcatattatacttctggcagtctatttcaagctgataaaaactcaagtttgattacatgcaacaacactacacttctctttcccccattttatgtttttaatgtcagaatttgtcattttgtaatatgtattccttcgtaatttattttagctatagttgttattaatagttttgtcttttaacccttgtacaaggaataaagttgccttatgcactgccattacagtcttagagtattctgaatatagctctgtattacttataccattaactattatgttattaattcacagccttttgtttcagcttaaaaaattccctttagcaatttctgtaaagcagacctaatgatgataaacttccttagcttttgtttgtctggaaaagtttctgtttctgcctcattttggaaagacagctttgctatgtaaaatatttttggttggcagattttttcccccttcactttgaatatatcatcccactcttagtctgctggatttctactaataaatttgccaagatagtcatattgggacccctttgtatgtaatgtatttcttatctcttgctgttcttagaatttcttctttgtctttgatttagatagtttgattattatgtgtgttagtgaatgcctctttgggttgaagttgattagaaacctctctgtttcctgtacttggatattggcactttccccccagtaagaaaagttttcagccattctttcttttttctttttttcttttttttttcttttttagatggagtttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccactgcacccggcccattatttctttaaatatgctttctggccctttttctctttcttctccttttgacttgctattatgcgtaggccaggtctcttgatgatatcccataattttcatagtctttctttattcttttttctttttatttctctaattggataatttcaaagttctgtctttaagctcatttattcttttctcagattaattgagcctggtgttgaaactttctcttgcattttccagttcagatattgcttcttcatctctatgatttctttcttttacaaaaaattgtttccatttctttgtcagtcttgccatttggattggttccaggaccctcctctcccccatgtataccaaaatctgcagatgcttaagtctcttctataaaatggtgagtaggctgggtgtggtgactcacgccagtaattctagaactttgggaggtcaaggcaggtggatcacaaggtcaagagattgagactatcctggccaacgtagtgaaaccctgtctctactaaaaatacaaagattagctgggtgtggtggtgtgcacctgtagtctcaactacttgggaggctgaggcaggagaattgcttgaacctgggaggcagaggttgcagtgagcctagatcacgtcactgcactccagcctggcaacagagtgatattccatctcaaaaccaaaacaaaacaaaacaaaaatggaatagtttttgtataaagcctatgcacatcctcccatagactttaaataatctctagattacatgtaatacgtaatgcaatgaaaatgctatgtaaatacttgttatattgtatttttaagtttgtatcattttttattgttgtgggttttgtattgtttctttctgaatattcttgatctgctgttggttgaatccacagatgtggaacccatgaatatggcgggctgactattatgactgtattcttgcagttcatggaatttctttaagaggatttttctaaattttttgtcatcattttattgatctccctttcattagggtcaatttttggagctttgtcagtttcttttggagatgtcatgatttcttcctgagtccatgtaatccttgtgtccttgcgttggtgtttgtgtacttgagataacaaccttttccagctttcacaggcattctttggaacagacccttattatgtagtttaacctgcaattctggttgggctagctggtaacagccttgggcaggcagagcttattttggagttctctaaatgtctggggtgctgcctttaccttgaattcacatggggcagctggctggactgagcttcacaatcaggctgagctgctggatgggcactacagtagcctcagatcaggccagggtgtgttctctgctcaagtggtaccactatttgagttctgcagttggccagggttgtgggaggggcctcaaagttaagtggagacactgagatggacaagaccagatgctatgcacaatggaaatgcatggttgaagttttccttcctgcctgtgtggggccttagggtgagttaagtgttgaggttaagtgctgtgtaaactttccctctgctgtccctgctcttcaatgaagtttgctgcattggttgtctccctgcctgggtagggtcttggggtaagctttgaggtcacaccaggtgttgttagactcccaggtgtggcacaactagctttccattttgctgcaattccctgtggtggttgttgtcctccatgggcagggccctcaggtagagtccaaggctggtcctggattgtgcctgtctaggaattcaagccaggtagcactttccacctcttccaggagtgatcagctcagctttgcctgtgagctacactgttagctggtacctctaatcaggtacctttgctgccaggtacacaaagctaccaccaagatctgtacactcattgctttgtttccacctgaccccaggtggtctagttgtgctgtattccgctgtgttccctttgaggtgagaccagagtggacttcctaagaagcatcttggaatgctagggaagctggatatttgctttcgggttctcttttccctctgtagaaaccatggtttttgggaaatcccgtctgtgaggccctgggccaacttgagggatggggtggggcaatgttgtcaaagtgagatagtttctctcaccctttccatgcggcttttattccatgctgtggaccacacaagtgactctgacttattcctaacttggggagttttcaccaaggcgttcttgtctgtggatagttgctagttgaactttttgtggggtaggggggtagtgaaacctgtgacctcctatcccaccatcttgctgatgtcgtctgaattctctttgtacattagttttgtgatctaggaactctgaactctcttattaattctaatatgtagattattctggatttttaaatgtaaacaaaaataccacttctgaataacagtttggatatacccttccagtttttatggtctatttctttttctcgacctatctagcttactagaacctccactgcaaaatagaagtagtgttggggccaaacagaagtagcgttaagggtacttcagctttttttccaatttgaattctactaatgttttacatttaaggatgatgcttattgtagattttctgtaagtactgtttatcaggttattatgaacattgtttcgagtgtatcaactaattttcctgtatttattgacatgatcttatggtttttcttttttaatcttttgatttgtgaactacattcaataatttcccaatgttaaaccaatctagctttcctagaaatagccaacttggtcatgatgtgttactttttaaaatacattatttgattttgttttaggtatttgtttaaaattttatatccatatttgaatgtaatttgcctatagtgttcatttttctgcattgtccttattggattatggtaccacagttacattatccataataatgagttagggaagctttccctctttatctcctttgacttagtttatgtaaagctgaaattatttcttccttgaatgcttgatagaactcacttgaaattttctttgtgagaaaatttaaactactaagtcaacttctttaattattataagattattcggccaggcgtggttgctcaaacctgtaatcccagcattttgggaggccaagatgggtggatcatgaggtcaagagatcgagaccatcctggccaacatggtgaaaacccatctctactaaaaatacaaaaattagctggtcgtggtggcgtatgcttgtagtcccagctactcgggaggctgaggcaggagaatcacttgaactcgggaggcagagattgcagtgaatcaagatcacgccactgcactccagcctggcggcagagtgagactgtttcaaaaaaaaaaaaattattcatacattctcatttcttagaagtcaggctgttatagtaagcttttttttctgcagatttattttattaaattttcaaatttattggcctaaagttgttcacacctatcatcttttttatttatgactatagcatctctcagttttattcaagttatatatttcagattttatttattagagaattgtgatcaggggagtttattagatttttcaaaggacaaccttttggctttgtccaacagacattttaggtatgtgaattatacctgttaattttgctcttatctattgtggtattagtatttttcttgtcagtgtcttctaaagtatgtctttatatatttaaggtattcattatttaactgatatcttggttataaataattatctctgtttttctttaattttgattttagtcaattttttgtttataattttgtttattacttttgtacttagaatcatcctttatttagaaatgaaagattaaaaaaatttttttaacattagttttatttgtatctctaactgtaatcaaactatgtctctgatctggaattttattccgacctatgatgttaagacttcaaatctatggttgaaaattccagctttatgatagaatcacctgaagtgctttttagagacatttgcccagttcccttcagttcccttccgcactcactaaatgtaggggtgggatggggtggtaaaatctcagaatatttaaaaaatatatatcatagacagttcttgatgcacaatcaggtttggaaaccactgatttaaatatatttattttccaaatagctacctgattgttccagcgccattcattgagcaagctttttccttattactggtttgggattcctcctttaccatgtgtgttaaactccagagtatgctgggggttgttctgtggctcattggttctattagcagtcttgtgccagcgtcacagacttagtgattcaaactttatgacatattttaatgtttattaatgctagacctccctcttccttattcttattttttaaaacgtatctcatctttctcctcaaaaaatttaggatatttttcatttaaacatgttattcagaacaaggttggttgtatgtgatcatcttttccatgtcatttccactgctttgttgttaagataatttcttctgtgtgtaaacttgtgttgttacataattattttctttgagtttgtgagaaatacgtaatttccttgattttctaactggctcttattggtgcataggaaagttcctgattttctttcagtagagtttttaaagcgcactctgccttttggctctgctgagattctttcagttcctggattgtgtctcttgtccttgcactgactgtgccattcttccttttatttggaatgttcttcatcactgcccacactcccacctgtacctaatgatttcttaagctttagatttctgctgaatcatcccttccccaggatgttccttcagacttttcactaggtcatgacctcctgctgtgtacttcatcacaatctacatcttctgttacagtgctctgtttcagtgcaatcactcttccctgctggattgtaaacgtcttcaggtccaggaaggttttttgttttgtttaagtctttaaaccatctgagttaatttttgtctatggtgtaaggaagggatccagtttcaatcttttgcatatggctagccagttatcccagcaccgtttattgaatagggagtcctttccagactggataaaggtggtacatatacaccatgggatactatgcagtcataaaaaagaatgagaccatgaccttcgcaggaacatgggtggagctggagttattagccttagcaaactaatgtaggaacagaaaaccaaataccacatgttctcatttataaggaggagctaaaggatgagaacacatggacacatagaggggaacaacagacactggggcttactggagggtggagagtgagaggaaggacaggatcagaaaatacaactaatgggtactaggcttaacacctaggtgattaaataatatgtataagaaacccccatgactcaagtttacctatatatcaaacctgcccatgtaatcctgaactttaaaataaaagttaaattaaaaacaagatttttgtttttgtttttgctgttgtctccttaatcaggagagcagaccgcacacaatgggtatttaataaattgcttaaatgaatgcatgaatgcttgcttcagcaacataactttggcaatgtggagattgtggtggaataggagagaagatgtagagaagccaaatgaaatctgttccaacttttcaggcagaggaggataagcatatgagctaaggtagacttactcaggatagagggtaagggttagctttcagagtgaagaggtgtgattggcatcaattaggtgctgactggatgctggcgagagagagagaaccaggtgaatgggatacctctggaggagctggccttgggaagaaaggtgagggaaaggtggggacatttgctttcctccctgtacactgtgaaggtaaggcatgagggagaatgcccctcagaaactgttgtttgcctcaaaatccaacaaagctctttttaggtttgaaaagaaagcagttcttttttgctcattcatagaatacctttcagtgagttgcttctaaggacggtagcagagtttttgctgtcattgttttgttttattttttggtttttagacggtctcactctattacccaggctggagtgcagtggcacgataagggctcagtgcagcctagacttcctgggctcaggtgatccttccacctcagcctcccgagtggctgggaccacagatgtgtgccatatgcctgactaatatttgtaatttttatggagatgggatttcatcatgttgcccagatagttttaaactcctgggctcaaatgatctgcccgccttggcctcctcccaaagtgctaggattacaggcgtgagccactgtgccctgcccttggtagagttttgaagacagttgttatgatgttaagtcattgcactgagtcactaggccatcctttggctttacaggacataaaatatgggagtttcatcaccagacagtgggcggtactgggtttcctactgggtggacagtcctgctagtgggagagttctgtccttagtctgtgcccttggactgtagatatagacatagaaggtcatctccctttatttcgcctttctgccttcattgtcactggggagacagtccccccaagtcttcctgtgtgtgacgctgtgcaggtggtacatagaaatgcccatcagtgatacttattttgatgctgctgtgatcctgagaattttcccacttataggtgctctctttgggatatctgttggcattcaactgttttcaacagaagtctccaaaattggtactcatccagggttatgttaactgcccagtgtaccgaagggtgatgtggacaggtggaaaaagactgggttaatctcttagtgagactaagtgtttttttacaagtggttggttgtctgagggttagaagacttagaagagttttacattctacattgaggaagtaggcactcacccatggtgggtggtctgatgtccttgtttcttcagtggagttcttttttctttttttcttttctttcaagacagagtctcactctgtcacccaggctgagtgcagtggcacaatgtcagctcactgcaacctccgcctcctgggttcaagcaatcctcctgccttagcttcccaagtagctgggattacaggcatctgccaccacgcctggctaatttttgtatttttagtagagacagggttttgccatgttggccaggctggtctcgaactccgacctcaggtgatccacccacctcggcctcccaaagttttgggattacaggcgtgagccaccacacccagccatcagtggagctcttaatgtcatttagaacattattattgttgcagttgaactggagatggtaggaaatagtgaagttctgcagttgttgaaacaagatgctccctcaactgtgctgttccccacagtagagaggtaagacactccagaggagttgatggtcgagcagctatctgatgcctctaactgggaatggtctcacagattccttactgaccttaagcatcagtagtttgcttcccaagcttgtggccccaaactaaatctctttaaaaaaaaaaaaaagcaaaaaacccgaaagtacatgattagatcttgcaatacaattattgacaatgtattttctgtagtttaaatgaatcacttataaaactttagtgaatgggatacgtaccttatgtggttttagaaatattcgtgtgcaaatgggcagaatgaattggagttcaggtcactttgccaacttgtgagatgtcactagatttcaatgtatgtaaataaacaagctcgtctttccaaatacaactgcacttgttatttccaagagtctttcaacaaatgggataggaattcacaggcagggtcccagtgcctggttgaatctgactccccctgtgtaaccttggacccatcgctgaaaccctatgccttcgtgtcctttttgtaaaatatggacaccatcagtactcaggaacaccatgaggaccaaataggtttacacacgtaaatgcatggagaacagtagctgacagtgctcaagtgctcacattagcaaaatgaagtgattccctagtgaatcacactattacttaaagttggatttttttttgttttttgaaatggagtcttactctgtcgcccaggctggagtgcagtggcatgatctcagctcactgcaacctccgcctcctgggttcaagtgattcttctgcctcagtctcccaagtagctgggattacaggtgtgtgccatgatgcccggctaatttttgtatttttaatagagacaaagtttgaccatgttggccaggctggtcttgaactcctgacctcagatctgcccacctcggcctccgaaagtgctgggattacaggcgtgagccaccacacccagccaaagtttgatttttttaaaacttaaaagtcccaatggattcagatcattgagatttgtaacctattattaacatacattttctggctgggcatgggaggcagaggttgcagtgagctgagatcgtgccactgcactccagcctgagcaacagagtgagactctgtctcaaaaaaaaaaaaaaaagatatattttcttcagctgggtgtggtggctcacacctgtaattccagcattttgggagtccgaggtgggtggatcacttgaggccaggagttcaaaactagcctgggtaacatggtgaaaccctgtctctactaaaattacaaaaattagctgggcatggtggtgcatgcctgtaatcctagctactccagaggctgaggaaggacaatcgcttgaacccaggagatgaaggttgctgtgagccaagattgcaccactgcactctagcctgggtgacagatcgagactctgtctcaaaaaaaaaaaaaaaaaaaaaaaaaagacagatagttttcttcattaattcgggatatatattgtccaggggagttggggaaaagcctagacttaagacctaacacactgactttataactccagaaagccacatgaaatgagtttggtgttcaggtcaggaaaccaaagtgcaaaataagaggaggagctgtctgtatcctcttatgccttgtctggaggtgtgtaggaggctgagaatggtttagtgagcacattgctatacatcagtgatctcttccctcctgtctcagatactgactctgtgccccggggtccctctccgtgaagcaggagttacacgctcagatgcctggaggggtgagacagcaacataaatgtctttcatgggccagatggggactgtcaccagcagcagagcatgttcagccactactcattgccaagcagttgtttcctgtaggaattcaggcccagtgttccagaactcctgatttttcaagaagagacagaaatctgtactgcatagcccaaataaatcttggattagatgctggctgcaaccacactagtttgcaatttttgtaatgggaagaaaatatttatgatctatgtaacacacaaatgttggtgttaaacagatacttttactctagaatctttgggtaaaatgaagtctgatgaccttgttaaaacatattatgtaatgcttgactttggtcattcaggaaatacctactgtgtgcgttaacacgtaatttagtacatattttctctttaaaatgagcagttgctacaaatgaaacctggcccagaagtagcagattgtcattctgcaaaatatttgggagacctgtcttttgccttttaggttttgttagtttgatggaggtaacgttacttttggttcttccattgtatttaattgacagtatcatcttctaaagaatttcagttttacagattggagtagtgaactcagggaagcattaaaaactagtagaaagatttgagtagattgggcaacttggcaccaaggccactggtagggacgtgcacactcttttcttaataacttagaggtgatgaactcctgattgattgcctcagctaacagatatttggctgtcactaaaaattatctaagttgtattacttgaaaacttagaatttaaaagtgttaccatagaggcagatgtgcctctagaattacctgtgtccagaccaccaaaaatgaccagacattccccttgcttcatatgagtgactgctacttcttgactttttaaagagttagctttggccaggcacggtggctcacaccggtaatcccagcactttgggaggccgaggcaggcagatcacctgagatcaggagttcgagaccagcctggccaatatggtgaaacccccgtctctactaaaaatataaaaattagccgggggtggtggtgcgcacctgtaatcccagctacttgggaggctgaggcaggagaatcacttgaacctgagaggcagaggttgcagtgagcagagatcgcaccattgcactccagcctggatgacaagagtgaaactccgtctcaaaaaataataaaagagttagcttcactttgtttgcttttcctatcttccagataaaattatcaagagattcagtcacagatttgcctctgctttcagacactgccaaatccagagcaaaaccatacttctctgaactttccccaaaatcatctaacaagagcccaaattccctcctacagctcttttgctcagagccaccccatagtttcccacctgctggctccctgattacaaagagtcaataaactcaacctggtactactgtagtctgctcctggtgagctgtggatgaagggtattgctacctaggtaagatttgatgatattattacaccattatttacttgttggcatttgtgaaatattaaaggtagcagggcctatcataggaggaaaggaaggttgatggtaaaaatggaatgatctatttcagcaaaagctgcctaagaaatcgtctccctcagaaggttatgtatgtgcaagctcttcactccctggaagagccagtgagtcactccaggcagtcttgcaaacggtcgtttgattcgagttacagatagtaggaggtgaccctttgaaatctatttagaaaaagttctttctaaaagctatcgattgtgctgattatgatcatagcaggtttcaacctgctgtccaagtctggaactttaggcaagttaagatcaacaagcactctgcgatcgagtttcatttaattagagtttgctgccaagtcaggttttgaggccaactgcatgccaggcgcctttcaatggttgtctgtctgagctgggggaacgttggaggatgctctgccctttctccagtattaaccttagaccaaatcccaggggcttgccctgagataagctatctctacaccactggaaagagaatgctttgctgcaaatgcatgaaggcagagcaaagatgtaaggcaaataagtgggaaatccagttcggtaggcttttcccaaaagcgagagaaaagcgttcgtagtcctttatcaggatggtgggggaaaaagaaaaagtaagctgacttttattttttcaagtcactttcctaagaaacttgtaaggacctctctaaggcactgctatctgtctttgtagggcaagcgtgaagctttcccttgccagctttgtgatgtcattgaattaataatactgtaaaggctagatcagaagtcaatttggcagctgtgcctttagggaaatttttgggagagtgaccttccatttctaataagcatgttattacatttagaattaaattactaagagccaagctaccctcttgaatttgctattagccattttttcccttttatttttaatgaactagaacaagttgaagccagttgtttctattagtaatagtacacagtaagaaaggaacaaaaaatcttttactatcaggccctttatgttggacaagtttagctcttctaaatatcagaatttgtgaaagacttccacaaagtctatttcttttttcttaatttgggtagagtgggagaagccagtgggttcctttcaccaattttatatttgaatgcctcctcatgtgtgagttttcttccttaaagtgagaaagatcatcttcatttcaacgtttgtgtgattctgaaattcatgtggaatataaatgggccccaaagtccaatggtatattctgtaacaatgcacctacagagtatttaacccatcaaccactagagcccaatttaaaacaccagtccttaaggcagggtggtacccgggctgatgtaaatgaatagacacccagagggcagttgagaaatagctagcaagcaagttggatcaattttaatatcaaatcacactctcaaataagacagaagaactttttacgaatgatgttggcagagagagatggcagtttggagccaaaatttaaatcccacactgtaaacctaaaacaaacataaaagggtgctccaggttaactaaagatgacaaattattgaattgtggaaaacatagaaggaaaaaaaaaagagagtatgttcagatatgaagcaataaaccaagtcacaaagctggaaatattccctcattaaacaatacctctttaagagcaggggctgtcacaacaacttggtaatattccacacatttgctaaggtaaattcaacaatactatacgtggaaatgctgctactggggatcccggttaccccaaaagggactctttcctgtttggcttcatgaagacaatacataaaaccaaaagtgagtgccaagcagtgcagactttattcgatggtcatggaatggagaagtgggagcgtagcttgcatatcaacaactcagctcttgagaactgggaagttacagatataggggattcttcattttaataagcctgtaatgatggcccatttgtgtctgtgttcacacgtgcgtctctgagagacagagacagagttcactacatgtgggtatggtatttagattcctctattggaatgcaggttccttgaagctcaaggatattgtgatgcacaggtgctctgacccaggaacacagcctggcctgcctatcagatacggaccacaggaaccatctgttctactactcttccacacccaaaaaacctgccactgccgaggctacccctaccaagtctaggtgtgtacattagcttaaaataattcatggtattattaaaggtcaaaattatttctctctttgtacctttattgattccgctgatattcatccatttgcttattgactggtgttttcattgtggtagagccacacaatttttgtttttgattgtcattacttatatagatttttgagaggaacctaagattgtttttttctttcttgctcattaacttgtaatatctcaaatatatacttaataaagtaaaaattgacttaagtaaagggtgagaaaaagattatgaacttaagaaggattaaaaccaatttgcatagctctggagagactgtctttccttgtattacttggggaaagcaaaaattaaaagagatgagatctattatctgaatcatggatagtgtgacctacccagagtacctactttttaaccttccagtgggtgttgaaatctgattcagcacattcttggagagtgatgagtaaatttgttgttatataaagatttttcaaaaataagcatcggattcaaacatgagtagaaaggatgagatgttaatttaagtgattatgggaagctgtgatttatacacatgaaatcattcatttagagatgggtagtaagaacaatgaggatcttagggactgagtatctgtttcctaggacactagagacagcattaggtagtgattaacttaagaattctgaagtgtgattgcctagatttgaatcctggttctagtcctttctagctctctgaccaggagcaaattacctaagctgtctctgcctggaccttcccatctgtaaaatggtgttaataataacatctacctcatagcattattgtgaggataaaagtgagttaatatatgcagatttctagaagagtacatagcatattgtaagcgctgttatacacatttactctcattacttgccatgatgagtgtgcagaggttaaccaggagacaaaggaagctcacaccccagttgttttgtgggctacattcttggcgatgttttatcgttgcccctgataatttccccatttttaagaaaaaagaattcataggcttagcatgtggttgatttaagcctaacttttgactgattctatatgggattctgactctctgattaactttgatgttctaactttacctagcgaatattttttttctttattttatcgaacagggaagaggtcttttgatttttggattatttggtataatattatattcttgaaatcatcctgtgactgtcaaaaagctgactgtaaatgaacagtgagccactgcagacagaaacaattattcagggaaacataaattcataatcactgggcctaaaatgaattagtgagtaatccaatctgggggtgagaaatgagcccttggcaacattgtttttaggctacagatggtccttgaaacactattagccggtggatctgagcacctgaaaggtttaaggaagcctgggtctgtgctgaaggtgtctttgggtaaactgtcatatttgcatgcagcatccttttagaatatcaatgagatctttatatgcatgtgttatgtcatttccaagcaccctgtcagtaaatggatgggtggcatcagcccgaatgcaaaggaaaggggttcatctggaactgaaatagcagaaagggagcaggagatggatatttgatggctgcccttccctgtgcattgtgtgaataccactaggtgatcatctcagggcacctgcacaggcatctgaaatgcagtgtagaggctctgcttggcagatttgaggacattaaggctcagataagataactatcttggcccagatcacatacgtgggacatggcagagccaggattcaaattcaattttgaataattccaaagccaatgcagcacctgaatgcgtaggtttaataaaattcagcctaatccttctgaaagttaattcaatgcaggagtgactttagcatcaatattaatttaattttctttcttataagttatttcaagtttgctgtttccctacagtttgaattgaactttttcttcgattgctgggcaaatctcatttatgagtttgcagatgggagaggtattctttaagtcagctttgcaattaaaatgaactagagtacaaatgtctcaatttaaccttgacacctgatgtaatattcacacggcctcatcatccatcatcttttgtgtgccactgaggtgcattgggccactggcttttatcccatgattgtagagttgcatccgacattatctgtttcaaggatcgcagaccagctactttttctgaactagaattctctttgttctagacctgttgtttgggtgatatatagagatgaagcaatcttcgacctgattactgtctggctatagaactttattgtatcccatagtatacaggactgctttgagttttgcctctattctagccatttgctgagaagaaagacatttgtggaggtctcctcaataggaatttttattaaccataagtgatttaaaaccattgtcaaacctgtaacttttaagagttactgtgacagaatgaggggaaaatattctgaagtttaattagaaactatagaaattagacggccaggcatggtggctcacgcctgtaatcccagcactttgggaggccgaggtgggtggattgcttgaactcaggagtttgagaccagcctgggcaacatgatggaaccccgtctctacaaaaaatacaaaaattaggctagtgtggtggcaggcgcctgtaatcccagctcctcgggagcctgaggtgggaggatggcctgagtctgggagggcaacagagccagaccttgtctcacaaaaacaaacaaacaaaaactgaagaaattagaagatgaataatggctgtggtaatttactttcttgtaagtaaaggtctttacctactttacaagaaagatctttacttacaataaaataagttacctgtaaatggccttaaatattgattaggttgtaagagagaatatgaaattagataaaatgtagcaatatttgatgtcatcatttccttcctcacccacgcctcttctggagtgggcagttggtcacatgatcttgcccctcttcagcgattgcactgtggctgttactgtcaggagatgcccgtttgtaggtctgctggtagaagtctgagatagactggctcagagacaagctgtaccagtaagaacgccctaagaaactgttcaagccagagagagcagttgccagcgggcagtggttactggagctggaatgccagatgaagtctgatgggtttggctctgatgggtcttgtgcatccaaaaccaggtagccagaaggagccagttgatcaagcagatatagaaagatccccagagagaagcagaggtatcatccaagagatgtgaaagatttttccacatcccaattgctacctggattcctgagacttggttttcattttcttctgtgaatctagtgaccatatacctttttccttgcggtaacatgggacataactgattttcttgaatgcgagagagctttaactaaaagaagattgacatttaagacaaaatgaaatattgcaaatagtcaagaagatctacacttgggtccagaatgttatagaattaagaaaataactttctgtggcatcagagattgaaaaaaaaaaagccgtcgagaccaggagcagtgtggctgtgaatccttccagagcccagatgtacaaggcagcagaagcaacaaaggctgtggccagcaacgaaggcagagtccccggtaggcggaggtccccgtgcacagtgtggtgcagcagtgaacccaagattttccttcacagggcaggggaactatttcctaataagcattggcattcaggttagtaaccagttgataggattatatcaacctgtctctaagtcaaaacagattattcaacttttttgagtggtattttagaatacataggtcaaaggtgggcatggtggcacacacctgtagtcccagctacttgggaggctgaggagggaggcgtgcctgagctcaggagttcaagtcagcctgggtaacatagggagatcctgtctctaaaaataaatattaaaaaagaacatgtagatcagaatttggatgacttttttttcctcaggtgcagagatggtaggggcatactttcaatccctggtacatgactttctttctggtctgcttagcaatatgtgtgaaatgtggccaaggatatgggacttgttgtgcctgtgccatataagagcctcatccaaataagtctgtacctctgtcttaaattccagaaaccatggatgcatgtaacaagcatattgaataggttctgtaacccagagcttatttgtttttattattattattattttagaggtgggggtcttactatgttgctcaggctggacttgaactcctgggctcaaggaatcctcccgcctcagcctcctgggtagctagctgggactacagatgcacaccaccactcctgtctcagagcttgatttttaagccttatatatacttataataaaatatgttcataatatattttataaaatgaatatataaatatatatttataaaatgtatataaggcttaaaattttaacgttaagaatgctgtttctcttttttagtttctactggccaatggaaagaacatcaagggattgcaggccaaatttataaaatgtttacccagggcaatgctagtttactttcatgtattcaagtattgtcattgtataatttaggtatttatactccccgggaaggtgtttcttggaacattttaattattgaatcttaagaatattagtttttattaattcgtcatttatttgtttatttttattttttatttttttgagacctagtcttgctctgtcacccaggctggattgcagtggcacaatcttggctcactgcaacctatacttcccagttcaagtgattcttctgcctcagcctcccaagtagctgggactacaggcacctgccacaatgcccggctaattttttttgtgtgtgtgtgtatgtatgtgtatatatatatattagtagagatgatgtttcaccaagttggccaggctggtcttaaactcctgacctcaggtgatccacccacctcaggctcccaaagtgctgggataacaggcgtgagtcaccacgcccggccagaatattagtttttaaatgaatgattccaagctaagttttgctattggaaatataggagttaattatgacaattatcatttgatgttgtgggggctaaatgtgggtatttttggtgtttttccttttttttgttacatatgttaaactctgagtcttttgacaacaccaaaaggcattatgacaactgtatatacatttaactttgctttcagggagactagttcaaggtagtaaaacctcaaaatggatttgcaactgaattaaggttttctgagtagagataaggctgaggtagccaaaactacttctgctatctctttagaaaaagtacttttattcagtctgttcttaaaagaaataagtgtggttgttttcttttttaccataagcagaatgaaaacaaaattagaagtcattacttttttttgccccagcttactttttgttatggaggtaaaaattacataacataaaactaaccattaaaagtgaacaattcagtatatttagtacattcatgttttgcaaccaccacctctgtctagttccaaaacattttcattacccccaaattaaaatcctgtatccattaaacagtaactcaactctttcccctcaaaatcaccagtctgttttctgtctctatggatttacccactctgattatttcatgtaaatggaatcatacagtgtgtgctatggtttagatatggtttgtttgcctccaccgacacacacatgttgaaatttgaaccccagcatggcagtattgggaagtggagcctactggaaggtgtttgggttacgggagtggatccttcatgaatgtcttggtactgttctcccagtagtgagtgagttctcatttttaggagaatggattaattttcatgagaaaggattagttctcacgggagtcagttgttaactcccttaagacatcctttgcatttccctctttttgcacatatctgtttccactttgaccttctttcccactctccatctcatgttgtgatgcagcatgaaagcccttgtcagatgccagggacatgtccttgaactcctcagtctgcgaaactgtggcctagataagcctcttttttttttataaattacccagtcttagatattctttaatagcaatacaaaatggactaagacaatatgtgtaaccttttatgcctggctgctttcacttaacatctaatactgctttcttttgtgtttgatttttttttctagtgtacccttttgattcccttttcactgctttttctgtatactttttagttattttcttactgatttaccatgagtattacaattaatattgcaagtttatagcattctagtttgaaatggtgccagtgtagcttcaatagcatataagaaccctgctgctgtatagctctgttccccctttatgttatttttactaattttatctttgtatattgtattaatatagatttatagttattgttttgtgcacgagtcttttaaatcacctgggaaaaagaagtggtacaaccccaaaatacgtaaataatgaattttatgtttacctatggttacctttacctgtgattgttatttcttcatatagctttgagttcctatgaaatgtcctttcctctcagcctgaagtatttctctttagcatgtcttatagggcaggcctagctcctttagctactgtatatctgggaatgtcttcatttctcctttattttagtaattttgccaagcatagcatttttggttaagtttttttttctttcagctttttaaatattttaccccattgtattctgggctccaaggtttctgatgagaaattggcagttgattttattaaggattgcttgtgtataataagttgcctctttctttctgttttcaagattctctcttttgttattggcttttgatggtttgaatatagtatgtctcaacatagatctctttgagtttatcctacttggagtttgttgagctttgtggatatgtagattcatgtctttcatcaaatttgggagttttcagttataatttattcagatattctttctgcctctttatctctctgtttttcttttggaactcccatttgcatgtgttggtatgcttgatagtataccacaggtctctaaggctctgcttatttttcttcttttttctttctacttctcagtatgatttaacagtatataaaatatgcataggagtatcttcacatttgctgagtctttcttctgcctgctcacttctgctattgaacccctttagtgaattttttacttcagttaaacttttcaatttaagaatttctgtttgattcgtttttataatttctatctctttactgatattagctatttgcttatacattgctttctttatttcctctactttttttgtccatgtttccatttccatttaagacagttaatttaaagttgttgtctagtaagcccagtgtttgagcttcttggggaatagtttctgtcaatttatttttttcctatgaatgggacatacttttttgttttttggtatgccttgtaattttttttttgaaaactagttgttttgaatattgttatatggtatccctggaaatcagattctctcccctaaccacggtctattattgttgactcttgagggctgccatctgtttagtgatttttccaaaggttgcattctttactgtgtatcattactgaagcctctgttctgttgacatatggttactgacatttccattttgttatctcattggtcagccagttatgtgacagaggatttccttaaatgtctggaaccaaaaagaaaagaaaaaaacaaaacaccaaacatttttctagtctttgcagcttagttctgacctaagtcattccctcaatgctaaaccaggtcacccatgactctgccttagccttcacctcctgctgtgcagaacccacagatccaccagtggggcaaacctatggtcctctcaggtcttctccaagcatgtggcagtcctaggcatggatttttcaccctagcttccacagcgtatacattttttattccctctagaaacttccttcttagcctctgccttccctgctttttggtctgtcccttactagtttttattccctctagaaacttccttcttagcctccaccttccctgctttttggtctgtcttttgcttccccatccattgtccgaggcataggtagtgtgtgtcttgaaatctttcaacagatgccactgctgcctgaaatgccactgcagcccaagggagcaggaatgaaacaagtaccagcctctgtgcagcccctcagggaacagccaggcaggtcaaaatacatacctgcagtattttaagaataaggtttactttagctccctgataccagcaagccacactaggagggcaggccaccatccccatggctgccctatggtgctggggttagagcatggtgggcaagtgagagaaaagaccccagtgctttcttactcaaatccagctgcctttttcttcattcggcatattccttactatcataggtttttaattaactcctagagttctgaaaaagctggttgtgtcagtatttgttagcttacttattattttagttcagggaccacttgtttgagtgccctactccaccattttgtatgatgtgatttggtagttccttctgaaggaagatagtcccactgcatagaaatctaagtatgaatattttcaatgaaacatgctgttattcaggcagccttttctgcctgaggttattgaatcagacgttctgcagtctcttgccctggtgttgagccctgggagctggatggagtctgaggtgggttgttctcatcctcttcccccttgctgcaggttccctctctgaatttcctggcacaatgccctgctgtcttaaatgtttactaatatttgctaaaaaaatgattatttcagtttagctatataaggtgaaaatggtttcccattttcagaagactggtttaccaccttttggctggcacacctgtatagctaacataaatgtgatttaaaatttaaatgaatttgcggagcctgaaagagcctcttctttgactaccctggagaaaaacaggtagcaacactttatgtcttagatgatgttcctcctgatgccttaattagaaacttgtagatttacttgcagtccagctatgtgctcatttgcacagtttagtctaaaggctttacctagagtcacaacttgattgttgtccaactcacactgggccactaacactgcaagcttgacctatatgtgaaatcatggagctggttcctcatcaatttcatgactgaaaagtttgtttacttcctttcttcttgttggcagttctgttaagtgtcttgcttcagctgtgtctgcagcctctggacaggtatagtggagcagtgttgcgggaagtcagggaccccaaacggagggaccggctgaagccatggcagaagaacgtggattgtgaaaatttcatggacatttattagttccccaaattaatacttttatagtttcttatgcctgtctttattgcaatctctaaacataaattgttaagatttcatggacacttatcacttccctagtcaatactcttgtgatttcctatgcctgtctttactttagtctctcaatcctgtcagctgaggaggatgtatatcgcctcaggaccctgtaataattgcattaactgtacaaattgtacagcatgtgtgtttgagcagtatgaaatctgggcaccttgaaaaaagaacaggataacagcaattgttcagggaataagagagataaccttaaactctgaccgccggtgagccaggcggaacagagccatatttctcttctttcaaaagcaaatgggagaaatatcgctgaattctttttctcagcatgggatatccctgagaaagagaatgtgtacctggaggtaggtctctaaactggcccccctgggtgtggtcgtctcttatggtcgagactgcagaggtgagatagactccagtctcccatagcgctcccaggcttattaggaagaggaaattcccacctaataaattttggtcagaccggttgatctcaaaaccctgtctcctgataagatgttatcaatgacaacggtggccaaaacttcattagcaattttaattttgcctcggtcctgtggtcctgtgatctcgccctgcctccacttgccttgtgatagtctattaccttgtaaagtacttgatgtctgtgacccacacctattcacacactccctccccttttgaaactccctaataaaaacttgccggtttttgcagcttgtggggtatcacgggacctaccgacgtgtgatgtctcccccggatgcccggctttaaagtttctctcttttgtactctgtccctttatttctcaagctggccaacacttaaggaaaatagaaaagaacctacatgaatatcggggcaggttccccaatagagcagcgtactattttgctcagtgggggacactgtaggtcatagagtccatcttggatgggtatcaacttgaagttagtgtctgcctgcctgcctgtctctcatatgtttgttcggggggcctatctgtatatatacttttgtcttatttgaagattccagtttttttcatagagaggcagtaaaagatgcccaaggatgttctgactccctttcaacttatccttgtaaggcaccatagagaaagtatcttaggtcttttgttttttcagactgtggcatcatcagcttttctccaaagtgctggctgcctctcacaacatcactgcagtgtgtgttgtcttgctggcagagtctttccatttctctttggggtgggaatggaggcaggaagatattcttttctagcacatttggcaaggggagttcaattcaaaactctaaggaattggtttttcaaatctgtgccacctttgttctttttttaaaaaaaggacatttaatatttctcaagtgcaaacttctcattctggctgctatttattttcttcattctctaaatttattctgtcagcgtttctgaagctgcctctgctggttgccaggcagtggctttactccttttggagtaaagatgaatctgaccccagggtaggatcaaaatctgtaccagtaggtcccagttctggctttttgagctaatatagtcaatctaatttcccttgcatgtgatagctattaaaacattttaagactgtgaacatgcttatttgagaccggaagagactgggtcacagaggaagaaggaggcaattacagagtgggagtgggcaggctttggtggtttggagactttgggagacatgaataatataagggattggtggaaaagagggagggagcagggtagagacaagaacctttggtcagcttgtattttttagggtcagtattctctggcaataatctctccagcttctttggaacgaaaacatgaatagtgtattagattaaaaatcacaggactcccaggctagcattaattctccattcaaccctgcctctttcctaccatgatggacaaggcaaggagatgagggacagaatgctttctcctccgcctctcactgttcctgtgattttcagattgtactattagcagagttctgcagacactataacagcgaatactgatgatcttctataaatgtatgtggaattctatttgatgattcttgtttaacgccacagaaattttggataggatacaagaagattacccatgatgtggcaaatgagaccagttgggatagctacaaagcagagactctgacttctgtatactgcacaggaaatggattctcctaactgtcctcctgtcatgtatgataccaatgtaattatagaaatagaagtcaaacatattttaacaaatgtggtactggaaaatcatacagctctactggctaattttccttaatttcatgatgttttacaaattggcatttattgctccctgtctacgctgactcgtttctctactaagcttgcttttttcctaccccagacacagatctgatcataatcttccatatatcccacccaaacagctattggtgcgtaggaaaaatggtttaggctgataaagaatgattcacggcaatggaaagaaagccagccactgaagtaacttataaaatgagtccagtaattcagatgtatttataattttatttgcctgtgtggtcctagttagacttggctctgcacagggaaaggaggggaaaaagaaacaattttaggggaaaaagtgaaagatggtacaaaaatttggtgaaaattacatagtccatatgccgctttgtcatcattaagctaatgttttcaacaagctgttttttgtggttcagcagaggaaactcggcagtgtgattgcagtcatggaatcctacctggctttggttccaccatggctacatcctgccataaacggagacttcgggaaggtctaggaaatattgtggtgttagtgtctttagttaaaagccaaccattcaaggttgtctggcccaaagtaacgtttccacacttagagaagccacccaacctctgcccctgtttaggctagtgtgaacaaattcatcctggccatgttgtcttctcagaactcctatgagggtccagatgtgtccccccccgaaaactaaatctataaggacctttggctcttttagctgctttattttttgttttcaaccatgtatgaaagtgagtgtgcaaaataggcttttcaataaattatgcatccttcaataatatatcgtttccattccagttagctttaggcccccaaaccagatcattaggtctctggaattggctgaggcaagctggcttttatgtctctgatgcctcttggcccatccttttcaccaagagaggattagaatggattcattgcaagggctgcagggaagtggtgtatttagtgctttgcagtgcctgccacagacttgagtgtcaaattcctcctttctctaaagagcataaaattcccatcagacttggagagctaaatgcaattgaaacattgaggggaagagtgttccttggcacattttccccacccggagatcctcaacagtacgtttcctcccgtgtagtgactattaggagtgcaaaacctgaatactttttcaaaattagaatgaccacaatagtaaataggacagaatgggagtggtattgaagtaagaatttgcttatagaattaaaccaaatccaaattatttctcactcgccttcaaaagataattttgagcttttgaacatagcagatttgctggtcgtgctactgagtagtttgaaagcaaatttcagtcaccaaaaggacgtaagtctagaaggaccctttacttctttctgttgtctgttttaatgggtgcattctggaaccaaatgcgagtcatcctgttttatctttttccctttgcccctaagtttcagttgcttgtctgagtgtacagctagattgtttgccttttgtaaaggtgagcatatgaagcagacatggtggagccttggggccctagtagtgcagaatttttggaatggcagcaatgttacctctatagtgtcagctttgttctttggatttgcattgcatgacccgtaataccaggtggaggaaaccatgttgaatttctctgggggccactgctcagcagttgtcaatctttaagtgcttaaaaatgtctagcattcttcctttccagagggcatcctgtgtttacacatttacgccgtcaaaatcaagcctagtggatagaggagttgtagaacagggcagacagaatcaaatcaggcctggtgtagaggtgtaccttgggaaatacctccagttgttttcagacacttgcaaatatgtgtaaatgataagttttatcagatagctttttattttaatattttgggaaatgggataacacaaccttttcttgtgaatatcttttgttcttttaatagaatgtgaaatcattacactctaagtagcaagacaagaatatcatgtaaacatgttctggaagatctgggctttaattttgttgtgattagtgtatttcagagagtgaacatgtttggaagagtattgaaaatactctcctgggttgtgccggtgttcatgggttggacaagctcacctttgacaggcaggcttggatgctgctgatggagttacagagagggctttgcatgtgaaaaaatgacattttaagttgaaatgccataattaatcatttccccctttgattcatgttatagaaaccaaattaacataattaaattatttttacaatcatatattaatagaaatgaaaaatactcaaggtattggagaccccaaatatcctgacttgatccttattctatacatgtcaaaaatacttacatgtaacccataagcgtgtaaaatattgtatcttaataaaagaaaaaaaaatgtatatgtatattttaagaatcagtagtgccttgaaggataaatattctaataggtaggcagtggttaactgcaagtgatctgattggtggtctggatcagaaaattggaatttcaaattagagaatatgtttctgacttgacatcataagcatagatgtctttaaaatgcttttaatattcacaggcatttggggaagaatgagctagattcttttttccctcatctagcttagatatttctacatttgctatcctcagtacatcatatctcagtagctcttcccccggcttgagttgtcctggaaaggtgcagacctcatgagaggtggaggatggcagggaaataaccaggtcatctcaggggtctgcagaagggtaacatctaattgagttctgagaccacacgtgaactctgcctcaggacattgcagcccttgtcctggccacacactttattgcatgtgagtgccccacactacccaaccagctcaaccagcttcactctgcctcacgagaaagctcttattttacctgtgccaaagtaaaaaaggttgaagtttgccaagtggaaaggaaaagacagacaacacattaagtgattttttaaaaaaaatttttatatattccttctggaaactgtttttctgtttgacttgatgaaagtatacatgtatacttgtatacatgttgtagaaaactataacagagaatacaggccagtattctctgtagtcgattaaaatctcttattggtagagttattcaatagggaactcccaatttgacaagttaaaactcctaaacaaaaaggtgtcttatgttttgtagtcttgctcttttgaagggatttaggaaacctctaacttctttttttgtttttcttttcctagtgcctttgttattgggaagaggaatttttattttcttttccagaggaagggaaatctctgggccagatcattgcctgggacaggattctcttgctaaatgccctgcacaccatcttccatcctactgcagcagactcaccttttaaaaactcttctattgtggcatcagcttagtctagaagtctgctgcccactatggtctctgctagccacatggggctgtttaaactcaaattaattaatgttaaataaaatcaaggttttagttcctcagatgcactcaccacatttcaagtgttcagtaggcacctgtggacagtccagaacatttcgagcatcatagaaagttttattggacaacattgattagatccataatggttttcaatttctttaagactttaaatgtgaactctttagcctggcctgtaaacctgcccaaattttgccatctgtagatattgaatataatttaccagaagggagaatgcagaaggtagtcaagaaaatccatgttggtataactcatgtgagacccgggtggtggtggagagacatttaattcccttctgaagaaggcatggcacttggacagacaggaggtagtccaggtagctctgggataatgtgtgaacatgaagattaatttgaggagtatagaagattttgatcttggtgaagggtaaggtgaatagaggacaacgggagagagataggtggcctgtattctctgttatagttttctataggggactgtcttctcatggtcttcagcctgtgtttgaattcaaacatttcagtctcctttgtcctcaaaaagagaacatgaaggagtggattcactcatggcaaagcagatgggaacaggggtgttagtgaatagtgtggacttcagactttaaggaatgatgatgagagttagtggtccacagattctggaaggagcactgtggtgatctggtgcgaatgagagggggtgggggatattacagagggttatgaggcaagtaatacctttacagaaagtcaaattttaatgatggaaagaatgcaggaatgtaagaactttaagatgaacagaacatgactcatgatagctcagacgacccagaagatagagtggataagtaatagaggtgcaggtggttcttgatgacaagaacttggccttcaactctgtgtccctagcacctgtcaaggcacttgatgattaatggattctgttaaacacttgttgcctctgtggggaaagctgggctcaccaagctagtagttgtggagtatgggggaaaacagagttctgtgtctcaggcggtaatttcagcaacaagtgaagaaggcagataataggctggggagaagggtagaggcacttagtgacaggctggcagcaggtggaggatatggccgggagtattgctgagtttataggattaaaaggccccactggagagctgctgagttgattgaattccctagaccccagatgccaaggtaaatgccactggggcagctctagcacttttcaatagtgctgcctgtggccctgagagtgtgccagcaggtggggttcttctgaggcaggagggcaggactggtggagtcaagcagagggagccagctctgcaacacagctcctgggtggcagcttgccttccagcacacgtgttatgcagcagagacctggtaaagccttgtttggaaagacaactttggcagcaggatagctggaaagccctaccttggaaattagtcctggggttgaattgtagctgtgccactcacttgctccgtgaccttgggcaagtcagttcacctctaaggcttcctcataaaatgaggagaataattcttaatctccctgtcactggaggctgctttgtggaggaaagcgatgtatgtgaaagcatgcagtaagctgtaacatgctacaaaaatgcaagttatttataagttgggtttcaggggcaaagaaagacaactcagtgaagatgtctttacagtaatcactgtgagttaatgacaacatgaatcaagaatatgataatggaaaaattagggagacaacagaaataaaggcttctagtaagaattttaaaattacacttggaaaccaggtaagcaatgggaggaaggcaataggatgaaggagaatgaaggctagtaaaagatagtaggattctgggtttgaatggttgagagaatggtggcaacattaacctagaggcagaaagagggaaatactggaaatcaagatgataggctttgttttggacttattaaattctctgtactactggaacatcctgataaaaaatggtaacaggacattctggttgtaagcacagtgaaaaaattgagactgagtttggaagccagccaccagaagcagtgtttgaggttttgcaacagaatgttatcacccaggcagccatgtagcattagaagaaggccagggataaactttggggcagataatgcgatttgacttccttgggtgttaggtcttcctcaaggtaagcgtagttttcttactgcttgtatggtggccatgacacttatgactgtcagcactacatgtttatgtgttcatatttttcacatactttcaattcttggagtttagggattgtattaatcttgtataccatagacacctgaacataagctaaatgtctactagcacacagtaaagatttgaatatgttattttgaaataatgaatcagtgccctaaaacaaaggtggtcattgttaaggatgatctggagaggcctgggtgaaggataccaccctgggcccattccaggttagtgacatgaagagaccagttgatattgtcagtgtctttctcctttgatgctctatagattgagttgagaacatagattgttgattgcggattaggaaaaataggaggtcaaggggattaagacagcatcagttttcatgaagttcaaggtagttggagaggtgggttaagctgaggaataccagtctagagtgattcacagtagcttctagaacaaaacacttttgcaaaacaagacaggtggaattaaagtgggggcagaaattgaacaggagagaaatttcatgctctacgttcttggtgtgaccgtgctaattgtgtggcttttgtgggttggatcgcatccttgaaaagatacgttgagttgttgagtcctaaacccccctgcacagtatcttagaatgtgacctggtttggaaatagaatcatggcagcttagttaagatgagttcataagttgaggctttcatgcaatgattgatgttcttctgaaagaagagatgcacacatatagggagatcaccatgcgatgatggaggctgagatggaagttagctgcagctgtgtactaaggaattggcagccagtcaccagaagtggggaagagactaggaaaagatccttcctacaggtttcagagggagtgtggctaccttgaattcagatttctagccccaggagctgtgagagagtacttttctgttgttttaagccacccagtttgtggtacttggttgttgcagccctgggaaactgacaccatggctcaagggaagcagaaatgaaggtcatggagaccagggtggtagaatcatggatgcaatgctgaaaatttggagaacaacatggagagatagagtgaagaaaacagaaggggaatgttctggagtgttctgtagccttcatagctaactgctcttgtcgtcctaaggctccttgtacgtcagtctctttgaaagcaaagtgagaggcttttgccattgccatcaaggtgccctctacaaccatgtttgtatttatctcagcggcccaggcttgtcagttcctggcatttgggtttaggttgtacttggtgtgggcgcttggtttcttttagagatattgtaaaagggacactgtatatttaaatagcatggaagacttcaggttgaattgggtcaaggtgcttcccactccctgcacaaaagaattctaattgcagacaactcaatcaaacaatacaactcagtatatttttctgaagagagggaaacaattggaattgaagtgactaattccttttgcaaggtcctctaggaaaactagaaattctagaatggctttctggagaaaagtctttgaagggtttggggaactgtttagaaaaaagaaagcaaagaaaaatctgggttcaaggaaacagacttgacaatattgaggttgtagggagtgtccagatacccggcatgcttgactgtctctccctctcccatgactccagtttggatatgatgaaaatgaatgtttttaatttgttagcctggagcttctcctgcattggaaagtgattttgggattaatgctaacgttttagaagatttttcccatattgagtgtagaattaaatgtttgcgtaccccatagtgtttactttaatttttccacactcttcaggagttggcaggtatataattctggatgatagcatgtgctgtgtgtactctccagtcctgacgctgcagggttagggcattggtgccttttgttcagtccacgcagggaaacgtgcaggcagggagctggtccgagacgtctccaggcagattacgggaatggctgctcccacaataacaaaaaatggctcctggtggaaaaagaaaaatagaggtagtctgaacttgtggacaggtttgtttcctccttcttagatatgagtatttaatttttctctttttagctccctctctctaccaaaacaaaacagacaactctttgaaaacacctccaaatgatttatgtgccaaagatgtgtgaaaatgatcatcttagatgttgttgggggtgggaaacaaccctcagtggtttgttccattcttatctgtccttgaaaatagttgagaacaaacgaagacttgggactgactgccttggatgtggtctggtttgccctgtaactgacaagagtgatgggtccccgtcgagtgacggcgttggactagaacccaggctgagagagcactgcggtccttggctgatgcactgaagaaaaacgcgtcagatagaaacaaaattactgtgtatccatttctgtgcataactatagtggaagaaaagcaaaatttaaaaaaaacacaccaaaaaccccgcgatcaccattctctgtaattcagactcttttttgtagtaagaagtgccatgcagctttcatgaagttgctggtatctgttagccgcactccattgccatggcccatcttcttgaccttccactcttattgtgggtttccctgttaatcggatcgtgcctcccccctcctctgcaaacaccttatagttttgagagatgataatcaggcataaaatccttcccctgagtctgagtctgggacttcagtcaccttccagcctaagaggctggagcagcctggcatgctccccggcagctgtttttcttagttggtgcattgctttaattggccacagttctcctcatctgtcatgaagactcttaaagctcatacgagagtaattttctccacctcctttattgcgagttttctcttgacggggcacaccactgactctctggaaggcttctctgctcgctttctccagaaagccgttatttgctgagtttctgcaggctggccgattgagttacagcccgaagaatgttgaacctggttctcagctgcaggatgtctttccccaaagttcttgtactgctaggcctaccctgaggattcacatatgtgtattggtttacaacaacattaaagcatcccctgaactccccaccccgcctgccccaggtgggtagattacttttaggactatgaagtagtgctctcacaggggttggagctcagggttggcctgcagtataagccagttcccttctggctggtttcacatacatttatggccttcttttacacctaataggcttgctttgggttttcaggaaaaaattcttcatgcaattagggagagattctgtggtcatttaccataaaaggttgaaagctttaataatgtaaaacataaaacaaccccggaaagtaagcattaattggatctctaagtattgcatttgataagatatacacagagagtgaaagatcataagcagaaaaatgacttgctgatattacaatttgaggttattttagtaatggtgtataggatgaaatagaccaggaaacaacttggaaggaggggcctcacgttagcacattgcccttagacattaagcctgtagcagctgcaacatccaaggtgaggttgtggttgagactgtagtgagcgatttgtatgcagttcctacatcaccactgtccctgtggactgcagttggtcctcttgcttgttagtgttctagacacataagtttcttaaaatgcgtgatttcgtagtagagtcttataattctactagattttgtgtgtagttttatgtgtgtggactaatacttctgtgggtttcagtctacacatttgtattttattcttgtcattagagttctgaaatgatggttggcacgaatgaattctcatctcaactgaagtgccaggatgcccttgctttcctttaaccagtagggagaggtaggagccgtgcggaattacaaatggtggcttctgtgaaagcctgttcaagtgttgttcagagtttcaacaacaacaagaaaatgctatccaagccatcatttccttttttttttttttattatgagtctctagtcattcttgattttgtggcaaattgatggtcaagaaggccaagtttagcctacagtggtgtcttgtttggactgcactgtgaatatcgttaggtgggggcaggcactttccagttggccacagtcctcactactcctaatgtcctggcatatcttttttacctgcctggtgcccttgggtcatttatttgcatggtacacaaacacaaagtacattttcatatttcttccttaaagagaatcaaatagtaaaggagatttctatttgatttctatttttatttgtttctccaactgtcttaagactgtgatataaaatgaacaatgagatgcttaaaaggtttgagaggaaacaaaatttctaacgaataagatataataaaaaggcttccgcccaggataacattattaaccagccagttagcccttgagtgtgtgacgttgatcttattgactgcgcttagcagagtgggaagtttgtatgtttcaggtttactgtgtgaacagtcctagtagtgaatgattctggtttaacctttttcagtcttactggaaatatttttgctcctgcgtttcctttattcctcaaatgttgctaaattaactcaggccttggaaagccctgaatagtcatctccatttcacatacttctcttattttttcaattggaagtgttgatctcaagacaagctgaaggctgagcctggttgcattgatctgattgattctgccgtgtgctctgctcggcctccatggaaagaccatatcgagttcgtccactgttgtgaatgaaaataatcagttggtgaaagcacaaaattagaaacctcttggtatatttatttctgtgtctcaagaattctgatttaaagcagactttattccaagtaatgtgaacagtaggtcgttcaggagtctcggatgaatcaatgttttcttccctcctctccaagaaaatctatttaaagcaaaggtcaaatctgtgctggatttagaacctattaaatgtaagtctggaaaacagagccacttctcttttttttgttcttcacatagtttcaagcactggggacactctggtcttctgcaaatcatcatttcccacgtattcctggtgtttgtaactttccttttgttccagaggatggagtgtaacctgtagtgtatatactgagtgaatttgagctcttttgagtcttgggcttattacatttagaaataatttaaaccttgaaagttgtcttggaggagtttattaggctttgaattatacctgagaagaatgtattaatgtatagattaatcaactcatttaaataacctgcttacaaattgactcctcctgcttgtggttcctccccaacccctcctatcctgtcgccctctggcctcctccatctctatgaaggctgataagccatagttggatgtgacagccttagacacagcccctgcccaggcctcacactcagttactgagcccagtcccctttgcttctgtaaaggcttcagtcctgctgctccctccgtccaggccgattagatatatgggtgttggcatagtctctgaactggactccctgtttcccatctttaccttttttatgtcattcttccattcggtaaagatttgaatatactttgcaagccaggctgtgccctcggccctgaatatacaattgtgaaagagtcagccaggaaatcctggcccctgcagctgattctctagtggggagggtggacagtgagcaaaatgtgtcagtaaaagatgtagaagacggacatggtacatgccccaagggaaataaaggaggaaagggaaataaggagtttgcatggggaagtgtaattttaaatgggggcattcaggagggcctccctaagaagccacattgaggtggggtgagctgcatggaaatctgggagaatggatgcaagggagcagcaggtcagcctattagaagaaaagcagaaagctagttggggctctggcaccagaggaggtcagaggggtgctgggcctcgctggccatcagaaggcacttggttcttattcagatggagaccagaagctttggaggactttgaatgtagtgacaggacctgccttccatggtaacagggtttctctgctgggtggaggcccagggacagttcaggaggctgctctgatggtccaggtgagggagggtgaccctagcagtggccaggtgagatatggtcagggtctagatgcatttcagaggcacaggtggcattgtttgctgattgattgaatatatggggtatgacagaaaggaagaagaatgattctgatatccttggtgtgagtacctggaagcatggagctgtcctggactgaaagagacagaagtgatcactgctgtgtttctctgggtggtgttccataactattccatgcagggccatgcaggcttgggagggagggaaccaggaactcagtttggggcatgctatatttgggatgcctgattggactactgtttgggatgagttttgtcctgttggaaatcagagagaatagggctcacaaggagcggatgcgtcacgggcctgaggggcaggaacatgatgcagtgctccaaggagacctctgtctccaaaccagaaacttatagctgccttggtcatctttattctgacttttaatggggaggtgggtccagaggaaaaaaacaagctgtacatgctcagtgacagtgacactcagtatcccagtatcagggaggcagtagacactgggaagcacctggccaagagcacgtgtgtttatttctcaggggtaacaagttcagtgggaacatgggctcagaactccctgacactgtaatgtttcaagagaagctagataacagagttttcttgtggaatctcttggcttttaaattttggcttaaaaatatttcttttaatgggatgaacagttaacctcttgtcaacctactggttgtatttcctggccactcaaattcgccatcaggaccttttgtgcactgaagtacaaactggtctacttccaccctcaggtaagtctcagtcttcttgactgcggctctgaatgcccaggattctgatggaatcctgcttcctaaaccctgcttggttttcatccacggctcttaacagctcatgacaccgcgttctgtttttatttgtgtagtgtctgtcccctcactaatgtgtaagcccattgagagctgggcctttggagttttgtgcacagctgtgttcctatagtcgatgtttcatgactgcttactgactgtatgaatggcccaccaagctaacatctcaaatactttccaaaatgtcatcagaaggcccttgtcacggccccaaagaagaagggagtcgtggagcagaggagagcacatggcccacagcggccatgagcagagtgctctggccggggtcaggagttcaggaggcagcagatagtccccaaacaaggggtggcaagcatttcttcagcacctgctgtttgctaggtgattggtttgtttgcttttttcacccagtgggagcagtaaggaaatgacccaggtgatctctttttccattcttcagccaacattgattgaaaggttatatgatccacaaagagcaagtgacagctgccggatgttcatttgaaatttacagacactaatgggggcatagtggtggaagtgactctcatcaggctgtccaggcacagcagtgtccctagagagcagctctcagtgttccagggcctagagaagcttcctgatcccccaccatcccagcaggccttcccactgccatcgaggggagcagtaggcagctcttaaacgaaagagccagctctctctccatggcgttgatattcagtgacttctgatctgcggtcacttggtccccacccctccccagttccttacttgttgctttcttagagattggctcctttttctgctggccacatgcctattacttattcccatttcctctctggtcctctcaccattcaccgagcactgtttattctttttagtaaatacacttcctggttttgtctgttatcacaggcagaggtgataccacaggcagaggttaggctcccagcattctaagcctccttaactggctgggtccttgttccagtccatcttccatactgtggtgggtgatctacaaataaaaattcaagtatgctatttctatccatacaaaccttcacaagctccctgtagactctgggatgaagtccaagtgcttcctcccagcctgccagagtccccaccctccagcaccttcctgacacgagactgtggctcaccatactttacaggcctgggatactcactgccccaacagccagacatgcggtgatctttggctgttttcgtgctgttgtgtggctgttttgtgctgttgtgtcgctgtttcattctgaaactcttgggcctctaggatcctgtgcacattataggcctttcctgcctaagagttaattacaggattttgtttcttgctctgtatttcagtgttaacatctgtctccatgaccttccctccttgccagtctgtgtaaaataaagaatggtgaggagagccccaacctgccccaaagcccaccctcacgcaccctagttcgttacgggttctacacagccggaagcctttcggccaggtgtgtgtgtcagggagaagataagacttcttcctcactgtatctgcagtgctgaggccaccgtggaaatgagatgttttctacattttttgcttatttttttcacttactgatttttaaagtttatgtataatagagtgcgccactgccattaccaactggagactctcatgtagaaagtatttccaattttaaatgtggtaacggtgtcctatgtgagcatgagatattttcctgatatagcagaggatttgtagacagctgttcttttctctcatataactctgtctgtactccccagcgcctgctgattcagggagccctaagaaggtcctgctggcagggctttcaagaaccacgccctgtgggctaacctgcagcctgggagcctgtgggggacagcccagcttcggccctttctgtctggtgcctttgcttcagcaggttccaaatgtgagcctgtgctcccattttcgtcctatggctatgatcttcactgccagtttgcacagcctgcagctgccacacatgcatttagaatatttttaaatgatcttccttcactatttctctttcagaaatttgtcactgttttcatttgctgtttgcacaagactaaatacagcctgggcacattataatttttctaagagtcaaagggactttagagacagtaagtgtggtggctgtgtcttcaaaatattgaagttttaagtttaaatctccaagagtcaggaagttaaataattaagttgagattaccatgttcattttcttatacagcatctgtgaggtttgctttaaaagttttagcacgtgttttaagaaactggttttgtcttaaagcagataagtagttcaaaaattgtaatgactataccgcttatgtgctgcctatgctgacagaacatatattaacatttgtcgctgtaagccaaataaagatcttaatgagattaataaccctttatcttcctttggtaaaatttacctgatatacttaatgacatagttcattaaaaacgctctttgtaaacttaagttgtctagaaaataatttatctggtagtttcatttttcatttgtaaatgtaatctccattgtgctcagtttgggccctttataatttttccaattatcaaggggactttagaaatagtaagcagaatagctatatcattatttgttaaagttgaaaatgttaatccccaaaggtcgggcaattaagctaaggttattatgttcatagtaaaactattcctagttggagtgatgatattaaatgtggcattgattcattgtgtccctcaagtacacagtgacttctagagatccactctgggcaaatggtgtgacaagcaactgttccgtgggattatggaggtcattttatacatagctgagtggtggcttgcaaatgctgatttcacattcttcttgtaggaagatcacactttgaaataattttcttttaggaaaaaaaaacatctattttgaggagaattccatgttttaaaaaattacaaaaagaatccacagtcaagtagtaaatgcttcttaaaacatatacattatttttgagagatttaacagtattcaagaatctgtttgtttagcaaataaaaggattcctggtactaaaataaaaatctagtttgggggaaaaataaattaagcatattagggttgctatttaatatcttttgagaaatgaaaacagtaaatattttcagagtttttttttttttaacctcgatttgagccctgtcacaactgttagttaaattttctttcagtaaatagtagtaattaatagtgttcagactttctgggctctggagcctgagtgcataaatagtctctttcttacaaatgatacttgatcattaacagcatggccagttttctcttatgcatctcacttcctaaatctgtcctctaacactgcatgggatgctttttcaggaaaacgtgggtttttaagaaatttgtgacttttttttttttgaaaggaagaaactaaaattagagtatctcagctaccctgcaagagagcttcttagacaaggcaagcccatgcacacacagtgtgtccctggtattcttgaatgatcccacggtgtatgtcttgaaatctcagcaaacagaaattcagttcattcattaagcattagaaggtcttcaacacaccattggttatttgggaaatgcaaattaaaactactaaatctaatactacgcacccactggaaggctaaaattaaggagactgagcatgcaggtgtttgtgagcatgaagaatagtggcagagctcacctgtgagctcacctgggaacccacagtgactcaggcactttggaaaacagtcttacagtttctggaaggttaaacatgcacttgctctgtttgtgcctgtatgtgtggtatgactgggtaactccaatcttagatttctacctaagagtaatataaacgtaagtctacacagagaccagtcacacagattcatagaagaattattcataatatcctcaaagtggaaacaatccaaatgtccaataataggtgaacacctaaacaaattgtgctgtgttcatacattggaatactgcttggcaacagaaataataaagtattgacatgtgcattaatattagatgaatctgaaagcatcaggctaggtgaataggccaaacagaagagactgcaaactatgattctgtttatataacattctagaagaggccaaactgtagtaaaaagaggtagatgaaaggtcagcagggcctggagtgagggaagggacttgtctgcagcatggaaggagggaactttggggatgatgaaagtgttctgtatcttgattgtggccggggttacctgactctgtacctttggcaaaacttgctgctgaatcctacgcttaaaatgggtcagctttattgtatgtcagttaataaagctgattaacaaaagagtatttctgtagaggcttacatgctagtgtgaatgtgtgaattcaataaattgggttggcttattctgagaaggataaaagttttttgtttttcgttttttggaaatagaaacattttgtgggaggtagggatggccagtgtagagaaatatgtcatggggtaagtgggaaaagataacctgagggtaccagactggcacctgggtgcttgcaggtgagaagccaaacatctcttgaaaatgtttgcttaatgcctgtgagatatcatcctgtcttcctttgaattattagtattataggtagtccttgaaatgttatacatttaacagaaatttctcttatctacttatggactttaaatttagggatattcctagattggaagaaggcaatattcagagcaaaaaggtacaagctttacttgccaccagcagctgccagagtggaggccttatgtaattacttcggcttcagccttggcagcttttgttagcccaaagtggatttgctatatttgtgctttgaattttaccgtttacactcattaagttctataaatacaaaagcatggagagcattagtgctgtcaagaaagaggtgtgattatgttggaaatgaacatgatagtaaaaagaatatgaaagtggcagggaaatggtgactgcagctgcactgggtgtgagaggctgggcagggaacgatctgaagaatgggggagggcgatggtgagaaaagacacagctgatggtcgacaggggacaggagaaagagattcacggaggggaagaaaaagcattgaatgtgtgggataaagaaagagcattatcattagctactcactagcccaattaatgcaggagaagggagtctgctctggaactcgaaggctaagcatggtgtggttgaagtgctgctagtgaaacctgaaccatctgctttgggcatggtcagctctgagcccactggaatttgcaggacatcaaagtgagggctgcagcagctgctgctccatggcatctaggaaatccctcgtggccctgccgagctgacggaggaagagggctcctacccgtgcagatttcagtggtgctggaaccattcatttttgaagagagactcttgccatctgcaaatcggtagaaatgcatccaggttctagaagttttcatctctcctggcttgtttattaactccaaagtgattaacagtggaaccaccttttgaatcctgggtactcctaggttgagcagggctgcacttccaccgtctttcagggttcaccagatgaaactctgaggatcctctatgaatcagcagatacacaacatctcctgagattataaggtggtactgtctgtggtgattacttaattttaatttataaactgggaatgcaaaggccatgctgaccttgctaagaaatgtgaagttcacaggagaacaaaactggggaaaaaggtaggggacagtcgtcagtagcagtcactcactttcgacattaaattatgcgtttgtttaattgtgaaggaaaatacaattgtagaacatgcaccaaaagctagaaatatacagtttaatgttaacacctaaaagcaaaatactaattaaagattttggaatattttttatctttctgggtatgaaacctccagccctgactttttatgccccttataacagctaagtccattgtaactttcagtaattggctttttattaaaataagagactgtagtataaattttagcaactggactaaataggcattaactggccctgggatccaaccataatttgtaacatcgttcctctgggaaaatggattctaagtgcccaataactaccttacaaatagactcttgaatcatagtccatttgagaataaggaactgtttgtgatagtaataccttcaattggctcgcttgagaactgcacagaagggacctatgttccaccacatgtgtgtggtgaacccagctcgtctgggtttgatcaaagattattgctgagtgggcatggaaagtgcaggaattaaactcaaagtagaggctggagacacgtcaagggtggcgttagaaggatggacctggagggctcttagtggtaggaagaggatttcaatcccagaggcaaaggagtgtatctgagcagatgaagggcagggagaagagaatggaagagtaagcaggattgagattgagaaccagccattttcaagcaaaatgtaactcaaagtgtaccagtaaggctgaatagcccaccaagaggtcagagagagacatccctcagatctctctgtctctctctctctctctgttttatttatttttattttatttatttattttgtctgtcacccaggttggagtgcagtggcacgatcttggctcactgcaacctctgcctcccaggttcaagtgattctcccacctcagcctcccaagtagttggaaatacaagggtgtgccaccacacttttctaatttttgggtttttgttgttgttgtctggagatggagtcttgctctgttgcccatttggaatgcagtggcacgatcttgactcactgcaacctctacctcctgggttcaagtaattctcctgcctcagcctcccaagtggctgggattacaggcgtgcaccaccacgcacatctaatttttttgtattttttgtatttttagtagagactgggttttaccacattggccaagctagtccctctcctcctcctgccaaggaagaagaaccatgtattggcatccagtctatcctcatgtgtgctgcagaaataaccctaactggagaaagctgccttcctaagatgagcacctatgtctccatttatgctgtgccctcttacaaaaagccacaggcaatgggctccacatttcagagatttttattcctcactctttccctccttggatccacgcataagtccagtggggaggcccatgggacttggcactgagctagactgggcctctactgtagcacctggatgctctccctgggccaaatctgtgtaccttgtctcatctctttggtgacgtgcttctcaagaggtttttctgtccttcatacactgacccccggcaggcacccctctagaatttcccagacttacctgaatttcctggtgaacacacccaggctgccaagctggcatttccccaggtcagggtaatttttttctctctacccaaattctaaagggcaggctgttgttttagataaggaaggcatagatgttttcaggatgcttgtttgagattcagaattacaaagctaattgacaataaaaagtataaagtttatttattttagagacaggctgttgctggactgcagtggcatgattatagctcactaaagcctccaattcctgggttcaagcgatctttgcacctcacccttctgagtagctgggactacaggcatgcaccatcatgcctggccaattatgtgcctatatgtccctttttttctagggacagagtctcactctgttgtttaggctggtcttgaactcctggcctcaggtgatcctccctctttggcaaaagtgctgggattacaggcatgagccaccatgactggcttctttgtttttaataaaagtccatttaacttttatgcatagaacattattctattaatgtttcgtctattgcaggcatacctcagagatattgcagatttgggaccagtccatagcaataaagcaaatactgtaataaagcaagtcacactatctttttttttttttggttttccagtgcatataaaagttatgtttacacggtactgtactctattaagtgtgcaacagcatcacatctttaaaaaacccaatgtgtgtgccttaatttaaaaatactttttactaaaatacactaacaatcgcctaagccttcagcaagtcataatctttttgttggtggagggtcttgccatgacattcatggctgctggctgatcaaggtggtggttgctgaaggttggggtggttttggcaatttctcaaaataagacaacaataaagtttgctgcatctgttgactctacttttcacaaaagatttatccatggcatgtgatgctgtttgatagcatttacccacagtagaacttccttcaaaattggaatcaattatcccaaacactgctgctgctttatcaactaagtttatgtcatgttctaaatcctttgttgtcatttcaagaatgttcacggcgtgttcaccaggtgtagattccacctcaagaaaccactttctttgcccatccataagaagcaactcctcgtttattcaagtttgatcatgagattgcagcacattgtcgcatcttcaggcttcacttctaattctagttctcccgttgcttctaccacatcttcagttacttcctccactgaagtctcaaacttttcaaagttatgcatgagggttgaaatcaacttcttccaaactcctcttcatgttgatcttttgacctcctcccatgaatcataggtgttcttagtgacatctaaaatggtgaatccttgctgaaaggttttcaatttactttgcccagacccatcagaggaattgctgtctatggtagtatgaaatctatttcttaaataataagacttaaactctaaatgactccttgatccatgggctgcagaatggatattagataaacatgcatgaaaacaacattcattcatcaacgatgtctctatcagagctttgggtggcccagtgcattgttagtgagcagtaatattttgaaaggagtcttttgttctgagcagtaggtcttaacagtgggcttaatgttcggtaaaccattctataaacagatgtggtgttagccaggctttgtttttccatttctaagaattgatttagcataaattttcagaacggtaaatgagcattggcttcaacttcaagtcaccaacttcattagcctctaacaagagtcagcctatcctttgacactttaaagcttgggattgacttctcctctctagctatgaaaatcctagatggcatcttcttttaatagacggctgtttcatctacattgaaaatctgttattcagtgaagccaccttcatcaattatcttagctagaccttctggcgaacttgctgcagcttcctcgtcagcgcttactgcctcacctggcacttttatgttatggagacagctccttttttaaacctcataaaccaatatctgctaaggctcagacttaacacagctccctcacctctctcagccttcacagaattgaaaagagttagggtcttgctctggattaggctttgatttaagggaatgttgtggttccagaccactttctccataccagcaataaggcagttttgctttcttatcatttgtgtgtttactggagtagctcttttaatttccttcaagaacttttcctatgcattcacgacttggctaactggtgcaagaggcctagcttttggcctatcttcttttgacatggtgcaccatgcttttgacatggtgtaccaaaacaatttcaatagtaacatcaaaggtcactgatgacagattaccataacagatataatcatgagaaagaagtttaaaatattgcaagaattaccaaaatgtgacacagaggcacgaagtgagccggtgctgttggataaatggtgctgatcgacttgcttgactcagggttgctagaaatcttcaatttgtaagaaatgcaattgtctttgaagcacaataaagtgaagcacaataaaatgaggtgtgcctgtattacattaacaaagaaggcattgctaatgatggcatgtattcactgcctgaagtagaagagatgtgtattttccttgatagggaaaattcttttgttgttgttgttgttgttgttgtttttgagacggagcctcactctgtcatccaagctggaatgcagtggtgcaatctcggctcactgcaacctccacctcccaggttcaattgattctcctgcctcagactcctgagtagctgggattacaggtgcgtgccaccacagcccgactaatttttgtatttttagtacagatgggttttcgtcatgttggccaggctagtcttgaattcttgacctcaagtgatccacctgcctcggcctcccagagtgctgggattataggcgtgagccactgcacctggcccagataggggaaattcttgatgaataaatagtaagaggaagaagaatgggttttactgagtgtttgctgtatgccaagccccgtgctaaataatttacgttgattagtttatttgttcataagaaaagtgctatgaagtttttagctcctttttacacataagaaaatggcaatttaaagaggctaagtgtcttgctgaaggtcacagaggtaacaagtagagagcttggactagaacccaggtcatctgaccacaatgcagggctctagactacatctttcttaaataaatctttatgaaattgtcaaaagtcactttttgagaataaacactgaacaataagacagttttctggaacctgtttctcactttttaatagtagctgatcctcaattttactagaggtagaaggattcttgttaattaaacatatttctttaagattgcaatttaccttatcatataataaattgcatatgaatgttacttaatagtcgtcttccagacagaataatttcagcagaattctgtgcttcccaattaacttaaaccatattttttatgagcccaaaattacattcttatatttgagtgagatatcctgttcatagtcataaattcactgtgaaaacaggaacgtctgttttttttttttttttaaagaaacagggtctcactgtgttgtccagtctggagtggtgtgctcagtgttcactacagcgtcaactttccaggatcaagcgatcctcccacctcagcctccagagtagctgcgactacagacatgcagcagacacgcaccaccatgcctggataattttttagttttttcgtagagatggggtttctctatgttactgaggctggtcttgaactcctgggctcaagcagtccctcctgtctcggcctcctaaagtgctgggattacaggcgtgaaccaccgtgcccagcccactttttttttaaatctaaaaaatgttattgtgctttaattccatgtgataatggacattacaccaagatgcttttaaggctggtagtagtgttttggtaggtgttggcagtttaacttgattagatactttctataacatgggaaaaatgatcagcttatttcttacgctggcaatgcatggagagaatggtttaatctgaagatctcagcaggattcaaaattaatattttgtcatatttttatcttttggatgctttaaagattatcttatgcaaactgagaaatgatagtgtttgccattcaagttccaataatgctatctttccccaaaaagcacatttgtttatatggagttttctattctaggggcaccaagaataatgtgtatgtagtgtaaagaagtggattattgtaaatttctaacagatctcactatgaagatgtttgtacccataaaacagacccagagggcattgcattgaaattttaatgtataaatgtgcaaagctgaactgatagtatatttatattagaatgggtgtgttctcatttcaagaaacttaattttgaattctattttgtttttgatattaaacacacaaaaaatgtgattttcccctatactcttgtttcaggccacaagggcagccattactcagcactgcactgaccttgggaatttgctgggcaaggaaaatgacgtggccctcatcatcgatggccacaccctgaagtacgcgctctccttcgaagtccggaggagtttcctggatttggcactctcgtgcaaagcggtcatatgctgcaggtaggaacctgcaggctgtgcacagttcacactctgctgtgtctgtatcccgtgtttatacaaaagaaagggatgcatgggaattctaggtttaaagttttgtatctaaaaaaggcaaaacaaaaatacaaatttatttttaactgttggtgcacagattttgcagaggcagttagtggtttttacatttttgttttgtttattgtcttctgagaagataaaaagagtaagaaccagggcttccagtcacattcaccatgggggataaattggaaaaacactgcctcaagcccctttgagaaattactggggtccaacctactgcacatgtctgagctcaacttccaagatgtgtggggctttgatgcttcttttctggcgtttgttggggtatttcttttcagttaaggaggagctttggtcgggttcatgtgatagcaatttttgtggtaaaatctaaccagaaatctttgtaggttcttcccttcctgggaaggtttttttttttcagttggcagtggtgggggattgttacattccattggctgctggctatgtggaggtctagttctgatagaaatttgaaagtcagacagaattataaagacagtaaaccactagaaagatgagtggtcaccaaaggtcacagagagctggaggggctggctagtggagcatcagtagtggaaaggcatgtcagttttatgcctatggtcacaggatattcagggaccatggggatgaggacaaattcaaatgtgtttgaaacaatgagtgacaagtctgttgtacctttaagtcaggaaacctggtgcagctgtgggggacctggtgcagggagcaatggccagagcaccttgaaatacactgcttctgggttttatgatggcctccttctcttttcctcgaatagcttgattgtgatacaattcacataccatacagttcacctattgaaagcaattcattgcctttgagtatattcacaaaattatgtaaccatcatcacaaccaattttagaatattttcatcaccccgtaaagaaactcctgtatccattatcagttaatcccatcttcctgcacgccttcacccccatcccaaacaaccaatcatctactcacttgtctctctaattagcctgttctttttctgacttctctccatccctgttgtttcatgtgtcagtacttccttctttttatggctgagtaatattccattgtttagatgtaacacatgtttatccatttctcaatgtatgagaatttgggttttttaccctttttgactgttacgtgtaatgctactgtgaagattgatgtacaagcttctgtttggacgtaggttttcgactcctctgggtacgtgcctagaaatggagttgctgggtcatgcagtaactccatgtttaaccttttgaggaactgcgagatggttttccaaagtggctgcaccatttctgttcccactggcaatatgtgattgtttcagttcctccatatccatgctaacacttgtcgctagctatctttttgattagttaggatgtgaagtggtatcgcattgtccttttggtttgaatttttctgttgattaatgatgttgatcgttttttcatgtgtttattggccatctgtatatcttctttggagaaatgtctattcaaatcctttgcccatttttaagttggattatctttttattattgaggtataagggttctttagctactctggatacaagtatctcatcagatagatgatttgcagtttttccccttttaggttaccttttcactttcctgatagtattacttgcagcaaaattattttgacaaaggccagtttatctatctttttcttttgtgcttttggtgtcatagctaatgagctctctttttaaagtagctgatcctgtgctttctttcctgggttctatttgagcagtttagattagggctatgcaaatggaaaacaggatggaaagaatggtggggaaatacttttattcataaatttccctttgtttctacattgtaaagctgctgagtaggtgggtacctgattttatgaatttctccacactggaggttgttactgctctacctcagagccgtgagtcatgggagtcagccacttctgcctgccactgccctgttgatcaaggggtcatccccctgactcgctggtggacaaaaacaagtaacaacgtggaaaagtctggtaaactgtaacccaatgcaaacaccctaaaaccttataagtttttaagagggaaatcaaaatgagtccgttggattctcaggggagatccaggaatgcctgtaagggtttacaggaacatgttcttttcttgccaggtgcttgatactaaaacacacacacacacacacacacacacacacacacacacacacacttttttccccttcttgctgtgactgcttcacagtgctttgtgtgtctcataggccatatacttgaagacttcaaaggggagttcaaactggaattggcacagaaagaggaaatttcaaattaaatactgttacagtctacaaaatggaagcattaattgaaaaagggaatttaggatagtgcatcattttcctgctcttggagacatttcttggctgatctcatacttaagattttaaaaaaatcaacatgtacttaaaaaaaagaaaaaagcacttgtacacttcagatgtacttactattcattgaaaatttaaacttaagctaaatttaatatgtggcttcaaacataaagttgaccttaattttcacttttcatcttcaaaatataatagttgtgagagttacctatttctctaataatgaaagaagtaattttttttcagaaaataactggtctatgaaatcatgaagcatgttcctatcaatattgattcagaaattggtgatgttgtatagaaataaatacctttaaactaaaacagtactttaggcagcaaaaagaagggaatgcaagaatttattaaatattttgctgaaattagaatcaaacaatttgctaattatgcatttctgtacccgaatattttccatatggttaaaatcctagagagggcatatatagtcagcactccagtataatttactttgtatctggcaggggtgttgccatgtaattagttgaagtgtaaactggtccagtccaaggtttttattgtgggcttgcaagtattgtgacatttacattgcaaattcctagtgtcatggatgaataaggagaggagacgtggcctttggtgtagaagtgcaaatagtgaataagagactatgttattgtatttgcctctattcctttgcatctcacatacatcccaattccttgaaacccagcccttagtgaagaaggcatagctgggtctccatctggccacatgcagcagactcccttttgtgcttgattttcagatcctttcagcatctggtgttgagggctcttcccttgaggggttctctttttcttctgtggcacctttctcttctccttaagttatctgtctcctttatgggctttctggctgcctgtgaagtgttgttttcccaaggttttacctctggtcctatcgtattcccactccacatctccccgtgtgccttccatttaatgtgtcggatggcctcattcatcttatacattagtgacttctcacaacaccagcttcatatggaatcatctggagaacttttttgttgttgtttttgtttgtttgttttgagacagagactcgctctgttgccaggctggagtgcagtggcgctatctcagcccactgcaacctctacctcccaggttcaagcaattctcctgcctcggcctcccaaatagctgggactacaggcgcacaccactatgcccaactaatttttgtatttttagtagagacaggatttcaccatgttggccaggatggtctcgatctcttgaccttgtgatctgcccacctcggcctcccaaagtgatgggattacaggcatgagccactgcacctggctgagaactttttaaaaacatattttcctcaaaaagctaaatctggaaagtaccatatgacccagaaattgcactcttaggtaggtatacacccaaaagaattaaaaacaggcactcaaacaaatacttgtatgtgcatgtccataatgttcatagcagcacggcccacagtagcctcaaattggaaaacaacccacatatgaatccatacggtggaatattattgagccataaaaaaaaataaagtagtgacatgtgctacaatgtggatgcagcttgaaaacaggctgaatgaaagaagccagtcacaaaagaccacatattatatgattccattcctatcatatactcagaataggcaaatccacagagccaggaagcaggctagtggttgccagcggttgggaggaggaagaatggccagtgactgctcagtgggcatgggatttccttttgaggatgatgaagtgtttttgaacaggctacaggggataattgtacaacattgtgaccatactaaattccactcaattgaaaatggtcaattttatcttatgtgatttctacctcagtaaaatataaataaatgaataaaagaattcatccatttaaatgaaatgtttgttgaattaaaaaactgatatgtttgaatgaaagttcactcatttgaatgaaatgtttgttgattataaaaaatgaatcctttgagcagaagttttgttagtttaaatgaaatgtttgtggaaagaaaaataaagagtctgattcccaggcccttcctcagagcaataaaatcagaactctagaaattctacaaactccccgtggcacctctcttctccttagttacctgttgattctaaacagcagtcagggttgagaagacaacttctgccatctgcttgtccagcgtggcccctcacttcagctccagtttctgtacatccaaccacatctaggacttttttttttttttttgaggcagtcttgctctgtcacctagtctggagtgcagtgccatgaacacaaacacagctcactgcagccttgacctcctgggttcaagcgatcttcctgttcagtctcccaaatagctgggactagcatgccactatgcctggctaatttttaaaatttttttatagagatggaggcttgctatgttgcccaggctgctctcaaactcctggcctcaagttatcctcctgcttcctcctcccaaagtgctgagattacaggcatgagccacagtgccagggccttttgacagcattagcaagcatggttttatatctaggggacctttagagagattaaaccatataagcacattattaaattgaggtcagacattaaaatctcttaatttgtttatccttttcagtattgcatttagttttataaataaggaaataaaggcctcagaaaaattatatcatgttgtctgtggtctcagctaggagtggaagagatagcattttatgttctatctgaataatatcagggcctatgctcttaagtcacacagttggctgtgtcagctaattcattgtcacacgtttattactgataatacagttttgcacgaaagttttgcttttcacatatttttcaactgtcttatatgtttagacttattcaagaaatcaacataaagtcttgtaggatttgtcattctccaaaggggtgaaagttatgtggaaaatgtgtaaaccattttcaatatgttcaagaaagagttatctgttctttcttccccctttctcattttccctttttctttgaaggtctttatttttgtccaaatggagataaattctctagcacagactaccaggggagaggactttgacctcttgagaacactcagaaatctttaaagtgactgtctcgtcaggaaaagagtcatgaaagaatcatcagtgaccccctgtgaggacgttagtgatggccccatcagagtccccagcaaatacaggtgacatgggggccgctgggcactgcctcattagcagatgtgatttacggcttcacatctctgggcaagagatggagtggaaggaaaacaccgcggcagggatttccacgggatgtgcaaattaagggtttccaaaggcatcatttattttctctgatatgtttagacttctgtctttcaggatagattcaaagataaacatgtataagcctgctgtgatatcatagatttgaaaacaggagagagaaaaaggccgagtggacgcactgaatgtttaaaaagacttcttgggtttatttttctaactgtaagagtgatttatattttttgtaaaaaattagaaaatacagacaaacaagaagaaagaaaatggcattcacaatccccccaactagggattagcactgttgacaattggttgtgaagtcttgatctccttctgtgaaaacacttttcattggacgaagggttacaccttttacaatatgcaaagttaaaggttatacacagtttctatgtcaaatttgttttttaaaagcataatggtgttctgttatatgaaaacacagcaattaatttattcctaattgatggatagtcaggttaacaatgttttttacatgaatagttgcaaagacacttgatgatgtccataaaacaataatggattcaaggataagcaacatagaaacttgcaaaagggcttgtagccttagactcagaaagtaagatgaattggcttagagtcagagagagatgactagtagcttagtccctgctgggacaaacatattctcctctgtttagtaagcatagtatggattccaagccccagtttggggtttgttagcctcactaagaaaggggagcagtttagaggttattttgtgaaagtatgtatatgtatacatgtatatatatactgtccaacattttaacacactggcagtgtatcattcccaacgtcaggtcagtcttccagcctatcctaagcttatcactcacttagcctgcattaaaaaacctggtggacatctgtcttaactttagactacttaatgtagaaaagaactggctcttctgatttggttccttccccagcttagcttttttaccttaatgaggcatgatggataataggaaatcagaacgttatgcattttgtgtgtggtatccttcagcctgtgaactacacacagaattatgtcaaaacagagttcagatgcagtaattagaattgtaccaccaattgtgttttagttggcctccatattggtagggatccaattgtacacttgcacaaataaaacttttctttagtttcattcatgatgtgatttctcagcatcatgaacgtttagttataagccagcttcctactttgacatcctattccagagagcattattaacttgtcgaggctgtaagtctatccttgggctgtttgattgtggcttagtatatatttgcccatttgttgattgcatgcaattaaggtagaattcacttttagataggtttttttaaatttaactctaacatgaatgctattgtttgaatgattacagcaattttatttggttctaaatggcttcattgttattttattaaggatgagagcgctcagatgtaatagttcttcagcaccatcttggaaaaaaaatttctcaaagcccaaagcttaaacactgtttttccacccacagatcttaccataatttctctagaataaaactagactgatgcagattttgtagtatattaaaaatagctcacgtgaatcattgtagaggccagaatatgtagagacttgagtattaatctaaagtaggaaaaggaaaccatttctaaataattatttacagcttaggaaaaaaaacaagctttttgaaattaaagctaattttgatgatagcacatttagaaatggagggcaattctcatcttaaatacctattgcagcaaataatttatatgaattactctataagatcaatttctaactgttagggatttctgacgttttgattcccctctaactaaaagttatatatcatcactatctgggtgttactatttcaggtgagaaattttttaaaaagtagcgtatcaactttgtttcttatgtcctggactaataaaacaatttggtggggagcaatatagtacatgtgataaaaatgtggacaaatatttagtataagattgaaaatacaggaagctcttctgcttgtcagctatgagcaactgagtgaatagacgtggataacatgttgagaatacttgccaaggggcatttaataatgaggattgatctataataatatgctgtgtaattgggaacacatctctttggagtttttttggcttataaaattattaccatatcattttgcttatatagtagacctacttttcctaatggttctgaaacctgatttacatggcacaagttcccctccactgagtaccttcacactagtgtttgtttgcagaagctcagatgcaaactgaacagtgggagtaatgaagccctttcctcttttggcagtagtctaagaactatggtaatagggtctgtgtgatctcccatccatccgctctgcagctttcaacacatggggacccttgtgagacaccagaagagctcacagacacatgacttttcaagacttttcctgtgtttctttttttcctttcccctttttcatgaatgattacttcatcagtgcatgtcatttttgacaatactgcttgccaaatgaaacagggtgatacgaggtcacactgtggcctaaaattctgaagtagaagctcataatatttggcatctttcctactagaaaaacaaaccagaaaagaaaatcaagaacagagcttaattaaacatgtggaatatgtcatgaatatttatgtccccaagtcttgccttgtgatggtatttgtacttaaagtgctttttctcctctttcctgtgaaataattcagaatgtgtttcattaatacaagaatgtgtcatgttaactttcatcaggaaaaaatttcacttctgacaacactgacacctttctgattgaaagtatgcaaaatagctcttacgttaattggtcccaaagaaaattatgttatccattttcctgtctatacatctgacactttccctcatctgtcacctcctgaattatcaatgctttcccttgcctgattttgacagccagtattctgcctatgactttaaaaaccataaaaaaaaaactccatcctgggagctttactgtcctccagtttgaataggaagccccaagattacagtcagcaaggtgtagccacatctactactatgccacatctagactgcagtttctctattttaagcctctcccattgtttcttactcgttgaactttagagaggaaacaaatgacaaagaggaatgtttatacttttttaatatttagtcttatttagggtcacaagtaaattttgtcagcaggagctaggtcagactgacagagctaactaaagttgccaaattttgggagcctgtgcttggtttgagttttatgattggtgatgtctgcgccttatgaccattgtcatctgcagagctttgctgggtcagcagagtctgagagggtctgttgaatgatttggtttctgttgtttcttgttaaccagttaactgagctctgtgagagtcccagggctgaattgtcgccagtggtttagtttctgacaggcctgtaagtgagagaggcagacagacagagagacagacagacaccccctccccaaccgtcccatcaaattcttgacacctgggtcatctgagcaaaacagagcatgcatttttttctcttactaagcaagtattcatagtggcgtcctttcaccacttggacacaccaatcattaaagaccaaagtaaatacaccaagttgaagataatcctttcacaaatatacaagtgccaagttaaaactgcctgtcaatcatttgtgcatttttccttactcttgtctgttttaatggatgggtgtggtatgaagatattagagcttgagaaattaggattcctgtgttatcacaattattttgcctctttacagatgattgaaccttaagttcttaatttctctatataaaatcatgatgaatagatactgagttttttttctgaaacagaataacaatagtagggaatatatgtttctatgtagatacatgaacacatgactatacatttaagctcaatgttttcaaacgatgatgcttcacattgagaaatgaattttgaattatcaaatatgggaacaagtttaacaataatatagaagcagattaagtctttttttaagggaaaaaagtaaatgttgaatgatattagtttaatgacacttagatctgaatttataatcccgtgtacctataactgtagtattagcctatgccaatataaacctagttataatacttaaaaataatgaataatgaatgcaattaagggctgataccaacatttcttgaagttttgaaataattataattagagatgttaaagaaataaagtaggatctttctgtggtcatatttgtgtttcctttatttgaaatctgctgccaagagtcttcaggataactcatcgctgggtgtcttgcatttctacatttctacttcagaatgtctcaagctcaagatttctttggtttagtttcacatgtgtttagataatgttgtggagaaggaggagacttttattttttttaatttttaattttaaagtatggatacgtactaattgtacatatttatgggataaatgtgatgttttgatacaggcatacaatatgtaatgatcagatcagggtaattggggtgttatcacctcaagcatttatcttttcttgagtgttaggaacattccaactccgctgttttaattattttgaaatatacaataaattattgttaactataggtgtcctgttgtgctactgagcatcagatcttattccttttatcttactgtatgtttgtacccgttagccaacccctctgtatctcccatcctcaccactgttcccagcctctggtacccagcattctacttaggagaggacttttagacatcttataggtctccgtaagatctattttgtatttgatcctaatatttttttgaaacaggcttttattagtgtggttgaacaggtaaccacactgcttgtcaggccagctcccaggactggccaggctgttcactgtgacccaacttgagggagtacctactgtttaaggttgttgggtgaacacaaatggcacaacctttgcctgcctagagggctcaatctggtgggaaggccagtctggttatgacaaatggtaacacagtcacagcatgaggtgctatgaaagctgaatcttgggagatgacacagcctagtaaactccaagggatgagtgtgtggtgggaaatcctaatgccatcaagaggctagcactcaagctatcgtgatgtccagaccctctgcaaacactaacatctactactcctgagaatcctgaaaatgaagaggaaagttattgctcttattttataggttagcgaactgaggcatagactaacaaagatatatcctgaggtcctctaggtattttttttgttttctgagtcagagtctcactctgtcgcccaggctggaatgctgtggtgcgaactcagctcactgcaacctccgcctcccaggtcaagtaattctcctgcctcagcctccgtagtagctgggattacagggggcgtgccaccacacccagctaatttttgtatttttagtacagacagggtttcactatgttgacgaggctggtcacgaactcctgacctcaagacaccagccctcctcggcctcccagagtgctgggattacaggcgtgagctaccgcgcctggccagtcctgtaggtattaatgaacagtttcaggatttgaactctggagtccatgctgagagactattctaaagataatggtatggaattaaagtattttgagcagagtagcagagctagatcacaggctgggcatggtgactcatttctgtaatcccagcattttgggaggctgaggcgaaaaggttgtgtgaggccaggaattctaaaccagcctgggcaacacagtgagaccacatctctatatttaaaaaaaaaaaattttttttaaagcaaacagagccttaggagaaggcaacactatggaggtcaagttagagttcatatgcaaggtagaggcccgtgtaatacttcaatttagcacatgttagacttccactagggtcacaagtctctggcacatagtaggtgttagaaagaaaagttggactgaatttccagattctctggaatggactatgatccagatttatagtcatttaagagttagaatctgtaattcttagtgactgactgaatgtacttggggatggtgagatggggtagagatgaagcactgctgtaagagagctcatgtcagagggggtcctggaggaggagttcatttccagcattgtgagatgtttagaattaccaccagctgctgggtgttcacttctggtgcaggtaggattctgccaagcccatattctcccagttacaggctatcaatctatctgaagctagaaaaaaaatgcctccttatttatttattttgtatctagcatttacagaatgcccatttctggttagtcaccatagtgtacagggctataggatgaaaaggagagagaaaccatgagtcaaggatacagtctcactcctgtatcaagttactttgcttcaaccagatgtatttattagactgctctttgacttttggcttaatgggtcaggggtgtccacagagttccccattagaaaggaattcttctacctatctctcagtctgcacagtaccatgagggtcttcatcttccaggtgtggaggtggcttatgtcagttagtgctgctgcccactagaaaccctggagcctggaagatgagccttgtaggaaatacctctttctaggtgcacactcaggactacgagaaatgttgaggaaggtgaaggattctcccataactcagtcctcctgggcaggtgactggcggggccagactttgagcatccttgctgaataataagcctgtttggtatgaaatccatgtgctactgatagcagggtaatcctgtggatttgctgaaaccataagggactagatgatacataaaaaggatatcagtgattccacgagtgtgtaacacgagacaaaagacataataaaagccaacctaatactaagcttagatttccatactgctcaggctatgtattaaaaattcttactgtagaatttttaatcaactggagttttctagtaaactgaattggtgtatgttaaaagggtcggaaagtcgggtagggatgatgggtggggagaattgcttgagtaagagatagtagccttaagaatatttccttgcaaaatatacctgggtattcttcatgtttaaaactatgtgattccagcaaagataagttatttcatttgataaaagcaaaagtaagaattatcctcatggaactaaaaccctgttatatttagtttactataccatgtcttccattaaaactatcctgagattaacttgatttatcttgtctcagtttaagtttagcaatttaatccctaaaaatgtagatagtgctcattgtatagaattctcccctttcccaaaatgatgtacgcttctcttttactaaattctcaactttgttagcccactccatatttcagtcttgctgtaagttttagaaagcagaaatcgcatcttctatttctaacttgaaaggcattttttacaactctgtgtaacaaatgtcatcgttcccactacgtctgtttttttctgatagggctaagaggcaagttttattgatttagaatttttcaccagtttatatgcattatgctcttcaaacttgcttttatgtgtgcatgaaaggatattgatttagaacaaatttatattagcccacttttcaaaaccctgcagccaatcagcattatttttggtgctacagctttcatgtagacgttctgcaggaaaaaaccagaaagctctcattgccttgtaccgagattctcagtcaggagtctagaaaagtctttcttgaatctagtagttagtgattcataagtttttgttgtttataacttagtacttttttctgaggcgattctagtcaattcacaagtctcctaaggattatttcaaatgcaggtcacttcgtgttcttgagatgactttgaaatccatctgtgtgtgtgctgaatgaatattgagcatatgtgtcgcaaatatgtttcctgacaaacaacgtgccatgttctgggtcctggggagctagcagctccccagggtagctagcagctaccgtggtggacaagatcagcacagcccagcacaacccctgcctctgtgagactcagggcctgggagaagagctggccagtaaaaattacgtagactgtacagttatgaattagatgcttggtctcttgtatttcagcaattagatgcctttgatcttaggtacgttgaattcttaaatttattagcttctctaatgctgtaggctgatatagatttctgtggctatccttaactatcagctttgattaacccagagtttggtgttcaaaaagaagctgtatccctctgctaaaagaaagaaaggaaggaaggaaggaaggaaggagggagggaaggaagaaaggaagaaaaccttctggtgacctctcagaattaaatttaaaaacctagtgggatgctgcttctcccttgctttctgtgtcccggccacattggactcctttctgttcctttggctctcaaagcaggctttgccccaggactataacaggattttgccccactgacacatggcaaactcacctgattcaggtctttgctcaaatgtcaccctctcagctcaaggcagggtaccttgagtactctggctctgttagtgccactttccatagctttattttgcttgatagcatttaccactacctgacatactattatacttttgcctaattattgataatctgtctccacccaacagaatgtttgtttcattagagcagagattgtgtctccttagccttctcttccatcctcagcactggaaatgacacgagacacgtaatgaacactcaataaatattggtgaatgaatgaatgatgtgataggctaaccaaaccttcactttcttggaggcagcctactcccttctcatgacagttgctgaagttatgctgagaacagtggtgattgtaactatggaaaatgtttagggtgtcagggtcaacttttttctcctttggttatttgtccaatgcagggcacctgcttagctacttttatctccatgttcttggctatctacttgtaggaaatagatacccatgtaagagaatgcaaaagtctcttggaggaaccaaggagccttatgtatccaagttagcatgtactgagtgcagggtgctcttaagatctctgcttggacactagaaatagaaaaaaatatgtatgaagaagtttggataaatgcttcatttgaaagttatataccttagtatttgctttcccattctcatgccacttatgaagggtgaagttggcttcattgacagctaatactgttgaagtctattgtaaaatcagttcattaggttagtgtctattgagcaactactatgtgtatgtgttgtgttgggagtagtgcaagatgaggctggaggagaaaactggggccgaatcacccaggtctgcaagtctcattggaacttggacttgctcctcagtgcaatgtgaaacctttgaaaaattttagcaaaggaatgatgtggtcagatttgtatttttaaaataacagctttattgaaatattagcataccatgtaattcacacatttgaagtatacaattcaatcaaattagtatactcatacagcagtataactatcactactacattccattttagaacatttcatcatccccaaaaagaaaccctgtaccaattagtcattcccaatgtctctccagttccccagcccaaggcaaccacttatttactttctgtctctatagatttacctgttctggacattgctttgcaactggcttttcccacttactgtaaagtcttcaaagggtcattcatgtcgtagcatttcaattctttttattgccaaaaaatatttcattgtatagatatatcacatgtagtttattcatcacttggcggatagttaggttgtttttacttcttggctactatgaattatacttctataaacattcatctacaaatttttgtgtggacatatgttttcatttctcttgggtatatacctaggagtggaattgctggggtatatggtcactctatggttaaccttctaaaacagaactgccagactgtttttctaagtggctacaccactttacatttcatacattacaccccatacatttccactagcaatgtgtgagggtcccagttccaccacatccttgccaaaactttccttttttaagtcatagccatcctagtgggtataaagtggtatttcactgtggttttgatttgcatttccctgatgattaaagatgttgaacaacttttcatgtgtttgttagctacaaataaccagaatatcttccttgggaaatatctgttcaaatcctttgcccgtttttaaattgggttgcttgtcttttatcactgagttgtagcaattctttatatagtcttaatgtcagtatcttatcagatacatgatttgcaaaaaattttttctaattcattgggctgtcttttcacttgatggtattgtttgtagcacagaaattttaaattttgatgaagcccagtttatctacttttttttgttgttgcttatggggtcatatctaagaagccattgtctaatctgagatcatgaagatttactcctatgttttcccttacaagttttatagcttggctcttacctgtagtctttcatctccttttagttagtttttgtatatgttacaagataaaggtccagtttcatgcttttgcacatggatattcagtttttccagcaccatttgttgaagagacagtcttttcctttttgagtggtcttggccagatgtatatttttaaaagatcactgtcagcagggtgtgaagggtttaaaggagtagcgatgagaatagaagtggggagatcaatttgaaaaatatttatgtagctcttattacgtgtaaaacattgttccaggcactggaactatgatcataaacaagtcagacatagccctggcctcatggagcttacattctggcactgaggatgagggatacaaacctaacaggaaagaggaaaaagaagcaaatgcagtgatgacaagttgtgagagaagaaacagtgatgtgcagtgtataagttataggactactgaatatataaagcatgaattgcttatttagttttttcctttaatttcaaagggccaaacataccgactcagaggcaggttggctagagtggagttaggaaaatactctttctggaaagaaaggtgactttaatcattgctgcctatacatgccactatcaccagtgagtcttcacttaatgtgcatatccacctgctggcagcattgccagagtgactgtctgaaagaatggccgcttgttcattcgttcattcattcatcagattatggtagcatggattacagaggtgaagagaaatgaagagatttgagggtggtctagatgtaaaattgggaggatttgtagtcacatatgaaaggtaatagtaaggaagaaggagctattgagaatgggatcagggatttgggattttggtagttatgatagccattgagtgctgagaatgggttaggctctctattgagctctgtccaggcattattccatatgatcctgaaaaaactaaaaaaaaaaaaaaaaaacaccaaggtaggcactaccactaccagcagcagcagacaaaaccaaagcttaggggaggtcaagtcacttaccctagatcacaaaactatgaaactgggtaagtggtggtgccatgtgctactttaatgtacttcttttactttgttgagctcttcttttcaaaaagcatctaaagattgaatgaagaaatatacaacaattctaactaaatgtttaatgaagaaattttgaagggaaaaaatagaccaaaaccactttcttataatctcaccgactgtgtataatgaatggctgtcctttggtggatatgtttccttttcgagagatcaaccctcatctgaatgcctccctcagtatagctgctgctggtcttgtagtatgtgcttggttgtgcagttcctgtggtctggcatgtacctaatgcacacagattggattgaagattgaagttaacctcgcttatcgatggcattttaatttccttcctcttactacattatgtgttttttatgatagtgctttaaagtccaggcttataaggaaaaggaaacaatctcctatgcaagtccccagggtttcagtgaagcagatggcaggaagggtctgggcatggtgtgtgttgcctgtttcaaaattatgtcccatgcaccccagcatttattcccttgatgttggcactgggcaggtgatcagattttaatttgtgtggcgtggtggccttttagagtaggataataacattgggaaaattaggttaagatcaatttgtcatttattttgtcgtaataaaatagagtaaatctttcaaaacagatttacgtaagttccttgaattggaggaagcctcaaatctaaaacttcattaagcaacatcttaatatcacagagactcggggtcagaaaaaatttaaatgacatataaattagtagagtttttcgtttgctattcattttttttcccgttttattgccctggtattctgagtctcttggttcattcttacgtgtgtatcattttggtttgggttatgagtgctcactggcatactggtatacaacactgagagccagtaggctgttattttgctgccattctattgtgtctagagaagtatccagggagagggttgtttgtttttacttgatgaggtgcagaagttgggactgtactgaaaaacagaatgctaaagagccagctccaatctaggaaacatcctccaagagcaccccctgagacagagtgtgaatcacagaaaggaaattagatttttttagccccaaataagaaagattaaaacaccagtaaattgttttacattgattttactaaggttagttagaagtaaaggcttacaaacacgtactgtttatttagtgatagatgaaacttagaggcgtttcttctgttgtaattggttggctctttgcattgattagaactaggtagacaagttggtacaaaaatggcaggagtggaagggaatgggcccctgttgatgtgtaagaacatacgcgtgcatgtggggacaccagtggcattttctgcatgtttcggggtttcagaagacttgccttgttctgcacctctaaattagacctactgtgaaaaacttacaggtcagtttctgggagtgcttttcttcctggactttcccaggtgagcacttagatcctgtgaatccatctccgtgtcggaaacttccgtgatccggctctatgctttaattttgaatgtcttgctatttcatttctttgaaaataaagcagttccacaacattacagccctgtgctgtctactcattctcctttggggattgcttgttttaattgattgattcacagaggagaaagaaaaacaatttgttgctttggcaagattggtttttctaaggatgctactgtcttgctgggtctatgtggcagttagtaagagaagctggcttagcagttctgaggctgacatgaacattgcttcttaaattgaaaggttgggtgggtggatgggtggatgggtggatgggtggatgggtggatggatggatggatggatggatggatgatggagatagataagatagatagatacttgcagcaagcattcccagaacatttgttactcacctcactaaaattaagctgttgttattttgagatgagatggcagataaggtagattcaatcatttaacatccattccaatctcccgtctgtgtcttttcctgtcctgctgatactagaaagctgaaaaatcatcccctggcagcaagggttctgaaaatgactagcctgtcagaatcacttatgtaagacttgaacacagagcagaattaagtgggtagagggatggtgtggtccagacatcagcttgctggcctgactggcaggcgagctgtgcccagagctggcatcgctgtggggcccccatggtggcccctgtagcccatgcttggaggcaatgtaaggatggggctctggtggggcctctggtggctcctgtgtcctgtgcttggagacagtggtatgaggacaggtttcctcatgtagcatcccctctgtgctggtgtctgggtcttgggggtcatcctggaggcacagctcagaggctattcttcaagtctctctcctgattttataagctccgaattcttgtataaagttaccttctagttaaaatacccagcatgatttctgttatctgcacatgacctccgataaatgtatactttttcttttttttttttttttttgagaaggaatctcactctgtcgcccaggctggactgcagtggtgcaatctcggctcactgcaagctccacctcccaggttcatgccattctcctgcctcagcctgtagctgggactacaggtgcccaccaccatgccaggctaattttttatatttttagtagagacggggtttcaccgtgttcaccaggatggtctcaatctcctgaccttgtgatccgcctgcctcggcctcccaaagtgctgggattacaggcatgagccactgcgcctggccacatgacctctgataaatgtatacttctatgggacaaattttcagagttggcaaagaaaataggttcatctttatggaccttgggatctccgtgtgaaactctcaccttccctcaggtcgtccactcatctcacacgtggcctcttcccttacacaggaaggcaactctgggacgtttgctgatgatggctcatcgtgcccacccctcaggtgtgaaacctcagaaccatgtgcatttctcctcatcctcgtcccctttaaccattctccagttcttacttcctgatgcttgcttcttttgagtctaacttttcattcagccttcagcaatccctgtgctacgacagcctctgctaagaacttcatgcaacttgtcttattatagcctcataaaaaccctgtgggaggaaggttagatgccatgtcccaaggctgaacgtagtgctggactgggcagagaggcctcagctctgactggtctgagctgtgggagctttagctttttttttttttttttttcctgacacagagtcttactctgtcatccaggctggagtgcagtgatgcaatctgtacctcgaactcctaggctcaagtgatcctcccacctcagcctcccgaatagctgtggctacaggctcatgccaccacaaatggctcattattattattattattatttggtagggataagggtcttgctgtgtttctcaggttggtctcaaactcctgacttcaagtgagcttttttttttttcaataacagttttgttgagttacagtccatatactaaataactcagccacttagatgtacagttcagtggtttttaatatagtcacagatatgaacagccatcatcacactaaattaaggaacattttcatcacctctaggagaaagcttgtgtttgtctgtttttgctttggttgcctgactctgaggtcttactcaaaaatctttgcccagaccagtgtcctgaagcatttccccaatgttttcttccagcagtttcacagtttcaggtttaacatttacatctttaatccattttgacttgaatgctgagagataggcccgagtatgtacagctgttatgtatcaggtttttaaaacaggtaacctggtacacttgaacagccctagccccctgccctaagcagccacttacctacttcccatttctatagatttgcttgtccttcccatttcttgtaaatggaatcatacatcatgcagtcttgcatgtgtctgtcttcttccacttacgacagtgttttcaaggttcatccacatccatgtatgtgtgcttcattctgttgtatgattgaataatattccattgtatggatataccacattttgtttatccattcatcagttgatggacatttaggctatttccaccttttattgtctatgataaataatgctgctatgaacacgcatgtacaagtttttgcaaggatatgtgttttcattttttcctgggtatatgcccaggagtgaaatcactggctgaatggtaactgtatgtttaacctcttgaggaaccatgaaactgttttccccagtggctgccttattttacactctcaccagcagtgtggaaaggttctaattcctctacatccttgccaatgctggtatgtgactttttgatattatgtgatgtcatgtgacttctcgcttatagccatcctagtgggtatgcagtggtatctcagtgtgggagccgtggctctgaaccccattgcagtaataccctctgctccttagtagcctcctcagttcaatttccccttcttccttgatggcagtagctgatcccttttgtttccagggccttcatcaatagattgctacctaagagggttactaaagtactgtttggtcccaagacttccttgaacaaggccatcaggaagttccccattccctatagggtgctgcctgcattttgctggggttacaggtaccccattattggcctcagccttgcattctgcttttctctcaggcagactttctgaccaatgagactggtatatgttttgcatcctgtacatgctatgtattttgacacttctctttcttgatcccctttctacccatatcatccagaagggactttggtgctgctacagaatttattattagtaacacacacttggcactaattcattgctgtatgttagttgtctattttgacttttgtctgtgtgtaccaaaaatgcatataacttataaaagccacaataaaataagtatttttttctaattccctggctaagacactcagtcttttcaagatccctgtgtacctaagatcatatcctcctttctatcccacaaaggtaactaattttattaattttatcattcacttgtgtttcttcatagtttctataatgaatcaaattgcttatttgctccataatcaagtacatgaaatttgaatggaattgtagtctattattttctgcattatgagttattttgttcaaggttacttgagtttactccgtgttaattcctgtaggtggagtgtattcattctcactgctacataaagttccattgtatgaattttacctcaacttactttattattctcctggtgatagacatttggcttcttgccagatttcaagtgttacatatgatgtggctacaaaaatagtaaatgtcttgggcaaatttgtttttggacataatacttgggagtagaattgcttagtagtggggagtgggcatttttaacttcactaaataatgcaaacttatattcttaagtgaattaccaggagtttataaaaatttccttagatctacattcttgccaagacttgtattttcaatttattttaatctttaccagcctcgtgaatattaaatgctatctcctttctctaactttatacttttcttcttgttaaggagatgacattccttatctttagcaatgtgtttttgccttagaggctcttatttgatattcagttggctacagtgagtttcttgtagttagaatttgcctggcagatcttttacctccttttacttttggcttttctgtattgattttaaacatcatctagccagattttgtttgttttctgtttttaactgcattgaagctggataattcagttcatttgcacagaggctgtagcgattgttagctgttgtttggggtaggtgaaaaatgggagagaggagtttgcttgcagccattgttctgggcagcattccagtccaagatggcgccaggatttctcaccctctggggcactccctccacgtaacccccgagactgcagctggaatgagttttacttccatgacgagctgactttaggaaagggagattatctgagcaggcctgacctatcacatgagccgtttaaatctgggtggagagaacagagataggggaagccagggagatttcaaataggagtaggatttgatggaccgtggctggtttgaagatggaggagaatgcgtggccaggaagtaggtaacctctaggtgctgggagtggcccccaaatggcatccagcatgaaaatggggccctcagtcctacagctctaaggaactgaattctgtcacagccatgtgagtttggaagaggatcttgagctccagatgagaacacagcctggctgataccttgattttacacttgggagaccctgagaagaaaaccagttataatttgtcatgcagcaatagaaaactaatgcattcatgtggcatctgggagggctctgtgcccatgatcaggaacttccagaaggtaattgggcataaatacccagcactccagagaaagattcagcctggggatggattcaccatcactgtcactaacaagcggtagaaatgggatgtgtgggtgaggtcagtcagagagagtgaacaggcagggagaggctgaacagggaagcctggacaacatttcccaatgttgaattgtgaatgatggcctgagggcctgaaaattgatagctcaaggcactgtgagttataaaaactgtaagttttatctccttgatgagttataactcccttatgagctgagagcccattatatactgactgttttcaaaaatacccagtggcctcatctcatattatttctccattttaaaaattcacattgacttctttgggctccacagcacatgcaggctgctgtctagtccttgggtcatttcctgggagtaaggaagagaaataaatcccttccagtaggaatatcttatggtaggcatggaaaagtagaagaaaatgaggtatctgtttttatgatgtcctaggcccattgaccacatcttgggcccacaaagggtgtagacaattgagtgagaacaatcagtataaagtctagattaattttatcctataccagttcaggaaaccattgcctcttccggttcctaggtgtcttcaataaaaaagagttatcagagtaaacaagtgattgaaatactatgtgtcagaccttctgctaggacctgtagagtaaatgtcaccctagataggcagatttcctgtcctcccagagtctgtcatctatcaggaagtgtagcctttaaacaagcgctctgaagaagctgtgataaatgctgggttctccattattgtcatctctgaaggccattggtaacctggaggaatattctcccactaacaggagaaagcacaggatcaaaaagaaaaacttcccttcattcttccagtttctcttaatcattttgccttttacttcctgtcctctgtgagcacgtgtctgtactgttaagtacaaatggacccagaggtttcaggcaaagcctgagtgaggcgctgcatgcctgtcttgcaggtcagggctaggaatggtgacagggctaggaattgaccattgctccattaaagtggaccaaagtggaatctgagtccttttcaggccctaggttcagtctgtgctgactctgaccctctgagatgactattcccaaacctgagggaccgaagatcagcatcaaggacaacagacaggggtgctggggtgcagatgtaagtgagctgggtcttctggagcgctggtcactgcatgctgtgggtataaaatggctgtctagtggaggcagccaggctgctgggaatgactccaggtagaccagacacatgattcttctgtgccttcaacccgatgctttcaagtggcgtgccttagctgtggacattctgaccctgccttgttgaatgctttttgtatttttgctcagagagagaaatcagagtgatttcttttttgtcttatagatcaatcttgtagcttttaaggcagctctccataaggaccacaaaagatcagtctgatagctagatgtcacatgctgtggcagaaacactcctaccagcatacactcattctgtactaggaactatagtaggagttttatttgtgttatttatttcattcacatggcaacaccattttcctggtaagatgactgaagctcagaaaggataggtaactcaaataccattgctaaatatgtttacctttagtatgtagatagacacgcattcagaagaaaacgaaggtgaaatattttggacccgtttgtttcgaatgcatcagtggtgtttattatttaaagaaattctttaaagagaatgattttgtaaagaggataattttctaatttgtgtcaagcaggttgtaatgttttgtacaagtacctgaactagggtacccttgctgagaaggtagtaaagtgtggctatagctacatgtaaatgtaactcaatgtgtcaggtgtccctgtaactaaaggcgcaaaagtgtgaaaagaatggcaagtgaagggcacctggacggtgggcatgttcgtttcctgttgccactgcaacagattaccacaaaggtagtggcttaaaacaacagtaagttattctcttaggttctgtgggctctggggagaatgtgtccttgccttttcagctcctagtagatgctggattctgatggctttttaaaaatgataaattcctcggcttgtggccccttctctcattttcaaaatgtatcccttcattctctgcttctgttgtcacattgctttctccaatcctgcagtgaaatctctctctctctgtggacacttggaattccatttagcgcccacccaatctcagatcatctccccacttcaagatcctttactatacctgcacatttcctttttgccacctaaagtaacatttataggtttcagggattagggtgtggacatctttgggggctgttattcagcctactacagttgccttgaaaggatataggaattatcaattccagggagtccttttcatagcaagagtgctagatttttgagggtctggaggtaaaagaccctgcaatagggcaggaatgctgggaggaaggctccatggggaaaagagaaccaccccaaggagaaggaggtgcagtggacagatacatacatgtgtacatttcagcctcatttttcgttgtcttgattttccgtgtagtacctggtgtctttaatatcatatccccgtccttctccatcaggggtacatgcatgcacgtgatgtagagctggggtaagcaagccgcagagcaaacctggcacatctcagggtgtgttttttctcagatctcagaaaatagcatttatatgtaaattaacctaactatggtgtgatggagaaaccatgaaatgataaataatcaagcttaacctttatgtgacaaactttggtagtcttggaaatatttttgaatatattggaacattacagaaagaagtttagagagttttttggggttgtttggtttcacaaaacattaggtaccacaaaatgctgtggccaaccaggaaagtgattttggcaacgttactatttgtgttctcttttgtcaacgccaagggagccgccccatgccagagctgtatttgcattactgaaaagcaaatatctcaggcctttggacaacacgatacactctcacatgccctggagactctgcgtgtgagatgattggaaatgctcatggctaaagtcagccattatccggaataaactttcccagagggagtttttcagaaacacaccagggaccagtaataaaacataaactataaaatgtcctctagcaaccaaaacacatgggatgtttttctatataatatttcacattaaacgtaattgtagattaacttttatagagaaaatattttttcaagccagatatgcttaaatcctttcatttcctcaagtatgacaaagcactgggaatatactcccctttgtaatttcctaccgatttgccctagttatgaatggaacattaactctgcgaaatctacatatggaaaacgaccccagatgaaaatcttaaactggccatatccctaactctggagtccaagccctgtgctctggtcctggcactgtggctcaccaggtagtcacgtgaccctactcacctgtgcaaatgcccccacgcttctcagatcccaagctcaagggggcgttgaggatcaggtcacccacaagttcccttcctgccctcagcttgcacgtggctcatctgtcaaggaaccacatactgtgtcagattttgttaaagcaaaaaccggtttttatagtctttataaaatgtaaaaacttggaataaatgtaacaatatctaaattcctggtgtgaatgaacagcagctgtagtgacaaagggaacaggtcttgaagtgaaacctgcctggcttggaattctgcctctgccacttaccagctttagtccttgttgaagaaattagctggaatcaggagttttctcatgggtgaagtgaggatacctcatggagaagtctatgcaaaagtaaggttctcagcacaatacccggctaataatattacctgcttagagagtgggggtaacagcaggtgcaatgtcatgtctgctgttttagctacaccaagctccatccacatcttgagttgatgccgtgaataaaggtcatattacttttcagtattactggggatatttgatccatgtgatgggcagataaaatgtctctgtcttagagaaaaaatggactttttaggtagccagcattgcaatgtactattgttagcagacatttgagatggcttctaaaaaccgtgcaagtgaaacaccccaggttttgagaaggggggagcaccgtgtcccaggtcacagggctgtctgtgaacagaattcacctgtatcccctatctcattctgttttacccctgcagacttttgattagacatcttcattgcatcctgagtgacgggaaaatttgtaattagcaaatgcatctgcatatagaagtgtgtgcccgaaactgctgtgcttttagttctcatatgcgtgctccttggaaagtgactgttagtaacattaactctgaaaaccctgtttttcagattgcaaacgtaacttctttccaggtcctattaaatggagattttcctcttgcattcttaaaaactcagagctaaccttggagtggtgtctctttctctccacctctctctccctttctccttctctccttcctcctccactgtttttttcccaccctccccctctctcctttcttgtgcaagatttcagtcagtttactgaattgcctttacatggctatgaccttgaattgcttctgttagttcccctgtgctcttccacattttttcattttaggactacaggctaagcatacttagttattaccttgtaatacacaatcaagataacctggccttggtttctgtgactgtatctcagcctccctgtcctctgtctcgcagagaactagggaaggatggaaagtgactaaaggtatggaatgcctgaggcatggccaggccaggtactgtggcacatattttcgtatgttgtctcatttaaccctgattcataccttttaggacaggtcatgatattcccatttaactgcgctttaaagaagttgaatgtccactgggtcacacttggagggtttaagatctggatttgggtctgagtccaaccacgatgtcatttatatggactgtgtcgcgacacgtgtgtctttttcctggtttggtgttgttattcccctggcaaggtgtgcatgaagtcggtcctgccctacacctgttggcttgttttgtttgacttgtgtttacactcctttttaagatgactttgttaaactgaaaaaaaaaagctgaaatgttgatcaggtagcagatttgcaggagacctaggtactcatcactctagcacttcctaaactgtagttaaagaaacattgttcgggatgctaagtgtaacgtgggggaaaaaaatagctctctgtgcaaataaatttgtataattgttaaatgtgattgctttccctctgagtctttaatctgataatgtgcattctgccagaagggaatgtagtatactgcacctccccagcttgtttttgttcacatctaacttaatttattagaaagcagcctggcgcagttgtgcatgcctgtaatcccaggactttggaggccgaggtgggcagattgcttgaacccaggagtttgagaccagcgtgaacaatatggtgtaaccccatctctacaaaaaatacaaaaaattaaccaggcatggtgccgtgtgcctgtggttccagctactctggaggctcagttgggaggattgcctgaactcaggtggttgaggctgcaagtgagccgtgatcatgccactgcactcccgcctgagtgacagagtgagaccctgtctcaacaacaacaacaacaaaattattagaaagcaaaagtctctttaagacaggtatgtcttcaactctatcaagttggcttttgttttgaagaacaaaagggaatcatggcttggcagtttcagctatgtgtggggactactttctattacactggtcctgcttttacctctggtgtctaaaatgtaataaatatgtgaactagagctcatagggtagcttcaactctgcttagagtttatagcttcaagtggcatgatatctgtcacactcacaagtagtatccattgctgatttctctttgtggttgagcttctttattttattctatattcttactttataatttttcatgtataatagaccaaatgtgattgccataaagaaggccaaatgtagaatccatgcccagtttgcttattctggaaaagcttactatgtaagctgggatttgaggagttcttagatttttattattgtttgattttttttaaggaaggaataggccaggcatgagtggctcacacctgtaatcctagcactttgggaggccaagacaggagaattacttgagaccaggagttggagaccagcctgggaaacaaagtgagacctgtctctacaaaaactcaaaaaattagccaggttggcggcacatacctgtggtcccagccgcacgagagactgagacaggaggatcacttgaacctgggttgttgaagctgtagtgagccatgttcctcccactacactccagccaggtcgcaaaaaagaaggagaggggaggaaaagaaaagaaaggagaaagaaagagagagagagggaaagggaaaagaaaagagagagagagagagaaataaaagaaagaaagagaaagaaggaaggaaagaaagaaaagaccggaaggagagagaaagagagaaagagaaagaagaaagaaggaaagagagagagaggaaggaaggaaggaaggaagcgggaggaagaaaaagaaagaaagagagagagaaagaaagaaaagaccggaaggagagagaaagagagaaagggaaagaagaaagaaggaaagagagagaggaaggaaggaagagggaggaagaaaaaggaagaaagagaaagaaagagagaggtgggaataaagataagggttaaagccataacaattaaaatattgatcaattgaactctcgtgcctgctattttttcaattctcttcccaaacacttttggccaaagaatgctttttatttggggtaaatgttgtccagccttaaattttcatttttctgggtaagggtactaaatcctagagtgctgatatacgatatttaggcctcaccccattggtaagtggaatgtgcctgttgatgtaatcaaattcacagaatgtggaatataacaccctcttggttaaaaaaataagcagagggatttctggcagaatccaactaacactcgcagaaatgaagcacatgaggtgacgaatacaaatgggtcacttagaactaggaaaatccattgtaacagggcacagaacttgttctttttaagcaagagtcttgctaacatccacatttatttcattcatattgaaggtcttcgaaagcttaagctctgaaaatggaagtggttgatttgaagatgataaatggaaactgggaaattagactgcttccataggtgggcagtgtgtcctctttttcaggactccggggtccctgaattgtgagttttccctcacagcctctccacattctctgtgctgttcacctcccacccactgctctgtcttccctgtgttagtgaaaaatcaagcttttccctccctagcccagagagctgagcttttccctgctttactactgtgtttaggaaaaggaggcagctttttcctaaaaagcagtgtttggaagttggaggcacgtatgatgctttctgggctgttatctccaatatccttgctagatgagcagcctcgcatgttgggaaagaatctgtaccagaattcggaatatggggcttgtggccacgtagcaatgaggtcactgaccagctacaatccctggagcaaaccattcacactgcagtcctctgtttcctgctggtgatattcgaggtagtggccatgtgagctccaagctatgatttgttgttgttctgaaattctatgtattatttaaattataatacctcagataaataaatgaaacatctcctgaatttattcttaatatgtaattcatggccaagaatattaactgatgaagtgaatcatttaaagaaggactttgtaatttttctgtgggattgtatttcaccagaagtgcttcagttccgttgagtcctgtgtgatgtacttcagcttgtctgtgagctgagctggtctaacacgctaagtgataacagaatggattctgtgttttatgagtcagtcagccagatctcaaagggataacaattaggaaaaatatatataatttatcccagtaaaagaactagcctattgctgaaaaaaagttgtaccctgtattattgctttttttttgtcccacaggtgtgaataaacctggaaagcataaacatttggaagttattgaaatttattgaaaatatagtacaaaactcccacccttcctttgtttccacccaaaatgtagaattattatagttggctgcagtttttcttatatctcagtggtgtaattttcccacaagtaagaaaactgaatgggtagtatctaagaataagaagctattaaatagcaattttacatgcctttatgatgaaatactacagaagatgggaactgtgtgtcgtgaagtcatggaagtcttcaatgactaataaggaaataatctggctgacagcaggtgttctgattaacagagaagttatttcatagcataataaagaatggcatgaagaattatattgtcaaaaaaacctagccagatttttttgagcaaagaggggtatttccacccctgactgcccactgtaagaataagagacgcttattgtaggattgggaaacagtgaaggaaatagaaaccgctaatggtatcactctcctaaggggactactgttatttcctcttaggcactttgtgttcgcatatacatacacaggcatgcccatacctgtgtgtgcatgcgtgcttcatttttcatggtgtgctctgtgtacattttttgcaaggtccaataggccataaatgacaaaaagatactgggaacctgtcattagcactctaaagttgtattctttccaccaggaacctttgccttttaattttagtcatttataatttattctgctcttcatgctttgtcggccctctcacatactggattttaatagtttttccaaagcaggtggtatacagaagttgaaaacattgtatcacttaatctattttatacatgggcccatattaaaaagcaaaaaagtcattcatggtctcaggaagtatcttgagaattcatcagttccatctcctttcctcaaatacaactgctcagatcctctgaaactaaggacctcctgaacacaaaattataaaccacaaatagtgtttaacaccctttgatgtcagcaccttttttcttctgcctaacttcagtaccttatggcacagcttaaccccatttccttttgatttttgttcgttggcgatgaggaacagctggttacctcttttgtaaaaatgaccttttcccaatatacaaacaagatcaaattaccctttaactttctcttcatgttacatttcttcttttcatccttctcttttaccatgaaaagcttgctatgcacaccacatagtgcccagcatatggtctgcattcaataaatgcctattcgactgaataaacttcagtattcattgttaattgctgtgtaaataaagcatcaccctccttcctaattaccttctcccattccacccacattcctgtactggtcagtgctactgggaaaggctctgtgtccagctgggagtaggagctaggccattgctgagacagcacttgcaaaggccatttgcaaggacttgatcacatccttacttttcccatcttcagtttatgtctggaggataggaagtgagtagtgaactgaacacagaacagtaggtaacaggtttatctcttttcaactgatatagtactttatagtttacagtgcctttagtgtcttagcaagcatttattgagtgcctactgtgtgctacccagtgggcaagtgctagagcttcaaggttgcttaaagcaacccttgcctttagggagcaacagcctagtagagggcctggaatgtgacaaaaaatcatgacacattgtgataaggtttcctttctttttgagatggagtttcactcttgttgcctaggctggagtgcagtggtgcaatctcagctcactgcaacccccggcccccagattcaagcgattctcctgcctcagcctcctaagtagctgagattacaggtgcacatcaccacacctggctaatttttatatttttagtagagacggggtttcaccatattggttaggctggtcttgaactcctgacctcgagtgatccacctgcctcggcctcccaaagtgctgggattacaggcctgagctaccatgcctggccgtgataaggtgtctaatagaggtgagaccaaggcacaatggtggcagaaaggaacaagcgatcagttctatctgatggtcaggtgaaactccagaaaaggtggttgacttggtctgtagcacagtacctaaaatgtaatttatttaatatggttccattcccctgtcttgaaggtggatactggtcttctgttttggaaatcttattgcaggttgctggctggctaaagcattgaatggcaaggaagaaatgattttagatgtagctgaagagttagaggtcatatcttcgaggacactgaaggagaaataagggttggaagttttttgtttctgttttgagacagggtcttgctttgttacccaggctggagtgcagtggtgtgatcatagctcactgcagccttgacctcctgggcttgtgcgattgttccacttcagcctctcaattagctgggaccacaggagagcaccaccacgcctggctaattttttaaactttttgtagagacaaggtctcaccatgttgcccagactggtctcgaactcatgggctcaagtgatcttcctacctcggcctcccaaattgctgggattataggcgtgaacctccacactggcaagggttggaagttcttatgttagaaaaaaaaaactgacagcaggaggaggatgaatgagaggaaggtaagtcaggaggataagggaaacaggaggctttttgtatagtcgtgcaccatatgatgacattttggtcaataacagaacatatcaaccatggtggtcccatacgattataatggagctagaaaattcctttcacttggtgacgtcgtagctgttgtaatgtcgtagtgcaaatactttatttttcataaatttagggtagcctaagtgtatagtatttataaagtctacagtaggtacagtaatatcctaggtcttcagattcactcactactcactgactcacccagagcaacgtctagtcttgcaagctctgtttatggtaagtgctctatacgcgactactatttttatcttttatatcatatttttaccatacgttttctatgttgaaatgtgtttagatacacaaatacttatcattgtgttacaattgcctaccatattcagtacagtagcatgttgtacacatttgtagcctaggagcaataggctgtaccatatagcctaggtgtgtagtaggttataccatctgggtttgtgtaagtgcattctatgacgtttgcacaatgacagatttctcagattgcatccccttcattatgtgatgcgtgactacattccaagggtgaaaagatggccgctcaagaaaaggctggagaggcagtgggttaagataaggaaaaatttagaaagtaggaggaagattgaacttactttgtcacaaatttatgtggtcacagaaggcactactgcaatgaaccctgtgttcctgggtaggaatcatgtattaactgaacgcgacatgaggttgaaatgattatttgtaaactgttgactgtcagacgtttcagaggggcctgtgaggtatagaggttggcatgattcgttggagacataaatacaagtgtgactttggacacaagtctgaatgaagggtcagtgtaacttttctgtaaaggatcatttcataaatattttaggctttgtggtctctctgcatctgaattctgctattgctgcacagaagttcccatggacagtacatgaatgaatgaatgtggctctgttccaataaaactttatttaaagaaatggacggtgggctggatttgacccggggcaatagttttttgatccctggtctagatgattatcaacaggcgggctctagttgatcatgggagtgtgtgagggggtgtcctgtgtgaatatgtccagacaggcaccccagggaatataaccagcgattgtagagtacaacaaaccagcaaagaaaaatgagataactatcgattggggaaagactaaagtgggagagttttcagtgttagggagggtgcatgtgttgaagtcaactgtcacagacataacctgagtgcagagatgataacccacagtgcttgtgggatttgtgtgttaggaggggagttttagtggagggtggggcagaaggaattttaagagtgaacaagaggcaagaagtgaagacaggagttctaggccgtgtttcctgtgtgttgtcccattcagagatcataactctgcaagggaagaaggcagctatatttacttcacttttaaatatgaggaaacgggtcctcaggaagttaagtgaatagctcaagcctgtgccaaaactcacactcaggtgtttgcaccttatgtttgtgttattttattttattttttactttagccacctggaccccagttaattctcttggtgattctgtaaaatttcaagttaagcaaaccctgtctggtttgaccaagaagagtcacctgttggtttactgatccccagttgagttcacaggtaaaagccacccttatagaagaatccaaaacagactctgtttttgcaaattatcgctttcttttctgtgtgtgtgagacagggtcacactctatcacccaggctggagtgcagtggcacgatcatggctcactggagccttgacctccaggctcaagcagtcctcctacctcagccttcggagtagctgggaccacaggcaaatgccaccacgcctggcttttttatttttattttattattttattttatgtttttgagacggagtctcactctgtctcccaggctggagtgcagtagcgcgatctcagttcactgcaagctccacctcccaggttcatgccattcttctgcctcagcctcccgagtagctgggacttcaggcgcctggccaccatgcctgactaatttttttgtatttttagcagagacggggtttcaccgtgttagccaggatggtctcgatctcctgacctcgtgatccgcccctctcggcctcccaaagtgctgggattacaggcgtgagccaccacacccagccaaactatcactttcagttacagagatcagacaacattttgtgtaaatatgatgcctctttctgagtctgaagaccacgtcgtacattaggcacactggcttggttaatctctgcatcacttcctggttgcagaagtgctattttcatcttaccagtgagaaactccttttagagtgcaagatgctgtccagaggaagtagggggctgggatttaaactccaatgtccccgaggcttctcacaggtagagtaactgtaacataaactgatggcaaattctggaacgcaggtatgacactccctcttgtctcttgttttgatcacattgtctctgctttttttctttttgtgcccccctccccccccacacacttcttctggtagttgctgtagtttaatctttaagaaggttgcaggggtttggaatttgttacatcctgtcttctcattctgaggtctaccaccatggctgggcatgtgaacccagccagtggtaaatgataaaaatatgctgtgattggaaggaggtggagagcgagcagggaacacaggaagcagagagggatttgtggtgaagggtgggaaggggcctgggcctggagggccccaccaatgtgtctgtgtaccctaaacacttctgttttcagctggcttgcttctgctcacagtttctcaatttacatatgtaagaactgcaggcaaaatgactggaatcaagggcacatgccacttggatccttgccagcttttatttcaggctgacaactctttggatgtaatacaagatttatagttgtttgtttcttctaatgaggtggcaaggtaaatctgcatctgttacagctgtttggcacaggatatattgatttattttctaaaagaaacatgaaaacataaaaatttcaaggtctaaaaatagtgtacattattgtgatggtaactgaacttatcagaagtcaacttatccttgttgacttatccttgttacgtaagtccaacttatcttgttgatgagtgtgggtgggaggcacgactgagagatatattgacagtgaagttgagtaaaagctcttccatttctcttgaacttctggagcaggagagtcacatcatgggatttgagcaggggaagaaaatcttctggtgtttctctcaggtgtctgcacaacccgacctcatccagagcctgaactggagtgtcagccttccatggcacatgctaatgcagggcccagggcaccttggcgatgcctttagggaggttccaggaggagctgctgtctgctcatcaggggctttgagtgtatctcacatatcataagtggagcttgttcacctcatgctcttctttgaatgggaaattctgttctctatcattaaactatgcagaatagaaacagtgtggagcagaaaggtttaaagaaggaaacctatggatttttaacttgcttatgtataactaagtcaactgagagaagagagcagtcttaatataacgtagagggaggttttctctttttatttttttagcagaaattttttagcctgttctattgcaaaataaattcaacttgtcttggagaagagccacacagatggaaaatagtggaaagacagttaaaaaaaaaagcttaacataaatggcaaggtaaccacttgtagctttatgttatgaggattggtatgatgtatcctattttatttaaagaggaataaacttaaacttcatgttgatgaagttggcagatgatcctgaatcaggggagatatcaaaaatctggaaggacagaaatattataatctccttcaggagattaaaagtataggcaggaaataacaaaatgagatacagcttggaaaatgcacactaatgcggctgggaaaaaataatgtaaaatgcagaacctaagtgaacagaagaaatgtgcaccaaaatgccaaaggcaagcaatatttggatgtatacattgcacaacagtccaccacagtgggctgaccattaggggccacctacattgctcatcctcaatagagaaagagggctgggcgcagtggctcacgcctgtaatcccagcactttgggaggccgagacgggcggatcacaaggtcaggagatcgagaccatcctggctaacacggtgaaaccccatctctattccaaatacaaaaaattagctaggcgtggtggtgggcgcctgtagtcccagcttctcaggaggctgaggcaggagaatggtgtgaacctgggaggtggagcttgcagtgagctgagatcgcgccactgcactccagcctgggggacagagcaaggctctatctcaaaaaaaaaaaaaaaaaaaaagagaaagacatgattatttttgcagaaggatgaacagcagtgtttatttttcatttccaaaatttcaccatttaagagataaggagatggtaagtcagtcattggcagaaagcgacataacaacagggagtgtgggactctatgacaataggaatgatgaatgtctgaactgagacaatgtagcagggtaagtggaaatagtggactgaaatgaaatttaggagggaaaatcaacagagtgaagatccaacaaggaggaaggagaagttgaagatgattctatgtagcttcatggctttatggagtgcatggccattgtcactacccacgagaggcattataggtggaaatgcagatttggcatgaaagataatgaattccatattggttgagttgcttaaattggttggagcttaaaggatgttcagctgataggagttcctagcatgtaaatgaatattaaggtctgactgggttagtgtgtcagctaatttgaagtgttgatgagtgataggaaatttcacataattatgttgtagagacctttagcgtgttatctcaaaaggctgaaaaatgtgagaacctcagacaacttggtgagccaatggaagccaatcatttaaacaggcgtctttagataagactctgcttattcaactttcttaaatatggctacggtattatagataaagctatgtgagtaaccagacatttaaaaacacatattgtttttaagaactatataagaaaataagtatttttcagaaagtgtatgagttctcaaatttagttttatcggaaaaatctttgtttgagaaaattaatttaaaaatcatcaccaattctcaaaaatcatggaaattttgatgagcactggatataagtcctgcattctaaggaagctaagttggaagtcagattgttgcctcatttcttaagacatcgggactgatgatctccctggatagtaattagctgttaatgagcacagtacccagactagaagtgtccctaaaatagctgaaacatacactcgagcaacattttagttgtttgtttgtttgtgtttagacagggacttgcttctgctgcccaggctggagtgcaatggcatgattatggctcactgcagccgcaagctccctggactcaagtaaccctcccacctcagcctcctgaatagctgggtatataggtgcacaccaccacacccagctaatttttaatttttttttttttgtagaggcagggtctcactgtgttgtccaggctgatctggacaagcaatcctcccacctcagcctcccaaggtgctgagattacaggcatgagccaccatatctggccaacattttagatcttaattgaaaacttaggaaagttgaattattgatcttcaactaaaatacaaccttcataaaatgagggctcaacatcacagaatttgggggaagggtgctggacccagaaaattgggttctggggcagtatctgccccttttagatgcatgagctttacaaggctcttgagatacctgagcctgagtctataatgcctgagggcaggtgccactcctccctttgacatcttcgttgtagagtttcaggaggtgcaaatgttcattgatgaaaattccagcaaccttccttacaggtacagtcatgcattacttaatgatggggatacattctgagatattcgtcatcaggaaattttatcattgtgtgaacatcatagagtatacacacacaaacctagatgagatagcctactacacacctggactgtacggaatagcctgttgctcctaggctacaaacctatacgacgttactgttctgaatactgtaggtgattgcaacacagtggtaagtatttgtgtactaaacacatcctaaacatagaaaaggcacagtaaaaatacagcattataatcttatagggccactgtcgtatatgcaaaaacatcgttatggggcacatgactgtaaaagtcaaatgctttcatgtgcatatgaggcatatgagataatatacatatataaagtaaattcttaatgtaggcaaagaccatgtgtctcagacaacaaatgaggggtacacatgtgtttcatcataaagaagttttactacaagttaggggctaactagaaactgaggctgtgtgcttctcaaaatgttttctacttcctccccctcattattaaagtgtctcagttattgtcattgtttatatttaattttcagaagggagataaatagtattcagtcattcctaaacatatttgacttaattaatcccccccacacaccccactccacttttctctctctctctctctctctctgtcttttttttttttttttatggtaaatcttttggatcacttgttctgaaggatatgagctgggaactcatgaccagagattctagaaaagatggaggaggcagtgttttgggaaatgacctttggcagtgtaagagaagtttgtcaccccttcgagtctgcagcatatgggatgtgggaggatgtatagaacagacaagtttggtggaggtgctcttatagcacagccctttctgggggagccagcttccaatttggaagggaggggatttattgaagaggtgaaaggtatatgggtgttataagttgtattgtgtccacccaaaattcttatgtcaaagtcctaacctgctagtacctcagcatgtgtgcttgtttaaaactagggtcatttcagatgtattgagatgaggtcattagggtggacctcatcttaatacacctttataaggactggtgtgtccttataaagaggagaaatttggacacaggcacacaggaagaacgtcatgtgaagatgaaggcagaggttgtgcggtgcttctgccaaggaacgccatggaatgctgaagatggcagcaaccaccagaggccgaaagatgtctggagcagattctttttctcagacttcggaaggaatctactctgccaacaccttgatctacacctccggctttcagagctgtgacaataaatttctggtgtggaagccatccagtttatggtgcttggttacagaagccccaggaaactaatacaaggggagatgttagcatggagaattccagcagaattctatcagagtggtggatggtccagtaaagggaaagcgaggaaatcgtgagaattgttccctttgtgggtggtcactaaagtatgggagcagagctgcacttctgcatgtggatttgccggccacatgtttcatttgtaatggtagatgtatcatcaggttctggcatgtgtgggacaggaaacgcctgaaggaattttagacaaatgtgtcctgagatgtccagcagcaccactgaaagagtaccacagtgatttgttctagagctttcaacaagttgatcagtttcatccacttcacctgttgctgggtttttcttaaccttagcaagaacactaattagttatgaaaacctatattgatgaatgaggtgaaggcggtgaggaacatgcatactctctgttagccattgattcattcattagtggactgctctgggaaagagtatttcagattataagaaaagctccaaaatgttgtaggatgtcagttaatcctatgactacatctactacttatgaaagaagtatgtactgtcatttggaacagtataaatgtttaaagtcattaactatcttatattgtgggtctggtttagtaatttttacaaactaacatcttccagtgtgtgccttgatcttgtaggagggaagatattgaaattcagcgtgaattttctttggcaattgcccgattctttttcatttttctgtttataaaccaatttgagtgcagtggattttacttacttaatcctgaaactgtatgcagcatatcttttcttctttggcggctgcttcactgctgttgaaatcagctctcatgcctgcacatggcatctggctcactcaccacccccccgtgtgtatgtgcgcccttctctgtgagccggtggctcagctgcccacaaatgcaagtctgtgggtcagagatggtactgagaagtggaaaactgtgcgtgtgtttgcacatttcatttagactgtacttcccttagtcctttcaaaagaactaaagcggggggaggggagaacttaatttttatacagattgttctgtattttcacaatgagatcatttcagttacatcagtgataaaaataattaggaagtaatagtgggctgataattagattgggagcaacaagatggtgttattgatcctagcccagctgtgtccttattatgagatgttggttagaattctcaatagccactggggtgataggaacctgcctcagacagtgtttgtaataaaaacttgctacaaggcatgttgtgaaattaaaatgcattcatctagagagaaatcctggagtttcttatcgttgctaattagaaacaggttgtattttcagaggaaaggaccttaaatgtattttccgagaatgtttttacggttgcatgacatgacttggggagtacataggggagcactagagcaggggcccagtttttcttttcttttcttttcttttcttttttgagatggagtctcttgctctgtcacccaggctggagtgcagtggcacgatcttggctcactacaacctccgcctcccaggttcaagccgttctcctgcctcagcctcccgagtagctgggactacaggcgcctgccaccacgcccagctaatttttttgtatttttagtagagacggggttttgccatgttggccaggctagtctcaaactcctgacctcaagtgatccacccgcctcggcctcccaaagtgctgggattacaggtgtgagccactgcttggggcctggcttttctgactcggcttaggaatttggaggatgtggctgggatgctcatggcatagaactcagcttgctccttgttttcctgaagctgacatgacaagccccatgcgttatgccgtgagcgtttgatgtcaatgggaagtggcgtgctcagtgacaggagccagcctagactgtaaagtcaacttacaatgaacttatctttatttatgtcctgttttggttccaacgactggacatggacatttgatttggcatcattttcagtattatctcatgaggactcttggaatatttcatttgcttggtctacatctatctaggctctggactatgtatccactctatgatcaaacttggaattttcctgatgcctggggatgggctggagtgtttacaagtggagtaaatatgaattcagccaagatataattgatacaaagagagggtagtatttaaggattgagatgacacttgtatgaatgaaataaaggccaggattggtttctagtgccaatagaactttgattgcttattctttaagtaagattacttttaagcaagcaaacaaaaaccacctgagttttttgaatcatcctctagttcagtttcttaggaatgcagtgccaaaaatggtattttagtaaaagagaaactgtgtcaggatacatcactctgaatgtgacagcatgctaggcaggaggctgactacatcctatcatgttgatggtttatattgttttcaccacactccagatgcctggagctgtgggctgacttctcgttgatctgcagtgagcctctgtaaaaatgttctttaatacccaagagataccctgttgcaaataatacttttcagaaaagtctttaaaattcaggtaaaggcaattcattcatatgagttgtttctccagctgaaattggcattctcaatgatgttctcaatgaactgatgataaagccaactcaagacctcccacccccaaaaaactcccaaacgcccaaaactgtcgtgaaaagaaggaagtcttgttcatggctctcaggatgtctgtaggaatttgcacactgacatgaacttaaagcaggacagatggatggcaagggctgtgcatctcattggatatttaacttgggaaatgagaacagtgagtctagcacgtaggcaaataaagttctgcagaatgaagctgattaaagaatttgaatttgaacctggaaggacttctatggtcctttctatgtatgtaatggtgtttttgtaggtaaatatttgaggttactctgtatagtaggttcaaatgtttgtgaaattgccttagagttagaaaacaattaacccaggttgagtctattatgtttcctgctcatttgtgggaaagctggtgatcccacactgaaaggaaactggaccagcaccttctcttccctggacggacgttattcatgccccagcagcaataacaatgcctcgtctcaagagctaaaaatctgttgattccagctgaagtgtttagagaaaagtgcattgaagactgaaccatataaacaggtcagagtgaaagccaatttttataaccagagtcaaaatcagtgtggaataattcataggtcattcttaattttatgttaaacattgtgctagattatctccatctttttggcccgtgctttcaaaatatccccatgatcaaagcttcttagataggatatgtttccctccattgtggggaaacacagagcctatggtcgttctgtcctgcgagcctctgcttcctctgcaaagtgagagctccttttccttgtgtttcctgacctcatccaagggtttttaaattattttctaagggagggtgtcactgtctttggaaagatctaaaatagcaaatttttgttttcctgtatacatataagaaaactggaaggagggatcagtagaaacttaggtctaccttagctacaattcatttatttattcagtagcaataatagaggattcgtgcctgttagagccatagcgcttgagcaggcaaacaggcctcatctgccgtgctccttgggctctcatcttcataaggaggacagtattgtgggaaggttagtagcgaagtcagttttcagtgtcgcatttccaaatttttgtggtctttccacataagagtttgaaaatataaagggcttcaattcgaactgtttggcagatgtagcaaaaggtatcctgtgggtccttttattcatgtttgtttcatgtcttccacatacctgataactcttacagaacagtacgtgctggagtggaggaggtaagctcagtcatggaggaggggttagacacgtggaggtgtgcttaagtagaccaaaagctctgcaaggggtttagcatcgcctggggatacaatgcgtggggaggggtttgtttagggaagaatttcaggatgtcaggatgtgtgctttatagataacaatttcatttaacctttaaaatcccccgaagtatggatcagctccattttacagattaggacagagttgcagtgagtagcccaaagacatgccaacacattgactaaaataacattgaatcaccaagaaatgttcttcagggatgtaaaatgcaccaagtttgactttcctaagctgacgtttttagctggctttgttcagatatttttctacaagtatataagttttgttttattacaaagacatttattgggttttaaaaattcattcagccaatcattcagaaaatctataagggttaactactgacatttgtagttcattctgatttaggaatcaccatatggtttaaattccaatttgagaaaaaaattactaagtagagatatatttgtatcatcatatttgtttaagctctgggtttccaaaacagtgtatatagatagtattggacattgtgaatgggctagtttaaattaagaacaatttcactcatagcagaaaaattatttttcgatgaaaggagatgataggattttccccccatgctgtttcatgttgaagatatttcagcaaattggtcagagttctgccaaagtattttgaatgttctttagaagtgtttggaatgacctgatttttctcctcaggacacatctgaattttcttaggcttttggaactctttttttgttttaaatgttacataagctctttggttcgagcattgaatgacatgttatgacatttaaggggaaaaaattttataagcattaatcaatgtaagatatttgttgctttttcattcgaccccatccagctttcatcctgatgcacaccatactggaggcatggctgcttgtttaattgtttagtgcagaacgcggtttgatctctttcttgtgctttcagtgctggtaaattaatcaaaagaagttactgctctgctgggcattagcatgggtttagatgtttctgcttcagggcctgttcatcaactaaaatgcttttaagccccaaatggagagtaaacagcgttgctgcggccactttgaggtgagccattacttgtgacccgcttacatttgggaaggggcctgtttgtattagcagttattctggtttgggttatagcattttcaaaatgttttttctcctttttattttagtgtttttagtatttgtaaagagtgccccccatcaccaccatgtatatacacataggcatttcaataacagtatgtggagattaaaatcagtggacatttctatgaagtttgaaaggtgaaatgtgtatcttcaccatggcttgtagtgagaggacagtgaaattataatgccaattgagatagcagatagcagaatagttttgactaacatgaaattgtggatccttaggttgtttttctgtcttccgtgaaataaaagttgacactttctaactcttggcagcaggtgggccaggcatttgggaggcactgcagacgctgaagagaacagacctttgccttgcaggaatcagtccttccaggaagacaggcctggaaatggtgatttctgggcatgggctgagtattctgatgggaagagagtggaggagggggaagtgaagctggcagaggggaaggagggcctgacggagatgggagaagcatcagaggaccccgccaggaaggagacgacactggaggtggtcttcaggatagagctgaagttagccgaggggagtccagatgcgagggagtttgcggtgcaggttttgtctggagaaaagcagagcagtgggaatgtgggtgaggagggggtgtaggcagcagggaatcatgacgcaggcattgtcacatcgatgtcagagcaggaggctgtgctcggtgggggcagtcagaaagccccttgagtgagcagctacagagcttaggctgttcctggggcaagggagatgggaggaatttaagaaagagtgggacagctttgccttaggagcagaccaaggctgcggtgtagacaggcagcagccaactcatgttccttccgattttctttaaaactggaaaggaagttaaaatgggacattctggtcactatagagtagaatgaatgcctgatgataactgtcacattgtctctttagtttctaattgttgacatctaagtttgtttttaaaataattatttggccaggcatggtggcacgtaccactagtcctggctactaaggaggctgagatgggggattgcttcagcccaggagtttgagtccagcctgggcaacatagcaagaccacatctctaaaaaataaaacaaaacaaaacaaaaaaacgaagaagaagaattatttgcatgtatgtgagctcctgtttgtatacgaaacaaccaagttcatctttagaaatcatctgattgtctcaatatttatttacttatttgtgtccctctaaagccacagtaaggagaacttcggtgaagtcctccctgaagggtcactggtccagttcgtgtggaagacaggccggtgtccagaaagcagctcctgacccaggcagagcaggctgcatttctcagagtagtcgctagagttttcaggagaccaaataaaatagtacacatctgtgtgtagttaccaaagccaggaacacgggccctaactgtgggcagtttccctctgctagtgccccctcttccttggttactctcatctgtctctagttttgggccatacactgtgcccacccccacactgaagcagcctccctccccacagctatccccccgattctgactcccacctgcttccatgttgctctgcccggctcccattccgaaggccggtggtttcagcccagctttgggagcaccgtagatactttcagttcagcagggcccttcgccccaccacgtgatgggattctagaaatgagtgtgttcgagtaatagggaggaagtgtggggagcctgggggccctgtcggcaggtacctcatatgtgtagttttggcatcgagtttatacgagcacatgggcatcaaaaagcttgcgaagaaaagtcctcttctgctcgatgtatacaaaacttctgttttgaaagagttgcttggggaaaaaaaaaaggaatctttttggaattacacgtgtagttcactaaagtattcctagtgacaacatagccatgtttaaagcctgagattgtgttgttctctgtccagggtccaacagggaactgaaatcttggaggttttcagcaccacagtgtatcagagcactcacagagagcttgggagtctcaatgacaaaggcgcccgtgggctcacagctagtactgcgtctttggtggacaaaagctccattttcctgataaaatttagcttactgtgcaaatgtgatttatttggtgggtttcctgattctcctacaaggagattctctgtggttatttgaaagtaactaagtcaacctcccataccttggcttactttgaattcaacctcgtcaacagatgccctgagggccccagactgtaataagcagctctgctacagtgcctaccagaagggtaaaggcacagtgcaaagaaatggcaacatcttgttttctaggacttcttcaaataccttgtacttggaaagttatgatggaaatatcctgtaatgtagcatcactgaaatggcttcattttaggcaaggattgtaaagctttaaaattgagtgaaaccttgaagtgtttttattatttatttattttattttatgatttttttttcttttaagagacagggtctcactctatcacccgagcacagtcatggctcactacagcctccaactcctggattcaagcgatcttcctgcctcagcctcctgagtagctgggactacaggcgtgattgccatgactggctaattttaaaattttctgtagagacaaggtctcgctatgttgcccaggctggtcttgaacttttgggctcaagcagtcctcccacctaagcccaggagtttggcctcccaaagtgctgggattaagcctggcctgaattgtatttacactgcttttaataacttatttgctttttctttacaaaagtaatctatgttaataatataagcagaaataataaaatgaaggaataatacacccaaatcagagataaccactttctaaatcattttctcctgaagttttatcactgcatgtatatgtatgtatacatctagtatgtgtctaaaattggatgctactgttacgtgtactgttgtaatttgctttcttcattcaacaataggtagtgagggccaggcacagtggctcaggctcatgcctataatcccagcactttggggggccaaggcaagagagtaccaatgggcatatatattggtgcagtcctacgtaaaggcaatctgaatacaaattttacatgtgcataacttctgaataggcagcttggctatttatcctaagaaatttatcctaagaggccaggcgcagtggctcacgcctgtaatcccaacactttgggaggctgaggcaggtggatcacttggggtcaggagttcaagaccagcctggccaatgtggtgaaaccccatctctactacaaatacaaaaattagccaggagtggtggcatacccctgtagtcctagctacttgggggactgaggcaggagaatcgcttgaacccgggaaaaggttgcagtgagccgagatcatactcttgcactccagccggggcgacagagtgagactctaaaaaaaaagaaagaaatttatcttaagaaagtaaatggataaatagacaaggtcataggcacagtcactagcttattgttcatcagcaggtccttgagagtgcagtagatgtaaaatgtattgttctggaagaatggacatatgctgactgcatggttttttgttttgttttgtgtttagagacagggtctcactatgttgcccaggctggagtgcagtggcagtgcaagcatagctcaatgcagcctctaactcctggccagtgcttgtttgcccacacataagcattatgtgatattagtctactttgttgttgccaaactctgttcaaagtgtttcctctacctcagattctttttggctggttttagttcagcatctctatccatggtctcagaactagctcagggcaaggctcctctgatttttctttctaactctcctccttccctttccttgccaccctctagcgtgtctttgagctatgtgtgatagcaggttttactggggtgatttataaataggtcatctctcccctcttgcactgtggagtactggggggcaccaccagcgctggctgctgtggggtctttgtgccctccctcggtctccttcagcaagctgggcccttaagctcttgtgccaagagaagggacagacagggcagagtggaggagtgggcatggggcgctgctgatcagagaaagggtagcctggtggccaacagcacgtccaagaacactgtatgagcaaaagtggcagggaaatccgggaagtgggagctcacaaaccaagtgctaacacttacagggtgtggttccacagctgccctttggctcgacccacaatcctttatacagccatttctagcttatttccagcccccagctcagtgctgactcatgtgaatgttggccagacgctctggcttgtgtggttattggcttcctctccctttgttgcatacagtcctctgtttgcctttctacagagtacagcaatgcatagctgcaaatttgagaatctcattctagtgcggtaggtcagtccacaaatactctctgagtgccagctccatgccagctattgagatgaacaccaccaggactatgctgggaaaacagcaaacatggtgctggtattgcagggagatcacagagggaaaattatcctcaacctggagggatggcttcttagctcaatgatgtcctttcccagcttctctcttggagatattttgtctttggaactggcagccacatgacagccatgtgttgctccctgattgtggaagggtctcagtatcctgagtgcttggggtgcacccaaaagacaaacaccacttatgtcaaaacgcaggccccagagttaaggaaaagtctgtttctatcactaacatagcatctggaagaaatagaaaatggctatttcctaattactgttaaagtgtattaagccaacatccatgtatgcttttcctctccttcattcactgaaggactttcaaagaaattgcaccccttgcacttagcatggtgtctgtgtgacttagtcaatgagccgttaggcactgcagataccgtttgttcagtcaagatggatagccctgccttatcactgcgtaacgccttggaggccataggctatctctgcacatctcccttaattgcctggtgtatttatgtgggttgactagtttgttgccatctgcatagctgggttgtttaatatatttttctttgttctgctaatgacctgagcttcattacatgctgataaagaatcctaaaatgtacatagaaaactgacgaagaacgaactggccctggccctgaacagaacaggcatgccactatgccggctgcccagactcagcatttgtcgttacaggaaggaatggctttctgtttgcattttaggaaaacttcaccttttaaacatttcaaatggaaaaaaaagtatgcgatttttttttttgaggttttactgatatgagctacaaatagcttcttggaagccagtcagaactctcttttcaataatgttgaaacattttcctttgactggaaattaataccttcaatttagaagaactctagttagaagtttatagcacaaatatagccccatgtaactaagggaatcttggagaattttctgatgtcaaaaaacagagcggtgttagctcattttaaaaaattgttctagtcaaatataaagcaaaaaatcccatttttaatttaatttttataatatttaagaatcatttcagagataaagtacttctgttttttaatatagcaaaagagattattatgatagagaataattatataaattaggattttaggctaagaaaaatggtcttctgttggagtggatggttgtggttttcacttgttagttgtctggtgttattttacataggctttttcaaaatttgttttatgtcaatttctgtcaattttcttagtgaaacactgtttctagacttccacttatactaattgcaccttgattggattatttgctgatttgttttttgggttttttgttgttgttggaggtaagagtaagaggaaaaactacttccagcacatgaatggaaaagaatcactttgctgtttgacgttgcttgaggagacaatgtttgtgacagttgcatgtattcgtatgtttgtaatttattcttgtgaacagctgatactgttttagggcatcaggtcaggatgagctaaatgtacagttctaatcaatcaagacaaatgatggtactatcacaattccatctccagaggcaggccctctccactgtagctcccagcttcacccagggacaaagctacagaaagggaggcatactgaccctgccaaagttccttcttcattcctgattcattccatctccaaacccacctgtgtcctgtggccctcctactgcttatcaaaactgttcccattattgctgcaatctgattcacataggcaaaattggcagtagccattgtgtgcaaagcattccgttgaatgtaggggcaatttaaaaatgaagacataatcttttccctgtaggaacttactatcttatttgtgttattcatattcagtgagtaataatttcagtgtgaatatgtaatataatataataggttgatatataaagaaaccccaggccgagcacggtggctcatgcctgtaatcccagaactttgagaggctgaggtgggcaaatcatgaggtcaggagtttgagaccagcctggccaacatggtgaaaccccctctctactaaaaatacaaaaaaattagctgggcatggtggcgggcatgtataatcccagctacttgggaggctgatgtaggagaatcgattgaacctgggaggtggacgttgcaggcagccaagatcacaccactgcactccaaccccagatgacagtgcaagactccgtctcaaaaaaaaacccatatagaatttgacacatagacagtggacttgaagggaagggagataaattcaaacagggacacgtcagccaagactttcttctcttcttgtttctcttcccacctctgtcctgaagaccttgagaggccttaaagccaggagctgagaggggaagggcactcccagccagcactagctctcagcctggatggtgtcctcacagaggcagggggatggtgctccaggatagcatgcagcagcagctcctactccaggtgtagcagccaggataggttttttcacctttcatccatctttatcatttattcagttttcatggttatcttgtgaagcagatggcaatggcggtgtccccatattataagcagaaaactgtgaattggaggattaggtaactgttggattctttttttttttttttttgagacagggtcttgctctttcgtccaggctggagtgaagtggtgtggttgtggctcctctgctggattcttacagtgttgggagcggaagctgtggtacctgtgttctgtctcccacccacggcccagttgctcagcagaattatgtgaaagcttccaaatgtgtgttttgaagaaatcaaagaatgtaacagagtaggtgagggtgtggagcctggagcaagaagacacttgcttgtgtttagtcttgtcttggccacttcttaggttgtgacctcgggcatactgtgtcaatctttctgagctgggttttctcacctgtaaaatggagagaataacagcaccaattttgcagagttgtgcttaggattacagcagccaatgcgtggaaagcacttagcccagttactgatgatcaaatggtatgtgcgaaatcagcacttgctgctgccctatcattattattactgaatcccatatttttgttttcaacttaaaagcataggctttggcttaaggaacattagaaatcctcctcattggtctcttcacagaggaggaaaaagaggaccagggagggggtctgtctggttaagaagaggcagggagcccctgtacagcccatcccttgaatcctgctcgctcagcgcattcgttccccacccttccccctcattaatatgttcacacattgccaacgcctgagttcttttctccttccccacagcatacactaaacctctagggagacaatacacctactctccaggagatggagtggtgggaggagggaggaattttccaaatagcccacaggatcatgaaggcttttcctcacatgttggtttttatcacctcggaccattggtcacagaatctggtctggaccttgtgccactgtgggaggatggccataggagaaaaagaaaaagcatcgctccctgtggctccagtggacacacgcgtgctttcctcacctttctatcaccagagccccaagacctagcatgcacttgccactgtgccctggaagctgagtcactctcatctaagtggatggcaggtcattttgttacatggtttggggaaaagattacaacaccaaagttgtcactactttaaattctatccatgtgccagttcagtgtaacgatatactatgtgtgtgtgtgtgtgtgtgtgtgcacacgcacttagaagagagggtgttctctgccaagctgcttgctactccactgccttaacctctctctctatcacactcagtcgcagttgggttgatgactcccatattcggctgagaagtgagtgtaattgtaaggcacaggcatgatatttcaagacctttacagcatgagaagtaaaatccttttctcagtcagctgagagcccctgttatatgtgttcctgacccccaaacccctcatttctcaagtttcatggctggaactttcttcattctcaactccccctttggtaccctcccaatccaggcggttgtgtgtctggctcactctggcctttatctcctttctgagctcagtgactagctctattctgaaggcacagggtcctgctggctccatgctgcagcttccagcccaggtgagtgaggcagttgttggaggtattgaccccacccatgaagccaccacaatgccatacttgatgtttaggttgccgctgttaacctccaaaaggagataacctgataaacatggctgtcctcatgttaatttactctttactgaatagctaccaggtggagtcaaaagttgggatttggcttctctgaacaggggatgtaataaactcatagccttaatctttcaccccttttgatcaaaaactgcaagatgatcattactcatttcatatgataagtgtgtccttgaacatgaaatggaaacaattgaggaggagaaagaaaaaagagctgtgttttaagtccaaaaaaccattgcaaaaacatgggcaattaagcaaatatttgtttattacctattgtgtatgatgctaaaggtctaaagaggagtaaaacaagtccctaacaccaagtagcttgtagcctaattatggagacagaagcacatagccaaccacatttcagatcagactttgtccaaggaagtgctattatgatggtattaatcaattagaaaagcaagttgcaaaataacctttacattagattatgtcaactactattataattagttataaaaatgtgtttcttctatggatacacaatgtcttggggctcatgtcctctctataggcaggcccccatgtacctatattcatccacctgccaccaccaccacatctatctgaaatccgtttgtccatcttttctctgccattcaccaggacattagcagacatatagaatcactggaagtcattttcatgttccatttttggaatggtagaatgccactcctgtttttttaaaacagttttacacatataaccatgaaaaagtaaagcattattatttcccgctattgagatctagaataagtggcttgttaaacagtctttgggttttagaaggtgtgtatgctacttggaagaaagagctttgtgtaaattacctcctttcccacccaagaaattccacttccaaattaagaaagagagagaaagagagagagaaaggaaagaaggaaggggggagagagagaaagggaaagaaagagaaagaggaagagagaagtattaatctgcaaactacctgcctgagtgtgaagcacacatggtgttggccattgctgtccctgtggctctggggtctcttaattgcttggattaggactgaggtgaaggtcagaactggatagcctacccactatttccagagtgcaggaagttacagtttggtgtagatatgggattggtaatcagatgaccttttgttctgtgcacaggtgatgggtgaagggcagacctaattaaaaccatccaatatattaagcatctccgttgtcattaattttcagccgtgcatgagctcacgatgcctggtcctgcaggagtcacaagtttgctctgaaatgtcaaaactcaaacacttctcagctttcctctcagttctgattcctattcccaccttccccacagcagaggtcaggcacactattttgaaatactagtaaaatgtgcagtggggaacaatacatgtatgttaactttgaggaagccagacgctcctgagagggtcttgggggccttaataaagcatttcaaggaagcagagtatcaaattaatgctttttgtgctaaaaacattaaggtatttagatgtgttattctaatccctgtttcagcatgggaacagaaggatctaatatcttttatttaaatcccagccttcctagactgctccattcttttcagtctagtacaggaagagacagactataaccggttgatttcagtgactataaaactgtatataattcacaacatacaacccattcaacttttacatgaaatgcgcttgcccagatcttaatacattccacatcatttagtagagatgtcaggttttcagaagctagactcctgtcagaacgccactttaattgttctgtttttgtggacatgcgataaaattgtcacagacgcaagtaccgatgcataaattctgaacccccaagcaaagtatccttatttcaaagtgagccctttctcagttgtggagtaaaccgatcttgagcagacagggtgtcctcctgtttttctgagagcccctctgcaagtctcagctgcagaggcagcatttatggcttgagtacaggatcgagttttaagggttttgttcagttaataaagaatatcaagttgccctcaccactaacaactgtaggatagctgacctgtaactcctgtttcaaagaagacaatgctcataggatgttgaagcagtcaccagtcatcatgtagtaattaagatcagtaaaatatatgtagagagagatggccatatatatgcctcatgtctaaatcaattgttatggcttcttccctttaaaaatttttggttttcaaggacattattagagcctgaaatcagaatttagacgccatataaaggtatcttcaggtaaacagaatagctagtcttaaaattctttatatttgaggacttaacatccaacgtaagaggtgcagtacactttaagacactagcaagatttttttcaaggtcttttaaaaggacttgtagaagaaccaagactatattttgtgtgtatatgttgggaggtgcatataacactgaaataattaaaattaaacttcctatcattattaaatattgaaaatgagttaaatgaaccctttacacaacaaggaaattattagtaaatgttaatgtatttttgcagtagcatattaacatacataatattttctaaaagctctctctttatttgtggagtgtgaagaagagctcaaattctgtttttgaaagttgagttataaagaatctcttttggaatatggaaacatttaaccttagtatttttgagaaatgatacttataccctgttaaataatttttgtacttatacaatgctgtggaaatttcaagctttccacaatttaatatatgctcaaatatatgtgttaaattcctaaaattaccatggaattgcagcactaagataaaaagcaagatgcttgcacagctgcctgcctctcccctcacctttgcagagactcctggtgttgtgaccttagcacctgttcaactgcagtgtcactgaaaggaaaggacctatgcctggtattgccaaaatatggtggatgttatcaaaacatacatgtttcagccataccaaaataataccgtcagtacatctgggctcttacattacttgttcaacaaatcctggagcgtgttgacctgtatttctcaagagtggctggatagcatcagggtttgtcattaagtcatgcatgttttatcaccaataatgagatatacgtttgtcatattagtcagtcagcaagttaaatccttattctactgggcactgtgttaaatagtcatttgtagtgcaaagatattacagaggcattctattgtggtggaatctgattctaggcttaaatcattgcacaaagagcaaataggtggttgagctaagctgggcaaagtgatgcacacctgcggcctcagctgcttgggaggctgcggcaggaggatcgcttgagaccaggagttcaagaccagcatgggcaacataaagagatcctgtctcaaaaaaagtatatgtatataaaatataatatatattagcacagtatatatatatacacacacatatgataaggtatatatataccttatatattatttattaaatataaataatttgtttggatgatttgtatcatgcagcacccccaagactacttgtaaatgtttggtaagctggtatttattaagccttcaaagtgcttttgtgaggtgttatgcaggggctgggggtgagcttttaatagttgaagcattatgatctaaagaggccaggaaaaaaaactaagcttaggtgttagcttttcccaggagagccctttgtaaggacaaagattgttgtcagccatgtgtcattaaaagctgtcacaaggctgggtgtgatggctcatgcctgtaatctcagcactttgggaggtcgaggcaggcagatcacctgaggtcagaagttcaagaccaggctggccaacatggcaaaactctgtctctatgaaaaatacaaaagaaaaaaattagctgggtgtggaggtgcatgcatgtaatcccagctacttgggaggctgaggcaagagaattgcttgaacctgggaggcggaggttgcagtgagccaagatcattccattgcactccagcctgggtgatggagtgagactctgtctcaaaaaaaaaaaaaaaaaaaaaaaaaaaaaagctgtcccagaaggcctagaatgtttttaaggatatttgtagaaaatagaatcaagaccactagcatgttggtcaggaagtttgcaaacgatatctgtctcttgaatcacaggacaagtgggctgtttttatctgctttccatgagtgatgcatttagatctcacagaggtggccagtcatttatgtattcctttcatcctctccatctgtgcataggctttcagaattgcacactaatagcctgctcctaggtctgttgtttatatgaaagttaagatagttttgtttaaatagaactgtattttttttctattacgcttaattatgggtggagatgtagctagtcttggaatcatgattttggtagttagtcaccatttattgaatgtctgctgtacaaatcttaaattagacatttggagaagggtgaggaaagggagggatagaaaagaaatgaaagatgtcatctctgtccttgtgaaggttagagagaaaaacatattcccccatgatggatataaccaattatgttgaatagtttatggaaagaaatgtactgattaaataattttttaaaaagtgaattcttaaaacttttatgtcacctgtctgctctttcatgatgcagctgatggcgttagggaaagaatgttaactcaagtcacatgacattttgtaggaaatcccctcttttatattcagatgtggttttgaaatgtctaaggattccgagaaatgcttccatgggaggggctccataacaccttcatctctagaggaaatactggcataggatttccagaattttttgctgcaaaaacaaccaaagctagaaacgctcatccctgaaagtctgtgcctgtggctcatttaacaatggggtgcacgtagtcactctgaaacccattcgctcatggattgttcttttctctgtcagcactcaccttgcttttcaaaatacgtcccaccttagacccaacccgtgtgaggctgcctcttggtcaaacactgcattctttgaaataaaaactgaactgctctcacctttccttcgttgttgcatctctctaaggcacactctcttgcagcttcctcagttacagctcctcgccatgtgtaagtttttatagtgagggagcttttatagtgagggagcacttacatctaccttagaactattgagtgattgagttgaaattttctttctttgtgcctctagataagctaacccacaggtacctattgggctcgcctgaatgcacccccattcctgccactatcctttcccactactgccctcccaaccccaaattctatatctgccactgtgctccaggggccattccaagctgcccaaattatctacttttagaatttagggctacaatgaaatataccaaaatctgggccatgagattaagttttgagggagccgcacagtttggatccgagcacagatgttccagaagggaacgactgtccagaaggcctggacacctgggttgtgtcctgcacaaatgtactaaatgcatctgaagaaagaacacagtagacagaagggatgtggtcagccatggaggcatttaataaataggattggttaattaattttaggttttagactcaaatatcacatgtttgtatatctatctaattaagctatgagatttttaaaggtactgaagtttttgactgactgccatgaaaaagaagatgttatattttatttaaataactatttcaataagaaaatccttttcataggatagtattttcaacaggaaaatgaacacttttccaattgaaatcttctgatatattggagcactttattttatagttaaatattatgtattttaggcttggtattgataagttggtttctgtgtcattacgaaaaacaacttatgaagtcttgtttgttgtatttcggttagtttttgcccctaccaccttcttatttgagacactcagattaaaagaatatttttaatgaaataccaataaaatgtatactttctgggtttctgtttaaaagcaaagaagaaaaacctacatatgcaaaactttaagaaaggggataagattcagtgtttcttgtaattgttaactgtcactatggaaattttgtatgtatcttatgctatggaaattcaagcttagctagaaaacatttttactagaaagaacctgtggtattgtctaggccagtgctggtgacttgagtatggtccagagacaagcagcagcggcagcagccgggagcttgttagaaatgcgcattcacaggcccagcccaggctttctgatcagaggctgtaccttgacaatccctctgggtgattccgatgctcacttaaagttggaaactcattgatctaggacagtggttttcaaacttccttttagtcataaggactgctacatgtaataaagatgttttcaaatccagatagtgaaagaattttgtgagtctggttaattaatatgtgttttgggtctctagggggttcctgggtggagttccttgtaacccctctggctcaagtgagctcagtgtacaaatctacaatcgagatccagcccctctttgacaaccaggcaggtaagatcggaggaggtaaagaatctgcttaggtttgttcagatgatattgcaagatcagaatcagaaactctgagagcagggtttatgtatatcagataaattagtgtatgatcactagttctataaaagcagttagccaaggtttcactaaagtgttatatttgaaataatgttagagagctagtttttaaatttcagggacatgtgtcccataaaatgagatactccaggaactgatttttgtaagtctcaaaagaaaaacttatttttcattttagaatctattatgttatccaaaaaagcagatagaatacttctccagtcaactgaatgcttttggtttatatttctattcataatacaccaaaataggattaaagaagtgcccccaagcacctagcttgggtcagctgtggtctggggtttttattttataggttgaattattatatgttgggaatacttattaagtgtggcatgtgactccaggtcacaagttaagattaagaaacagccggcttgtgcttcctggcaacttggtatactaaaatactgcatatggctaaagtggagtggtgcctcttcatttctgtagaaattagctgttggacatctgttttgaacccctagtgtgtgctagaattatgttttctcaaggcattacagctgagggcataataaatccttgatgagaatttcatgctcctaaaatactaccgtatgacttgctttatataccctggtcaggttttctccttatttttgctttttgggaaaggcagctgttggatgttcatagattgtactttaagccattggaatcctcacttgacttacttgagatccaaatcccagagtggcaagcccagtgagtctatttgacttgctcctcatttcccattggttggcctatcgctaacctccctaacaaaaaaccaacaactttaacctcaaaaaaaacccgggtctgtttaggtccttccctgttccactcctgagattttccgacccctgcagtgtgaagtggccaagcctttgcctgtgggcttcctttctctccagaccaccttgaatttgctgatggagaggccagctttcttgatcagttgggtgacatacggacttaaggaggagtcgcagcctcaggcctgctgagtcctgtttaagttcctgttttacgctctcttgtgatactttcatggatgcataagaggagttgcagattaagtgatggcctccttagtgaggttccacctcagtgaatgaatgattttaattaaagagtgattaatataatcataagaatccagactgtagatccactatgtcctcagtgtctcagcaattcctttgcacagcccttagaccaaaaggaaaacttaagtttctaattattaagtaggtaaagtcaaataatttaagaagtatttatgacccaacaacttagcagacatttgaaacaataatgtcattgaaagacatacattgaaagaaataatccttatttcctccatcattaaataatcattactgttgacaatggcatgtggtgatgtacctgtttacctgttgagcgctgcacgacttctcgaactttagggtaagcatagctgctgccttgctcatttcctattccacattgattttcacaaggcatttgctttttatcatcaccgccacgagagctcagcttcacaacgacatatcatgaaaagggatgcagtgtgatttattgttgaaactgtgagctacttccagctagtattttgcactgttacctgagagacattgctgtatttccctcaaaaattaaaaaaatttctgctgcagcatccccagggcacctgcacacccagttgggaaccacaagtctgatggcatgcattactcagaggtgtccagtcttgttttgtttttccaacagttaagatgtttcacataatcctatgctaggtggagtgtgagatgcaattgttttatacttgctagtcaacacagtggtttcacattaatacatcacaaccatcccatgaggtggctggttctcattttcctgatcccactcatgaaaagcaggggctcatggacttcctttccctgcttaaatggtcagtgtgtggtgcacaggaaaatgtcatactcaggcctttaactgtggctcccaggttgttttctccaactatatttgatctgtggttctgtggagtttcaaaacaaaatgggaaatcacttttgtgtagccagttacagttgtggactgcctctgccaaaaagatcagcccttggctttaagtagcagttgcacaaactaggcgggaatagatacagcttaatatcccttcatgttaaaattgcttatgtggagttgactagaggcttcattgataagcagtgttaaagctccagtaactttcttttaggccacattaaagtgaatctggcatctgctacaagggagatggtgattctgttctattctgctctcagttgcctaaaagattatacttggaggctatcttttaagttctgaagcatgcctattaaataatggttgaagaacctgagaatatttagcaagcagcaacagagctttgggaggaaagatgtgatagctgtttttatatttcagccttccatatatttgtaagagaagttagacttttcctatttagccccaaatgacagagttagtactcttaagtatgctcagtaacaacaaaaaagtaataataatttgcagtggtcgcacctactgcaggaggcatcgaattgctgccattgcaaacccttgtgaaaatgctaaaagggatatcagattgtgcaacccagctcctaaagtcctttcattatgtttttctaactttctaatttttatctttgtcactgagcaaaggctttttacatggttctacattcagtttgctgtctcgccaaatgcatttctttctcaagttggtagaatgagatgtcaggtagcacttcagttttctgtttggaacaggtatctttgtgggtagagaccatctaggagctgttgaagttcttactgggcaaatctttgagtgtccattctagctgatgcgtgaagtccatatgtgggcgtggccagtagacctctgtgaaatccagaaaaatcttttactttgtgtttattctgtgtgtgtggtggcgtggggggggggtggtgggggggcaagtgctgtttaagtgatccaaaagcttacctgtaaatcccgcaaatcaagcatcagcttaccaattcagaatgtagagtcactcagtcctgagatgctagtctttgcttcgtgttgctgtgttttgtggtctacactctgaataagcacttcattatcatgaatacccctctgctttagaccccacagatttatactggctcctcttcccagacgacttgaggacttaggaaagcttggccgccatcttggattccttgtggaaagaacccttcctatgcaggggctgatcttcttgccccctttagggctgtgcttctgcatggctcaacaaggggagacttccactccctgactcccatcctagatcctctgccttggctgcccttcaaacacagcttcattttctggggcggatgtagggaagtcttttttctttgctcttaccccagccttctttctgcactttatcatgccctgccaatttcctttcccttctgtaaaagcagattttacagaaaattcccttgccagccctaggttgtatatgatgtaccataaagcaaaaggaggtctgtgctggttttctgatttattggaaagacatttccgaagacccctgtaactagactgacttcctttatcattcagcagggcacacgtacccccgaggagtttgtgcagatgcctcccacttagcagagtgattacaaataggctgtgttttaagttagttttctgttgtatatttcatctgagaagttggcaaatacttgaaagccacaagctactgttttctgaaagcttctttgcacatgagcataaaatggatgtattgaatttggagatcgtccagtaactgtccttttaatgcagcggaatgtagattacagctgtttcctctggaaagacatgcatagctctgatttccctctcttttctcacagagtgtctcctctgcagaagtctgagatagtggatgtggtgaagaagcgggtgaaggccatcaccctcgccatcggagacggcgccaacgatgtcgggatgatccagacagcccacgtgggtgtgggaatcagtgggaatgaaggcatgcaggccaccaacaactcggattacgccatcgcacaggtcagcagcttgggcgtccagctgccctgtcctgttgagagatgatagctgggcatgaggacctggcgtttaaccttcagtgcatctccaaacctctgccacccctcttgaggttgctgtctagatgaaaccccggggatatttggaattctctgtagttgtgatcttgtgcagtttggaggccctgtcctgctgattggatttctctggccagctatggggttggccaagctgctctgtgatccaggcaaggtgctgctcctggcagataggtctctgatcttgctaataataacctctcaccttcagcttctgcatctgctgcatggctttttctgctgcattgcctgctgaagcacagctgtgctcatgacagcctttctctataatcctgttccagtctcactcctcccaaaggtgttgggacaccccctggctaggtgcttaaggtcagggagaagcagtgatttacagctgtcgccttctctgtagttatgagaggggtgctgtccaggaccacccctgtgaggtgaattgccaagagcacgagctgggtttgggccataatgaccccatggtcagtagcaatcagcctcctgcagttaggccaagttcagtccagcggaggctgatccgagcctcgcatgccagggctcctgatgtgctgtactgcactggtggcctgaggatgaaagaaaggtccactccgtaatgatagcccaaaggtgaaggaagatagccaatttcctaacccgtagggtgcatatctgagaccacctttgcaaaattatgactgagacagtggaagagatctaacttaaccgactccatcttgcttctaacctccaagctgtccttgttcatttctgggcgtaagctgaactaactttgagagaaactcagtttatactttatagtttaaacaaagatggtaacagccctttcccaaagcagacctccttgcctggggactagactaacattagccacaggatttgaaatatggcttaggagtcatgcagctggaggctacgagattctgaccttcttaaactgctcctaagatcagtgcttgagatattttgcagaccctgcacttgatggatcagctggcaccactcagatcaataaactggctcatctaatcttgtggctccccaccacccaggaactgactgagctcaagaagacagctttgactccctatgatttcttccctgactgatcagcattcccggctcactggctacccccacccaccaagttatccttaaaaactctgctccccgaatgcttggggagactgatttgagtaataataaaactccagtctccctcacagccggctctgcatgaattactctttctctactgcagttcttctgtcttgatgaatcggctctgtctaggcagtgggcaaggtgaatcccttgggcggttacatatctagatgatttggcctgctggatcacccagaaaacctagacatcacagcgaatgcagggcctgtccctctgtctccagattgcgatacatcatgaatagatgcctgctcatcggctgggtagcaggaattcccttgtgtttctacggtgttgaggtgtttgaagaatgtgttcaccttaatcacatgaacacaaggaaaaatggctacacaccccttcaacctgaaatcaggtgctgcatataaaatgtgaaggagcttcctatagccccagggcttcaggccagtcctttgcagttctggggctccacctctccaaagcgggggctctgtgttagatcacctctcaggtttcttctcagctcacagttctgcagatgcagggagaaattacaaaatcctcctggctctgaaaagtgcatgcaatcaatcttcttcctttgctgatttcaaataaatcctcaagataatttctgaagtaggtaagagaaggaatcttgactttataggtgggaaaaccggggttccttcgtatcaggtgacttacatcaggtccaagcaagcaagcatcttggggtcagaaaacaacggacctgagtgtgaacttgggggccggccccacgcacacctgcctgtttactttcctgagtcaaatgctttgaggcctgtgggactcgcacttcctgtagtctgtcagcaactatagatgttatacaccccagcattattaaatacttgagttataacatcatatggctggaagggatcttaagaggtttcctaggagttccaggcaaatatttgtctgtctttttctttaaaatgtctagggaagggagatcccatgacctgctttactggaactgcataggaataggatgtgttatccagagcaattgctctcttcaaattaaaagtgtcaaagaagggtggagcagggagcgaggctttaaaacgccattgggggttttcttgcccctccagcatcatagtcacttctgccaaaggaactgatgcagcccacatgtttctgtgcaccctcatttctcctgtccatggtcctattgccgattaggtggggatgctgttacttcagggcaggttcctgctaacctcataacctttgcaccaaccaacatgctgcctctaccttagtcaccatgccagaaaagccacagcttgatgaatttctttgcctctcttgaaatggtaaacatctctggttgtttatcgccttgggctttatctgttcattttaatgtggatgcattttttttattacgcttcggaggaagtaccctcagggttattatactcagaaagaaaaaaatgttagctcaaagacttaccttgggaaagttacgaagtgggcaaagctctggttctatttcttccctgcctaccttgtgcttttatgcacatgggcagcccaagaccgagcgccgtcctttttcagctgccttgtcctgagcaaccttgctgccgtcgctgagtcatggtgctcccctagcccttggctttccattctcctcgggagaatcattcctgccccctgccctcctaatgttttcagaacgacctcatgatgacagcattttgatttagaatatacatttttttttcctgaaaacaaatcactgtagtgctcaagttgaggcattcaggatgactcaagcagatgttttctgtgcccattgaagtttaacatcagggggtcccggtcaaatacaaacttcctttttatttgtttagctagttattttatgatttcccattcccctttggaatccttaatgagcctttatggggagttttatttttccatgtgcacctacttctgccacttcgaagcgatgatttagattccgaatgcgtggtgagccccgcgccttcccctcacctcctggaagaacatgctgagctgggactccacctaggatggagtcctttctttagtgctaatggagattattatgcagtttcctcctgaaaattttttgtttaagtattgtattttcagtctggtcatttcttttctattgagagttacatttaattaattaattaattaatttatttatttatttattattttttttattcagagtttcactcatgttgcccaggctggagtgcagtggctggatctcggctcactgcagcctccgcctccgcctcctgggttcaagtgattgtcctgcctcagcctcctgagtagctgggattacaggcacccaacaccacgtctgactactttttggatttttagcagagacggcgtttcaccacgttggccagactggtcttgaactcctggccttaggtgatctgcccgccttggcctcccaaagtgctgggattacaggtgtgagccactgtgcccagctgagagttacgtttaatttccaaagtcatctgaaattaataagaagtatataactgcaaaagaatttctaatgtcctgggcattctcaatacagcctgcttgtctctcctagtagtgtaataggtttcaagcttgtggacttactgacactctgacttagaacaggaggcattaaggttttcatgcaagggaactaagagggaactcaaatccagtgtaaggcatatcaaatgtgtagaaacgtgatgtaaacagggttgcagctaacggcacatttatgccagagcaggacaccacgcaccagaccagagaaactcgtttccctccctccagcgcaaggtttacactttttgggacctttatgaaacggcacacagaaggcaaagccaggctaaggggtggctgaggagatacgatctgagtggtgtccagagaccccctcccccagtgaggattcctgaatgttactggattatctatggctccaactcaaaccacaggagccatcacatcactcccagcttgggacccaccagcagcccctgactgcatagcactctggccagaggggctctgtactggttggaggcaaaaaaggagaagacaaaatgggtcaagaagtggaggcaaagtgtgtgtgtgtcttagtatatctatgtgtacatgtgtatttgtatgagtatctatgtatgtgtgtctgtgtgtatgtgtgtctctgtgtatctctgtcctgtgtgccactatctctgtgtctaggtgtgtgtgtctgcctgtatgtgtctgtttatctgtgcctgttatgtgtctctgtgtatctatgtgtgtacatccgtgtgtgtctatatgtgtgtgtaactttttaaactacgcagttgttagtggaagtagtgtatgtgcacctgtgtgtacttttcttttaaacaagactgtattgtgtgagtgtccctgtcccttgctctttttgtcactgaaaaaatctgtgtttgcttagagatatctgacttccactgtacttttctttcagtttagtagctcacctttgtttaataattaatccctattgcagcactattcataatagcaaagacatggaatcaacccaaatgtccatccgtgctagactggataaagaaaatgcaatacacatacaccatggaatactatgcagccataaaaaggaatgagatcatatcctttgcagagacttggatggagctggaaaccattatcctcagcaaactaacacaggaacagaaaaccaaacaccacatgtcctcacttataagtgggagctgaacaatgagaacacatggacacagggaggggaacaccacacactggggcctgttggggaggcagggggagggagggcatcagattaaatactaatgcatccagaccttgaaacctaggtgacgggttgataactgcagcaaaccatcatggcaaatgtttacttatgtaataaaccttcacatcctgcacatgtatcctggaacttaaaattcaattacaaaaaagcatttgtttaaatagaatttcataagaataacaattaggagtccagcagtatgtttagggaaaataataataatgtagtttcaagaaggattttacttgttctcactgggcctgaaagctctgtcttcagagaatggttttctgagattcctgcggaatctggtttcctctacctacattatctgacttctgttcataaggacattctgtttgtgacttttattcctcaatgatgggctcttctgagctttgtaattttcctttttcagttttcctacttagagaagcttctgttggttcatggagcctggagctacaaccgggtgaccaagtgcatcttgtactgcttctataagaacgtggtcctgtatattattgaggtaagaaggggtattttttttccttgaagagaaagttcttttaagaggatatcttgaggtatttaaagtcatttcaaggcaggattttgttcatgtaaaattaaaagatgctgctgtgactttctacagcctgggtcacatgtaagctcctgtgaagctgggctcgccattctggtctagatcctcatgctggatgaccaaagcgggcatctgcagcctttcttacctacccggacatgccttcctcctagctctcctcctgtgttcctctttgccatgcctcttcctctgtgtccttggctggggtagaatcttgctaatactcacagcccttccacaggggtcagatcctatcagcagaggcctacaccttgccaggtgatcgctgaggtgttgctggaatgaacaagggggcctgatttctgccttatttctcacagactctgcaagtttcctagcatccattcactgcttctgggatacttggacactggtacttacgtgggaagggtgtgggagtgaggggatagtggggagtaaaacagcaaggtcattgacaatattgcagtgagttcatattctgttgtcagacaattttccaagatgctgattcagttaccagtaaaacaaacgtgcctgctagaggggtgggcccaggaagaaatggaaaagtcacttcatgtttgctattagtgggattacagccctgctataaagggggtggcttttgaggccatcatgactaatcgtttccaactatgtttgtctatggaggaaggcaatgttaattatggtgttttaatgcttcattctactatgggttattttatatctgatttcttgactcttagtaaaaataataagcaaggaagaaatcaactttttctgatgtaagctctgacaatactgggttcaaataactattaataacaagtgccttgctaaggtagctgtaactaactacttctttacccggttgtctaatctttcctactcaatcattcaggtcaaacatataagttcatgtcacacatctggtaactaaactactaaagagtgatttccccaagttgtgcaggttgttcatggcccaagacaaccgggccaaaagagtaaatgaagcagaaacataacctgtgctacttcattcatctcttcagctgcccggagcccaactggaaacagcaatgcatttttctaagttgcacaagggccagcctattcgccaagacgtgtgcacttgcagagaggatgcctcttctagttcacacaaaagccccttgtgggctggggagcagccctgattcttaaggaatgttccaagcaatcaaaagggatctggttaaagtcctgaaactgacccattcttcctaatttgaatcttttgtgggaggtgccctgtctgcttaagtgtatttccctaggaagaaaatacacagcagaggcttgagagatttggtgatataattgacgttttattcagtatagtgaggttaaaatcaataatttaaaaaattattcacaatttgtctgctggtcttgtgctgtaatattcaactcagttcactctgggtgagaacttgtagatattggtgtaagaactttagtggtttctctcttctcttatttttacaattcccttttggcacttaaaggtgtttgtccccctcctgctcctacatttttctgtgtctgtggtaggagtcactcctcaacgtcactcaaggtcatggacgatagtgtaaagaggtatcgtagggtcatggaccatcgtgtaaaagggtattagaatctctgtttcttcgtgctatcccaggcttcccagcattttgtgctcctgtagctgctggctttcacggtttcttaataatctcgttttcttcacaatcagcaaattacagatagtctagacttcttatcaagacattctgcgtggagctcccaatctttcacttttcagatcgtcccctagggccccttcttagtcatttacacctactatcttgctggtgtttttttttttacttcaagtgggctgagtctgagaagagtgcaattttagtctgcctgaaaaattctatttggaaggaggccctgaaagtgccacatgcgtgcctcaaattaatatatttcaattgtagctgagcagcagttgttaaatggtcttttgtaaacagccttttaaacattctttataaagttaaagaaaatgttaaagtctgcaccactccatgcccaattttctatttagtatttctcggggatattaatttgaaaaccaagaaagcaaaatccttgaccgagcctatatggttagagccttgactcaggcagagcctacctaccactgccaaattacttctttcgcatcaacatgcacttcaaatatagttttaaaaataggaaagtactacttacttgcatgcaattttagtgtgttgtgaactgtaagatcaaagattattgtaagttgatttgcttatttgcaaagaatacttttttgttctaaaggtaacccttataattaattacttaagtaagaataaattaaatacattacttatttatcttaaatggttttcttgtaactcaaggagcgattctttacaatagccaatatgttgtcatctcagatgccctctaagatacataactactaatcacttaaaaatgtagtctaaaggcaatttggcaaattaaaaaaaaatacacatgtgtgcatgcacacacacattttatggccttagccattattatgaggatcattataggacttgaattgccaataaagattgtagggaagaactgtaagcctgtgatgtaatgcagtctactcacttggcatactaacctataaaagtggatttttctgtgtaaggaacacatggatgtattcatgttgctatatggaacactaactgaaagttccctccactctcgcccccaaacctccttccgtattatctgtcctgacctttttctctgtaggtatggagatatttatatatacaaacaaatcaaggattttagataaatgccatcatgctgtgcagagccttctgcaactcatttcacctgacagtgtattctggagaccattcccagttactatgtatagacccagggcatgccatttcacaggggggtttcctgcaatctattcagccattccctgcactgataaacattccacttctctccagtttcaacccccaaaagccttgtggaataacagctttctcactagcccataaatattccacccaaatgatattgatctaattagaccatttttaccacagttccttgaacataacacatgcttacgtatttttatttatacaacaacaagttatttgttgctgacaaatcttaattaatgcttgttgagtgtgccgcataaaattcaagccaaaataactattggtttgagggatttaaaaactaggaacaaaattatgcaatacatggtttcatgttagccctattaataggtaaaactgaaaatactacaacctgtgcctccatcctccctgcagctgccttaatttagtactgttttctgggttgattacaaaaaccgctagtttcacttccttgaccatctccgctgtagctaggatacgatttctgaaacatacgtctgatcaattccagtgtctggcacaatgtctggaatggaggtgcttgaaaatgctggcaatgaaagagtgatgaatgctgctgcttcctgcagccccttcccaggctccctgtgccttctgatgaaatgcccatctccgtcccgtcacctgcccctctgcgatctgggttccaactgtcaccagcctcctctgccactgtatcctccttactttatttgtaatcagtgttactcaagtatgattgatgtacagcaagataaacactttttaagtgttccattctatgaattaaaactgggtttttatcattagaaacacactgaggattttgtctgtctcccatagacggtgaccagaatgtctcagagagctctggagacaaacagatggtggtgatggttgcacaaggctgggcactggaactgcagtgcaagtgtgaacatgggaccacacacttaaaaatggctatggtggcagactttgttatctatattgtacaatcattttaagatgctaaaaaaaaaaaaaagagaaaaatgtcacaaacacttggctgctttcatcgccttgagagagacaaaaatgtataaggacagattgtatgctttggcgagcttattgaaggtttgaaaaacaaattttacccatagttttgttttgcattaaactaattaaatgctatgtttcatggtcgtggccagatggaccatatttctcagaaggtaaaatcctgttgttgtctagaatgctcagagcttcagagccttgcagggcagccagctgggagtggggttggggtgggtggggcaggggggcggtgtgtattccctgtgtgtctgcactgggggtgggaatgggatgaaattagcaaaagcaaggagatagagcagggtaaagatatgtgagtgaccagggaagggcatctgaatggctcagtcggagtagtattgccattggaagctgggattcctttttttttcttctctttttgcaatagtcaaattacatagtaaatgtgatttaggaaaatttgtctatcaatatgtagggcagatggcaagcagagaacttacatgtaattttgtagttttaagcctggggcatagatcatgccattatgtaactatctctccatgtaatttagaagcagaaagcaaagactgatttttaaaactctttgatgttgacaatgggaggaatttgccttaaatgtaaagattaggggtaaagaggttaggaaaggattcctataaatttttgaagtcttgactgacctctgtgtggtatctcctaaggagagggattgaataagttctttaaagctcctacactatttaacaaactatgagttagttgttcagggttttcttaatagagtacagtttcaaagcacagcagcatcagcattttaagcatgtattaggtggcatatgcatttgtttgtggactttctgaacctctgggaaaaggttatttggaatagataacatttttagtggccataaaattcaaatagaaaaataatagggacattacttgaacttaacctatatttcgaaaaattatcatagggatctcttgtaaactttggtataacataaggaagatatgccaaattatttttgaaatagagatgagtctgaaatcataatggtgattagttggtggttcctaatacaaagaataaccataacatatgtatattgatgtgaaaaagtggatattatatacagcttggagtctacttatttttggcaacacatacaagaaattttagtgttttcttgggggtgattaaactgataggggataaaggccaggaaatgagatgcatatttagcaggaaggtctggaaatactatcactgaaatagaaatagatattctaagaccacagcaatttggggaccaaatgaaactgaaccgcagaatttagttgacagctgtttaaaaatttgtcaatatctgacaagcctaaaacaagcaaacaaacctttattatactgcagcagagattcccaacctttctggcaccagacactggtttcagggaagacagtttttccacagagggcatggctttgggatgattcaagcacagtacatttatcattagatcctcataaggagcgtgcaaactagatcccttgcatgcgtgttttacaatagggttcatactcctgtgagaatctaatgctgccactgatctgacaggaggcggagcttaggcaatattgcccgctagccctccgctcacctcctgctatgtggtcgggtttgcaacagccaccgaccagcaccagtccagtccgtggcccaggggttggggatccctgtactacaggatatgagaaaaggccttactggcagtttgttttctgtgtcttcgaattctcacgcctgtaatcccagcactttgggaggccgaggtgggtggatcacgaggtcaggagatcgagaccatcctggctaacatggtgaaaccccgtctctactaaaaaaacacaaaaaattagctgggcatggtggcaggtgcctgtagtcccagctactcgggaggctgaggcaggagaatgacgtgaacctgggaggcggaacttgcagtgagcggaagccgagatcgtgccactgcactccagcctgggtgacagagtgagactgcgtctcaaaaaaaaaagtgaaatgaattatggttcatgtataaattgccattttaatccaaaacgttttcagtagatgaatactttgattttttaaaattgttttgcaaacatatatttccttttgctgttttacagctttatttttttctgttggacctgtgagagattttgttttatcatcaattttttattattgtttgaaaataatcattatttttcaaacttttttttgtttgttttttgagatggagtctcactctgtcacccaggctggaatgcagtagtgcagtgttggctcactgcaacctccgccttccaggttcaagcgattctcctacctcagcctcccaagtaactggaattacaggagtgcaccaccacactcagctaatattttttgtatttttagtagagacaagttttcaccgtgttggacaggctggtctcaaactcctgacctcaagtgatccacccgcctcggcctcctgagctgttgagattactacaggcgtgacccctttgcccgaccttcaaacattgttagaaaaaaatcatatctaaattaccccttctttccattattatgtcattagcttcttgtttggggagccttaattaaatatgttaatgcacggagatgctatgcacttggtcaaccctattacaaattggtatctatgtcctactagtaacccatgcttcattataaatgataaaagaagtcactggctttgggctggatttcattttaaatgttagaatcaacagagagtagatgttttaaaccatgatcaaaatttcatccagtgacttttcccctcttgcatataatgcatgacttaactatacctcaaaacaatgtgtttcgtttgggggacacaagaaatttcattacacggtaaaagataaaatcctaatagctaagctttcctcttctgtcctgtgcatctgccttggcagagttagctttatgtttcctgttacagcttttatttgaaggaatagattggcagctatgagtgcggtgttaaaatgttaataagtaaaaggcaaatttaaaaatatcattgacatatggacctttctgtaaaggctgtggcttcatcaagtatggaaccatccattttctattaaaagctttaataagtgttgaccacctactccaaggcaggcagaatgctgagactgaggtactgggacatgctgcacagagttccccatctaatacaggttggggaagaggtgagtacagtcatcccttagtatccacagggtactggttccaggatacaccctccccaccttcagatgccaaaatttgtggatactcaagtcccttatataaaatagtgtagtatttgcatataatctatgcacatcctcttgtatactttacatcatctataaattacttaaatacctaatgcattgtaaatgctatgtaaatagttgttacactgcatcagttttgttttgttttgttttgtttttttgagacggagtttcactcttgttgccaggctggagtgcaatggcgtgatctcgactcactgcaagctccgcctcctgggttcacttgattctcttgcctcagcctcccgagtagctgggattacaggcacgtgccaccgcacctggctaattttttgtatttttaggagagacagggtttcaccatgttggccaggctgatctcgaactcctgacctcaggtgatccacatgcctcagcctcccaaagtgctgggattacaggcgttagccacctcttctggcccagtttttaaatatgtactattttttattcttgtattgatatttttactgtttttctttcctgaatatttttttttcctgtggttgtttgaatctgtggagacggagagcctggctgtacagcgtaagtgctctgatggctgtgtgcacaaagacctctgcatgcacaggcctggtgccaaccccatcccaagagcatctgggcttacagtccatgattacctgggtggtccctatcttgtgctgacaattgttgagtaataactgcaactgtaatatgttggtgggaaaactacttagagaagtttcccattggacaattgaaaaatgggaattaactagaaatgtaaacattctgaattctgctttccttgcctcatgcatgctcattctccaagtcaagaactcttgggtcatggggacaagaggaacaggacagtccctcctcttggaatcaaatagagaatgcagataagaattcccacaattataatatggtgtggtggggctggcttagaggaagacagcttgcaatgagaactgttagaagtggtgctttacaggcgtggtagggtaagggcctcaggatcccaggatgaaacgagttaagacctgaaggatgagtagcagctgatcaggtgaaggggtgggaggagagggtcagggaatgtgccaaagagagcccagcacctgcctttcccatccatgttctctgtctgttccagctctgtgataaatgtcagcaattagcccagcccttagtacctaacagagaagaaatgcattatgctgcggttttatatttcagtcggaagatggctggagaactagttaaacacgtgcctaggaatgttctctgaaaggccagctggttgctgctggttgatagagctgggagtttattggcaaaaggtggagagggggtgagaggacagggaagaggtaggtattaagccagagaaatactagcagtctggagggattccctacaagatacacaatcactttgaactttataaaaatagactcttactgccctttccatgtgacaatctatgctttttttatgatgtttttgcagctgccctacctaaaaggatcattataaagatccagcactaaaaaaatgtttttaggcattgatggtttaaaaatggagtctttggaactctataaaatgttttaatctccttggaataaaaaaaaaatgcaagtccagaaacagagcccatgcaaagaacttccagggctcacgtgaactttgagaggtcagccctgtgctggagctgtgcttcgtagcccgggtgcactctcccaccctacctgttactgtggcagaagtgatgagaatccagcccacttcacctcacgaattccaatttgcttcccttccttaaaggcctcttgcattcagagacagcacccacatagtttagtactgattgcaggcaaggggtgaatgttacttttatttttccaaattggttatgacttccctaagggcaaataatccattgactacatttcagtagaggcacacacgtaagaatcttttggacattttggtttttgggttttgtttgtttttttagaatgtaagagaagatttcctaagtagcatattatttgtatttccttttaggaaatgcttttcttatccaactgaaatctttcccggtgtaattttcatgcagagaactatacccttcaagtactagaagatacatttctttttttttcttttgtttgagaaggagtctcgcgctgtcacccaggctggagtgcaatggcgtgatctcagctcactgcaacctctgcctcctgggttcaagcgattctcctgcctcagcctcctgagtggctgggattacaggtgcatgccaccacgcccggctaatttttgttttttaatagagatggggtttcaccatgttggtcaggctggtctcaaactcctagcctcatgatctgcctgcctcggcctcccaaagtgccgggattacaggcatgagccacacgtggcctacatttctattatattgtgtttaaccctatcttttgaaagaataaagaataattttggctgggtgtggtggctcatgcctgtaatcccagcactttgggaggctgaggtgggcagatcacctgaggtcaggagttcaagaccagcctggccaacatggtgaaaccctgtctgtactaaaaatacaaaaagttaaccggacatgggggcacacacctgtaatctcagctactcgggaggctgaggcaggagaatcacttgaacccatgaggcagaggctgcaataagctgagagtgagactccttctcaaaaaataataataataataattttgattgaattctttaaacacatttctaccttaatagaacttctattttggctgaaattctcaaagagcctttcattcttatgtagttgactttaccaattaggtttttccttgctaagttttcttttcattttagtttgtgttgctctcatttttttctttctgttctttcttttgccagtagagacatagttgtctaaaacttttgaaatcagatttcgtttaagttttagaactacttctgtgacaatgtctgagcacagagccactgatcgtgcctttctattcatttttctctctctatacccaaatagcaccattctaactggatttcagtaataactgctttagggtgatagaaagcccaagatcaagaatggagacttcatgtataggctgtagaaaagtcagtgggccaacagaaagagcaccttctgtagcaaatgaggaagaagataaaggaaggaggacacgggaattcgtgacgtatcactaccatgatggaaaatgatcctcatgtttgacaatcatacatttgcttgtagaggatcaagagcaggatatgttcccttctgctccttttctctaagctggtcagccttaggtgtgagatgtagattttgaccctcggttttaaaacacccttatgtatgcaagtaaaatgtaattatttatgagaatgcaattcgtcattttttttcttggacttgggagtttgttgccttttacctttagttgaaatagcttctatttaaaagtatcacatcaggaaactcatctctcttctggtaaatgtctgtactttcaagtggtaaataatctccattgcgttctaacgatacatctgagctgcgatattggttttccagcagatgtcctaagagtttagaatgcccttaacttctcagttccaatgtcctggcagatcaagtggactatttaaagatggatcaagaataggagttatatacacgccttcttgcctggtttttcaaacagagagaaggcaaagtagattcatcctattaaatactacatgtgcctcaagagcatgtcagtgaaatattgatcaaaatattgtcctcttttacccaggaattataggatgaagtttatttttattcgtttaattaaactgcatgttgttttaataatcttttttgtcagtcccttgcccatttgaaagttgcttttcttaacatgaactgttaactagaagcttttacttccctgttagttccaccttagaggttgcctttattctactgaaagtgcttatttgtatagtatattattttattttttaaaaataaggtataatttacacggagtaaaattaaccctttttaatgcacaattctatgatttttttttttttttttttgagacagagtttcactctggttgcccaggctggagtgcagtggtggatctcagctcactgcaacctctgcctcctgggtttaagcgattctcctgcctcagcctccccagtagctgggattacaggtgtccaccaccatacccggctaattttttaaaaaattatctttagtaggtcactcaggacttgcttagaaacggggttttgccattttggctaggcttgtctcaaactcttggcctcaagtgatccacctgccttggcctcccaaagtgctgggattacaggcatgagccaccgtccccagccatagtactatgactcttgacaaacacataaaccagtgccatcaccaggaagtgggcttgcttcctactacacccagataagaacagtatgacactggctccaaaaattccccagtctcctctgtagttaacccctgtccccctcaggggactcagttcctggcaacagctggtctgttttctgacctatagttttgcatttctcagaatgctgtatgaatggaattgtacagtattatgaccctctgattccaatttcttctactcaatataatgcatctgagattcatccatgtcgttggatcagtaatttattgcttttattgctgagtggtattccattgcatgggtgtttcacagtttattcattcacctgttgaaggacatttgggccgtttcctaattttggtgattatgaataatgcctctgtacacactcattttaggttttagtgtaaaggtagtttccattttacttggcaaataccttaaaaaatggggatcagtttcatttccttattcagcgttgctgcatggacttatttgcctctcctcctcactttggttacatgtgggaaaagtcaagcaaaaacttggcccaggggcctctggttccataacaccattggccgggcctctctgcctcagggcctctccggcataggtttcccatggttggggagtcctggaagtccagctttggggtctgggaaccagggaaccagggatcagaaagtcactggactccagggactatatcatagtttaaagaagggcttgagtaaaatgtgaccagaatagcattgacagtaatcaagcaagacgatggtagaagacggaggagttggcctggtgaccaatgcctgccagccctttctgcgcagaagaaatgccaggacccacagacatggctttccctggaaccactcctctgttggtggtctcactggtgcctgccgctagcagagagcagcatggttacaggtgaggccccgcacccaggccagctgtgggacctagtttccagctcaagccgtgaaaacttggctgcacctcctgacccatctcagcctcattatcctttcctgtaaagtgaggaaaatagaagtacatacatcaaaaagtttatgagggtgaagtaaaatcatacaggacaacctttagcaaagtgccgaccacagagtgagccttcctctttgccatttgcagtattttaaggtatttaacatcgatagaccatacaattatggcattgttaagagctggaagctcttctagtctgttgttccccaaccacagggttttcctatatgagtttacttcatccccacaaaccttctgatgcatgtccttctgttttcctcactttatagaagaagacactgaggccgagaggggttagaaggtgtgcccacgtttgcatggcttgagctagaagccctgtcttccaggtggcctggctgcaaccctcctaatccagaatcttccccacaacagcatggcagtcactgatgctctcctggaaaccttctggggaaggggctaagtcttcccttgctctaccttaaagacagctctaccttaaacatggctgttatatattgcaactatatatcattaccatagagcaaaatcaccatgattacatctgttagattaactcttgagtgggcttgcttcctgtttgtgcattcagaataattggtgcgctaagaatcaattgtatttcagcagtgtggtcaccagtttacaactgagaaatcattctctgcacatcatctgtggcctcatcttctcccctgacccaaattggtatttatagatttcattaattagcctagaatcccagaagctcagatgctttgcttgagttacatgaagagcaggtaaatgaaacatgaaaactgatgtacttgtttctttaaaactcatgccccagggtgttgagaaactcagattctaaacagaaatagtgaacgctggttgaattgaggatggatgtgtggtccatggtatttcaaaatcatagatatatagatcttttaaatgacaataatgttaactgtgtcaatgcttggaaataatggaattatgcttggaattaagttaaaattcagtataaaataatagcatatgcagtcactacaatttgtaaaatattaaggatcagaagacaaaacacaataatgtaattaacttgtttcgaattttgtaaaatgattttattgcaaagttagctaaaaataaaactctagtgtttaaacaaaacaaaaccagaaaaccccactactgataaacaacctcagcaaagtctcaggatataaattcattgtacaaaaatcactagcattcctatacaccaacaacagtcaagtcaagagtcaaatcgggaaaacaatgtcattcacaaatgccacaaaaagaattaagtacttaggtaactagggaggtgaaaggcctctacagtgagaaatacaaaacgctgctcaaaaaaatcagagatgacacaaacaaatggaaaaacattccatgttcatggataggaagaatcagtaaaatggccatagtgcccaaagcaatttatagattctatgctattcctgtcaaacgacaagtgacattcttcatagtactagaaaaaacttttaaaattcatatgaaacaaaaagaaatgagccccaatagccaaggcaatcctaagcaaaaagagcgaagctggatgcatcagtgttacctgacttcaaactatgctgcagggctacagtaacccaaacagcatggtactggtacaaaaacaggcacaaagaccaagggaacagaatagagaacccagaaataagaccacatacctacaaccatctgatcttccacaaagctggcaaaagaaatggagaaaggactcactattctataaatggtgctgggataactggttagtcatatgcagaagattgaaactgtaccattccttacatcatatacaaaaatcaactcaagatggattaaagatttaaatgtaaaacccaaagctataaaaaccctgaaagataacccaggcaataccattctggacataggaatgggtaaagatttcatgatgaagatggcaaaagcaattgcaacaaaagcaaaaattgacaaatgggatctaactaaactaaagacctctgcacagcaaaagaacctatctacagagtaaatagacaacctacagaacaggaaaaaatgtttgcaaactatataggtccaaaggtctaatatctagcatctataaggaacttagacaaatttacaggaaaaaaagaacaaccccattaaaaagtgggtaggctgggcgcagtggctcatgcttgtaattccagcactttgggaggcaggcagattgcttgagcccaggagtttgagaccagcctgggaaacatggcaaaaccctgtctctatagaaaaaaaaaaaagtccaaaaattagctgggcatggtggtgcatgcccatagtcccagccacttgggaggctgaggtgggaggatcgcttgagcctgagaggttgaggtgtggtgagctgtgattgcaacattgtactccagcctgggcaacaaagtgagaccttgtctcaaaaaaaaaaaaaaaataagcaaagaacataaacagacacttttcaaaagaagacatacacagtggccaacaagcatacaaaataaagctcaacatcacagatcattagagaaatgaaaaatcaaaatgacagtgaaataccatctgacaccagtcagaatggctattattaaaaagtcaaaaaataacagatgttggcgaggtggtggagaaaaaggaatgcttatacactgttggtgggagtgtaattagttcaaccattgtggaaaaacagtgtgatgatttcccaaagacctaaaaacagaaccaccatttggccaaccaatcccattactggatggatacatacccaaaggaatataaatcattctgttataaagacatatgcatgcatatgttcattgcagcacaattcacaatagcaaaggcatggaatcaacccaaatgcccatcaatgatagactggataaagaaaatgtggtacatatacaccatgggatactatgcagccataaagagaacgagatcatgtcctttgcaagaccatggatggagctggaggccattatcgttggcaaactaacataggaacagaaaactaaataccacatgttctcagttagcaggagctaaatgataagaacatacagacacaaagaagggaataacacacactggggcctattggagggtggaggatgggagtagggagaggatcaggaaaaataactaatgggtactaggcttaatacctgggtgatataatctgtacaacaaaccaccatgacacaagtttacctatgtaacaaacctgcacatgtatccccgaacttaaacacacacacacatacacacacacacacacacacacacacacacacactccagctactcctactaagcagtccactctgcctggaagttgctggaaggactccatgcgaaagtggtttctctcctcccagaacatgattttactggtttctttcaaagcctattcatcatcctcccttcaggacactcttaaaatttgccttctgtggagctctttaccataagaacaagcaacaatgacatgttccagcccattagtgttaatatttgttgatccgaagatggaaaatacattttactagacccttgtttccttcttgctgctgagtatattttcaatctataaagcttagataaatttcgtatatgctcacctttttttgtgggagacttgcaagagaaacctaccctaaaagctaacctagccaccttctatttgcagaaataaagcaaaaatcattttagtgttgattttgatgtaccagaacctaaattgcttaaattaaaaactttttagagcagtgtgtagaattctatttgtgtccgtgagtatggctaataactccattttaagaaccagaaaaggaaataaaataagttaaccatctcccttgagctgcaaaagttgctaatcaaaaacttcatgtaaacaatgtaccgatatcagactctggttatgatctgtatacatttagtgtgcaattcaagtataaaggctttcattttttggcagcccagatgcaaacaataaaataatcctgcttatttcctctcagcagcaggttttgtcatccatatgtaactgaccgaacagtgtttagccacaaacagaaaacactttctgcaggtggttagttgtctttaatatgtctcatcaagcctatctgtgtgcttctgtgtgggctgctgtgctcttcaaggcctaggtcaagtgccttggccagttagtggttagataattaatagagactcactaagtatgtattatttaccgactaccactttcctgattgctttgaaactaatgaaatgaacaaaaaatgtaattatggtccttgagggaatttatgatctagttagaagggttaggaaatactttgggcccagacacagtggctcacacctgtaatcccagctctttgggaggctgaggcaggaggattgcttcagcctaggcgttcaagagcagtgttggcaacaaagtgagacctcatctctacaaaaactaaaagaaagaaaaaaaatagccgggggtggtggtatgggcctgtagtcctagctagctccttgggaggctgaggcaggaagactgattaagctcatgaggtcgaggctgcagtgagctatgatcacagcacaacaatgagaccctgtctcaaaaaaaagaaaagaaaaagagagagagagaaagaagaaaggaaggaaagaaggaaggaaggagaggggaggagaggagaggagggataggggagagaggggagggcaggagagaagagaggagaagagaagagaagagaagagcaaaactttggaattgtttcataggagtggtaccttttcccacactgactgtaaaaagttcagagaaacaaagggattttcacagcagtgcttgcaattccaacatctgccttgtgactttcaattttgagttaatatttgaaactgtcttcgttgcctgcataaagtgatcaagtgaccatcagtacaaagactttttcacatacctgttttaattgctctggagaatgcctgattctctgagttattgcctagaggttttcagagtaaattacaagagtactacatagactttatattaagtcgggtcaccccaaatattttatgaaaacctgcccagccatttctacatgacatggtaacaagcatagagatgaaaattttatttatctagattaggcaaaattctcctatacgctatgtttaatgccatgggttgtctatattttatctttatattgtgcaaatgtgtgtatgtgtattatacacacatgtatgtagaagtacatatgtgtgcacatatatgtgtataattgtatgtacacaagtacatacatacaaatactacatgtactatcaggctttctcaggggagacttagtgttttttttatctttactggaaaaaactgttgttggtaatagcaaagacattttgtgttagccattaacgagatagcagagaaatcctttgctatctaatatgtcacggtgaaggccactggtatgagcttatgttgaaattcaggatttttctgatgtcatgagtgtactcaggtgaccacattttgaatctttttacttttaaaaacaattccccaccccagttctttagctgagattgtcatttgaagacgtgtgccctgttcatccagctgcacatgaccagaaggccctggagaatggtttaagccattttgaagagcacagacatgggggagaaggaggtaatcgtcatcaatacatcatccctacctctttcaaacttctgtatatttttcgtacttggttggtttgtttttgagatggggagaagacagagggaggacagaggctctcaaggagtttgtgagtttagagctggcctgatggccatgagcagcatgttttccatcttgaagaaagaagaggtgggaattcagaatggtgcagctgccttggtaaaaccttacggtggctttatttctacttaccaaatactagaaacaacctatatgtcccttgactgagaagtggataactgtgcagtatacctatgcagtggaatattacttagcaacaaaaaggagcaatacacagaatacagtgctttgctgtgcaaatgcattgtgctacatgaaagaacccagactcaaaaatgacaccctttcgtatgattttgtataaatgcatgattccacttatttgacattctgaaaaagacaaaaactgtggggaccaaaattagatctgtggtttccagggtctttgggtggaggaaaagggtgactacaaaggagcacaaagggtttgggagagtgacagaaatactcggtgtcttgattatggtggttacacaagggtgcgcagttatcaaaactcacaactgtacattaaaaaggatgaataattattgtatgcaaactatatctaaaaataaataagaaacagatatatatattccagtaattgcttcttggtatttgaatcaggccaaggataacatctatcagaaaggtcttttattgatattgaaattctgccccaacgcattccctctcctacacacacacacacacacacacacacacacacacacacacaccttctctctctctctgcctgcccccaccatctcatattttcttgtaatcatttttatgggatttataggatgtccagctcatgcacaagtgtcagcctcttgtttgtaatctcggtagctcagcctcccgagagtgatccagccatccatgactgagttttgattcaagaaacaggactgtgatcaagatattaattctatgcattataaaccagggaacagttggaaaaaaactaaagcttagtctcctttaagactggaaaagttgtactttatatatgcatatgtgaatagtagcagggaattttcttgcattcaattttctcattcctgagaggttagatggttcaaatgtgctggggcagggagggattttcactcggctgtcagagcttcatatccctcactatttttgagttttaagaagatatttaaaatgcttatgtttctatacattacattaacttttaaatatgaatattatagtaaataataaatcataattcacaagtgcaaagaccttctgtgcccatgtttagcatatttggtcgatttcttttccatggcactcaatgacagctgaagaaatttctttaggatgacagattgtcagcacattgacatagattgttttagatgtatatttttagtgggaatgaatgaaatttaagtgagcttttctcagaaatatagtaataaggagaagagttgctatttcatgtgtcaagcttacaggacttttttccccctctttgggttatagtcaacctaattagcaattattaacaagtatcttacaaaataaaaagaaaatttggaatttgctgaaagcatcctaacatctactagaatagcgctattgataagtagtaaagaaatttatctcaaatctcccttgcccaagatagagaaaaattaattaagaatactctagaatttttttctggtcctttattgaacttcattacttaattagtccttagagagaagaaccatcaaaacttggtaggtggtgacagcatttttttacatttatctgtgagatggaactagaatatggagttcacaggacagcatttcactaacatatcttttttttttttttaaaagacagggtcttgctctgtcacccaggctggagtgcagtagcacgatcttggctcactgcaacctccacctcccaggttcaagcaattctcctgcctctgcctccctagtagctgggattacaagcacctgccaccatacccagctaatttttgtatttatagtagagacagggtttcttcatgttggccaggctggtctcaaactctgacctcaggtgatctgcctactttggcctccgaaagtgctgggattacaggcacgagccaccgcgcccggcccataactagttttaaaactatgattacttcatagaatcctggtttcttcagaaaactactttatcaggatgaagggctaattgtgtggttatgacctagttactgctggaagtgctggaaatcattcaataagaaggcaggtgtgtgttgtttattacctccaaacatttgggaccctctcttcactgcataggggccgtgagtactggagttccaaaaggagagtgggacacacatgaaacccattttaatgaaggaatgtccaagctggttccccagatgctgaaattagatggggacctactggggaagagccatttccaaacaggagagaacaggcctagcttcctaaaggactgtctcagatcttcagcactagcccagagggaagtatttctccacactcacttgaaatggccactgtgctacacagagcccttatctggattccttttaaactgcaaagattttaaaggagagatctttatgcttttttaaattccaggtgtattactcattaaatatggacattgtagccaagaacagtgtagttcccatggtagtggaccgtattatattttatttagttcttctatattacttggttttttttaaatctgtgtttggctatttaaaagtttatactttgatcaaatgaataatatctagtatttgatagcacaaccaggtgactatagtcaacagtaatttattgtacatttaaaaataactaaaacagccaggcgccatggctcatgcctataatcccaacactttgggaggctgaggcgggcagatcacctgaggtcaggagtttgagaccagcctggccaacatggaaaccccatctctactaaaaatacaaaaattagctgggcatggtggcacacacctgtaatcccagctgctcgggaggctgaggcaggagaatcgcttgaacccaggagacagaggttgcagtgagccaagatcgcaccattgcactccagcccgggtgacaagagcaaaactccatctcaaaaaataaataaatagctaaaacagtagaattggattgtgtataacacaaagaaaggataaattcttgaggtgatggatacgctatttaccctgaggtaaaatacctatttcaaaatatctcatgtaccccataaatatatacacctaatatgtatccacgaaaactaaaaatttaaaattttattaaaaaataaaataataatttacattttggtaattggttatagtacgttcttaagagaaacaaataaaactttacattaactatttggacttgaaggaaacgatttcatctgcaactatatagactgttaaggcccgtgttcccacttttttaggaatttgatggagaggttgtcttactaccataggttttatttggtttaggtttccttttctatagtatttttacattttaaagggcccaaattgttcatttaatgggatgactgttaatgggtggagtctcccagggccgattagctgtttgaatgcaagtttattactcataatggcactttttttaagtgttaaagttttggtaaacatttcatctgaattcataaaattaaaagtgttgatatttcattataactgaagggagaaattgtatagaattagcagttgattccgtttggactgtgaataattatctatgggaagggtaccctgattaaatctgactatttaagagataagtgaatcttaaattcttaatttacaaaagtttgatctatatccaatgggaatgaatctctttttgtattccatgattaattttttttcaagaattccttaactcccatgttattttccctgtttaattttgcagaggctatgacttcctcaatgcaaggttccttcacccttgagaatctcctggttactaatggccaccatgtgtcacataatgagcttccagactgaaatcagaccaagtttgtttcatttgcactataagaaatggtagttattcttctgtgaagacatatatagaatgagcagtgatgcatataactgaaaatccctcagggaagcatttgttatttgtgaaaagtgtcatctcgttctctaagaacttcctcagctttttctgtttgtttaggggagggcacaggaacatgatggcatggtgttacatttggtgatttggtgcacacaactgtctgtggtcatgcactttgatgtaactcttgtccaactggcctatccaaagtacagatatatcttcttatagatggcttttaaaaaaaagtaaaaagcccatcctcaatagataaaaactattgcaaacaattttaaatccttaataagaaaataatttcaaattgctgtgcattgacagtatttgaaggaggtggggatgttataagggatggtttttagaaagaaagagctgagagacatgaattttgcagtgcagagaacatgagctttagattcaagctccagttgaatgatctttctgtacttcagagtcataattataaaataagatttagttgacctctgcaggtagtagtggcagttaaatgatgcaggggaggcaaagctttacctctatcctcttagggtcctggctgggcctgagaattaaatggacatgacaaattaagccaggcacagtaatcccagctactagggaggctgaggcaggaggattgcttgaggccaggagtttgagaccagcctgggcaacatagtgagacccccatctctaagaaaaaaaaaattgacagaacaaattaacaggagaaaagcacaccaatttatttaatataagttttatgtggcacgggagccctcaaaggaaaataaagattaaaaaaaaaacacagtcagttatttttatatattgaattggacaaacaaagataagttgtaaaatgcgataaggccagcaggcttggcctagggtaggtaattattggagaaggaactaggatgataagggttagttaacaacctttgtgcagatttcccttggattcaaccttctatccttgatgataagaatgctactttccttttggggtaggaaggacatctttcacatgggagtttcacctcctgcctttaagaaacagaacgaaggtcacagtgatcttcttgtgcctgctgttttttaggttcccttaaatcaaaacagccaatatgccagaacatcatatttttaactcctttggtggcatgaatatggagctcctacctgagtctaaacacatgcagccgcttcccagacacggagtcattgccatagatgattatgtgggatctgacagaagtttgttacttgaaaataatttcacacaagtcttccacgttggagggcagctgtgggctgcagaagagcctggagagagtagtccctgtggccttgcctccgtccctgagtgtatttagatgaacaaggacctttcccctgaacatttgtctgcatggatttttaaggactcccttctctggaagctgccctcaaagcatttcaagtgctcttgctgatggcagatgaagctgccgtaaagcagggggatgtgattgagcaaaaaatcttttctctttcaacccagcagagcaaaatagtaactctacttcatgaaaacaaaattggctgtttccaatagagcactcagatcttcaggaaaatgtagcatatttcctaaaggaggttaaaggtgaatgaaacctttgctggtggttccatatattctaccataatcgtaataacaacagcagctcacatttattgggccttttaatgtaccgtccattgctttaagtgttttacacatactgtattcacttatttaatgtccaccaactcctaagtccctgttagatgatcttcattttacgtgaggaagccaaggcacccagaggtgcgatgtaacttgtccacactcaaacagcagcaaagctggcatttaaaccagacatgctgattttagaacactaactgcatatgctgcatctataatgagtaaaaatctataacaggtaaaaatgtacaatggagaatggtgggaaccagtaccaggaacctgtgcagacctggtcagagcaggaaaggaaataaacacagttacatgattataaaacaacaaattggataataagatcagtcctgaaaagtcaaccaaaagatgctcacgccagacattattgcacagtatcttgaatcaggcccagatatctaaaataagcctctttccagtgatttttcaagaatcttgcttattatatagggtgcagcaactcattttgactttaaaggagtagtgtggcaggctcctggacacctggaggcactatatgaatttctgcctaaaaattcatccataggaaggagatttgctgaactgagaaagtgaacatttcacaagaagtacatatgtctccatgctaagaagtaactccctgggcgatcgccgtcatgctgagtgtttccatctccaagccctgctgcagcctgcctccttgtctccacccatgcctggaaaacctaaccctcataaaagtctcagtaagcaacagtgagaataactgtaaggtgttacaggagagatggttttggcagccaaaaagggcttatgatcctaagatccaccttaaaagtgttctgttgcccagttctgtattaattctgagcagaggcagcagaaagcatctttcagggtcgagaatttctgagatcttgaccgtcaggaaaaggatgcttccaggcagccgtggaaactgaaatccgagccctaatcttgctcagagctgctgaggtctgtttgtaggaaaacatcgggttattgtctgaataacatacatccaagttacaacgggaaaagaaatctgccttatggaaagagaatgaacatttgctgggtagagtttatgcctgcctagatgctccacctccaggctctaggtactctacttcggagtgcagtctgcgctccctcttctgggatggctgcggagcccagggcatctctctctaaggctttcaacaagtcttatgggctgtctagactcgctgtcttggaatgagttagtgctctgacctgaggaaaattccccatgtttctcagtgtcaagccaaaatctctagggcttcagtattgccccacggttctggcccgctggccaaacacataactctttttgcagctcatacaggtaaatgtgagccagtgctgctcttacaacctgcctcccacatccctgtctgtgggtggctctctcctgaagatggtacttctccagaagtttccaaatgatcagagaggaactgcttctgggtactcctccttctccttcttcttcttgccagaggccttgaatttgctattgagagatttggcaatatactttgaaacgtgaagataatgaagttgttgggtgtgaacaaatgttacttgactatttaaatattaaaaatatgatatacatggtgtattagtccattctcacactgctaataaagaactgcctgagactgggtaacttacaaaggaaagaggtttaattgactcatagttctgcatggctggggaggcctcaggaaacttacagtcatggtggaaggggaagcatacatgtccttcttcacatggcagcatcaaggagaagtgcagagcaaagtgggggcagaaagccacttataaaaccatcagatctcgggagaactccctcattatcacgagaataacatgtaggtatctgcccccatgattcaattacctcccaccgggtccctcccatgacacgtgaggattatgggaactacaattcaagatgagatttgggtgaggacacagccaaaccatatcacatggtaacctacgttagagattcgttgtatgaatagcagaactttaaaaagttttgccttgcagaaaacagttcctattattgttacaaataagtatacatcatcttagaacttgtctttacaaatatgaacaatgagtaatggcagggaaacaagtggttaagattcagtgattgaggctcagtttctatactggcaactccatggagagcttgaagaccagcagctacattccctgtcttgatcatccgggggtaggaaaagcattgaaagatgggatgactaatgcctgctaaatgctggccaactttaaaaaaaattgactttagtattatgagatacgaatggcatattttaattaggaaatacagtaatcctaagtgagcttcatttcttacacaaaatataggaagatgatacatgttcactgtgcttgagaactttttctcaaattcaatgcagaaaggcagtctgtgaggcagtaggaaatgcagctgctggaattctgttatcagtatgtgtatcagttctgattgagttgtaaaatggaagcctgatgtgctggatattaatttagcaatagataagtctgaaaatagacttaccttcaatttcatcataaaagtcaacctcccacctaacacgttgaaactcctgtggttgtgaaagaagaaaaatgaagttccacttccctttcattccatgagccccttcagtggttactgcctcactagaggtgcaagttactagaaccgcagaatataaactgttacataaaatgatgaaatatgcgcacagaaaataagggagctttttaaaataaaaactaatttgtatgctttggaaagactcaaaggtgagtttttttttttttaagctaattagatatgggtaagacaactgtgaaaaactggagaattttttttttaaaggcgtgaaggatgtacactcaaattgccttgtaatttttcctttacttaaaaccctgaaaccggacattttctaactgaaatcacattgacactctgtggtatctatgtgtgatggagaatatggagccaggagagcagttcttggatacagaaccacattttggttgaatgactttatgtttatgtattcgtagttaaatgcaatatgtatgtggtcaggtttcatggctttttcaagtgactaactacaggtcttaagtaagtcaggtgacaggattgtaccagatgtaaaaaacgagtttaatataaactcatcaatttgttgaaactgaatatcaaaatgagaacctcagtgtttggggaacagttaaatctacaacatagtaatttagtagaggttcatggagtcaatttaaggaatatcccatgatatgtaaaaatatatatgtatattattaaattgtatatttgtaaagatgtggcccagatataaactttatttacctccagccatataataagtaaatatcacacagattagttgtgcagtccaactctcgtgcgtgtgcacagatcagcctcgggaccaaaatgccacatccctcttccccatatgttagtattgaagttctgccaatccttcaaaaactgactcagatgttaccattacctgaaggctttcctaagttctccacatcaaactgtggttcacttagccaaacctgtttgtcgttaatacgttggaatattacctgctgtttcctgtagctagaagtggtgcttagtactatggttttcggaatcacagtactgaagaggcatctgagaactgtgtatgtgtttgcacacagtactcaatctctagcttttctaaaacgccatctctggcacatttgcttaacttattttaaagagcacacactgaagtagtatgacaagcagcacaagaacttctgttttctgtgttggaagaaataacaaatgattatacacagcaaggacaaagagatgagtttttagagaaaaaagcacattagcaataatattccactggcgaagtcactacctatgcatatcatatattgtatacattggcaaagcattttgtttcaactttgccttttcgttttttccagtatgtataaaatgcttgtcttaattaatagtcattttctgctgggggtggggtaaggaatggccgttttaatgatattaatgtacagtggattcttggctgtgaaggagtgttaccaaatattacagcttgtattaaaagtgtaaagatagaaataagtggtgcctgtttaaaaagctataagatttagaagcctctccgctctgacagggatggtaaagctcattttaattctgaaatgcaacttccatgtgttttacagtttaattttctataattttaaccaattttatataatgagttttgtagctttataagtatattaatctaacaattaaatagagaaaaacaattgtttctacacgtacaggactagaatgtgtggctagtttctctcttattggtacctctacacagtggagctttctgtaaacacattctaaatatagaagtgtctttaaagatgagcttttcctctttttctgttaagacagagcttcctttgggctggcattttgtttactctgaaggggctcctccaggagagacactctgaaccccgtgcattctgggtgccgagctgccgcaggctggtttggggacttctcaacttagtgcgcagaaaaatgaattctgtgaacttaaaatcagagtctctgcccaaggggacttctagcatcaagaaaaggtagaagctagctgaggtttaagaggtttgtgcaggagaaaaatgaggcgttaaatggttaaacactgccagcagatttttagcattgtttaatagttttaaattatggaggtcttaggtccaaaatgtaacagttatccaactcactgacattaaacattcagttgccagcttctgttttcttggtcattaattttcagtctatgtattttcggtgctttgctaagagttttgttaaaataacttttcttgtttgcattctcatttcctacaaattcagactttgctttagaatccaacagatggatacttggagttagcttattttttccatctaccctattttttttccttctaccttttatttaatgaggaggccaggtgtggtggctcacacctgtaatcccagcactttgggaggctggggtggacatatcacttgagcctaggagttcgataccagcctgcgcaacatggcaaaaatctatctctataaaaaatgcaaaaatacaaaattagccaggcatggtggtgcacacctgtattcctagctacttgggaagctaagatcagaggatcacctgagcccagggtggtcaaggctactgtgagccaagatcatgccactgtactccagcctgggcaacagagtaagaccctgtctcaaaaaaaaagaaaaagagtaacaaagtaagatatcttttgtctggttataataaaagctgtagtatgtataatttactcaaaagcagagcttgctttggaaatctctacatgcttgaaatttaaagcagtgcatatatagtctccatatgtattccatactgtaaaccatgatggtgttccagggattgagtctgagtgtttataaaatggcacatggcacttaattttgaaaccgtggaaatatttaaattactgacttgatgaaggctatagatcaatgtaagaacttattagttctcacattgatttggatgcattcaaagatgctaaatgattgccaatatagtttttttttctggactatttaattcatggtaggtatatccagtatgtataagaaagtaaaaaaaatgcaaacactttaatctcaaataacagtatgcagtgctctaatgtaatatcttctactctgaagggcaggtcataagagcaggctcctggtgatgagatgggagatcattcttcatttgttggaagatcaactttatttcatgccctagaaatgcttgctttacaaagaaacatacgtagggcagcatgtatcctgaggtttccaaaagagaaaagatttgttcacaggggtaagttgaggaggcgggagaacagctctcaaatccacctccctgccgataagacttaggaatatttttgggttaggaagtaacaggttcatttgtgcaagcgtatttggggttcttggcacttcatatgacatatatacagaagatggcagctttagcatgatctgtgggtggagttttttggccctctggcttcaaaaggccacctctcaggcatttgcgcaggcccacttgaagggttggtggtctcagctggtttgaagtgaacagcagctggcccaagtttctgaaaaacagctgaagccaacattaccaggaatgtcatctgtaatgcagccagtaatggttaagtttcagtgttctgtggcacggccttcaacttcatggaaaagggacaaaaataacataaagcaagtggccaaaagcaagcagagcaggcagttgtgatcagattaacctcttggtttcactgctatgaacatctgtatacaggttttttgtatagaaataggtattcagttctcttcaatacctagaagtggaattggtgagtcataatgataacgctatctttaacattttgaggaactgttgaactgttttctgaagtggcttcatcattttacattcttaccagcaatgtgctaggttccagtttctccatatcctcaccagcacttgtattgtctgtctttttttactataaccattctgatgggtttgaagtggtatgccattgtggttttggtttccatttccatgatgagtaaggatgttaaacatcttttcatgtggttattagccgtttatatatcatctttggagcaatgtctattcagattctttgcccatttttggattgggttgtctttttattgttggactataagtgttctttatgtaatctatatacaaatgccaaatcctatatgagatatattatttgtaaatattttatcccattctgtaggttgtcttttcaccttctttatagtgtttttttttttttagcacaaatgtttgtaattttgataaagtctaatttatctgttttttcttttgtcccttatgcttttggtgccttatctaaaaaattactgcctagcccaaggtcaaaaaactttactccattttcttgtaggaattctatagattcagctcttaaacttacgactgttatttattttgagttattgtttgttaatggtgtgaggtagttgtccaacttcattcttttgcatgttgatatatagttgtaccagtaccatttactgaaaagactattctttttcctattgaattgtcttggtaacttgttgaaaatcaattgactaaaacagagaggatttattcctggactctcagttctatcccatttatttatacatctatctgcaaaattattttaataaaaacaaatagtgagcacattaatccagtgtgagtaattcatggatccattactaaatctttgtgaaaaatagagaatggaaaagtatctttaatcctgttactgtaaatgttttgctgtatttcccttgagtagacttagaccatttaattcctttacaacagctattcctacctgtttctttttttaactcactctgctcatgttacttcttttcctgtgcactcgagaagccagaagtaacactgcaaagcacaataacccctaaaatcacttgtctgtctcacacacacaggaagaaaggaataaagggtaaatttccttttaatattttatgttttattgttctttttttctacagtaagctactcatttactgcatctgatactgaggctctacagtagccatgcactttagtctgtctcttaagacacttttggagatattttcatcagtggtttaaatcacaagttgccttaatttaaagacaagaaagagagcattctgaacaaaacataaacattttttagcccaagttcaaactggcttttttgctccccaagacttttttttttttttgagacagggtcttgctgtgtcacccaggctggagtgcagtgccacagtcatagctcactgaagctttgacttcttgggctcaagtgattctcccacttcaactttctaggtagttgggactacaggcatgcactaccatgtccagctaaatgtttaaattttttgtagaggccaggcatggtggctcactcttgtaatcccagcactttgggaggccgaggaaggcagatcacttgaggtcaggagtctgagaccagcctgggcaacgtggtgaaatcccatctctactaaaaatacaaaaatttgctgggcatggtggtgcatgcctgtaatcccaactattcgggaggctgaggcaggagaatcacttgaactggggaggcagaggttgcagtgaaccgatatcatgccactgcactccagcctgggtgacagagcaagactccatctcaaaaaaaaaaaaaaattttttttttgtagagttgtctcactgtgtcacccaagctgttctcaaactcctgggctcaacctcccacctcagcctcccaaagtgctggtattacaggcttgaggtactgtgcctggcccccacaaagactttttatacctgaaatacctatttaaagtatatttctacttaaaattttttttcatctttcagatacactttaatacccatgtcttaacttttacaaaccactgtaactttataaacagagattacttgagaagcaaactggcaatccatattttcagagagctgagaggttttccacagagctgaaagagaactaaggaatacaaatctcagaaggaagaattgcgtcctacctaagaggtaggcatgaaggacacatgcactttttgcaaactgtgctgttgaaatttacacgctacatcttcagttgtctgacttggacaatgacactgcttgtatatgaaataatattagcttaaaattattaaacagtgaaatactgcttttaaaagtgaggtgtcttcaaagatgggaacaacagacacaggggcctctgaaatgggagagggagaggccgcaggttagaaaaactacctgttaggtacttgtgttcactatttgggtgacatgatcagtggaagcccaaacctcagcatctcgcagtatacccacgtaacaaacctgtacatgtaccccctgaatctgaaataaaacaaagaataaaaatgaagtgtcttatctaaaatgaaaatctatattgctttgccctttcaaacttaacatgtccaaaagagagctgttgattctttcatctcaacactcgttcttcctgctttgtcttcccctgccctgtcctttcccctccctttgtgatccacccctgctgagcttcccaccttttggcaccacgctcataattccttattatgctccagctgtattgccctctttacttatctgaacaggtggcacttttcttcctctagctgctttgctcccaaatgttctgttcccttttgaaaggttggtgggtctctcctctagctcacaacaccctgtgttcttcagagctctgatgttcttatttgtacgtttccttctgtattacttgtgtcctcactggtccataggtgccttggagacaaggatcctatctgtctttccccctcaatctccagctcctggagtagagcctagtccatagttggtgctccataaatatgtgttcaataaatgatcaagcaggagtgagttataaccagaggtcaaaaccctggggcatcggagaagacatgcatatgtgtcaagtcgtaattaatgtgttgccccagagaggaccatgtcagctgtctgcttcctggggagctggcttctggcagcttcaaccatctaaatacagtcaaggagaaagttgcatcagttccatttgtttttgtttttccattggattttgaaccccaggagaacagttgccataacagctttccttcagcttttggtagtctctaacctccattcaatattgactactgtgggaaaagcactctctctgaacgaggcttcttactgtttctgaatttacccatacttctaatcttattgctaactaatttgtacagaagtctgtttctttagatagtaagttaaagatgagaatttgaatggagactgctgatctcgctataggcccatgcagccagctcctggccacatctcaaggctcagctgaagtggcctttcctcggggaaccctccttcaggtccttggcacattttactgtctttaataaatagcactgactccatttgggatgaaaaaagcaaatatgcagtctgttattgggcccagccccaatttaaacatcttgagggcagagaacatctgtcttttttttttaaggaaaaaaaaaacaaaacactactctatctccaaaacctgatatgtactcaatatttaataaaaataaattgaattaattaatcctttccaaccttacagatatttctgattgatagatccattgtccagcaacaataatatatgactatgtctatcttagtaaataaatttctaaaaagctcaaatactgggacatgaatggctcactgagagcaatagggtgtggagaaagagagagagggagcgagcagagggagctggatgtacacgcagttgcagtcagtcacttgtttcctgagtagactatttgagtttttgaacggttattggtgtgattatgtctatcccatcaaattgttgatgaactttccagttttttttggaaaataaatattaaaggatacaattctgattatgtttatatttcgtttcattttgttttcaacttaccctgtgaatttcgtccatgatgttatggtatcttaagggatgaatctaatacagaattatgcacaatttttgtcatttgcctcccttaaaagaaaaaaaaaatgtccatgactatactaaaagatcctgtcatcttaactaagaggcagctgtttccctggagttttttccctcttaactatatcagctatactgagtgggatgtaatcacatgatttaaaattgataattagtgtgtgaaaggcacttggcaatgaaatacatagcaatatcagtgacataattttggcagcagaaaaatgctaaatataatccaaatgtcaatgtagaaatgaaaacagtactagctagtcaatgatttatataatgtcttgggaaaatgaagtcaattgcatcaaattttaaatcaaaataaaatatactttatttaaaagttatagaagctggaggcgtagtatacgtgtgtgttatgtgtatgtatatacagtgtatggatatatttaatatcattaaaaatgattatccttgccccggttgtacttctcttctattcataaaccctaaagaaaagctctttagatttttcttctagggcaaggcgcaatggctcacacctttaatcacagcactttgggaggcttgaagtgggtggattgtctgagcccaggaatttgagacaagcctaggaacatgatgcaactccatctttacaaaacaaaacaaaacacacaaaaattagccaggcgtggtgacatgttcctatagtctcagctactcagatagctgaagcaggaggatcacttgagcctaggaagttgaagttgcagtaagcaatgattgtgccactgcactccagcctgggtgacagagcaagaccctatctcaaagaaaacccaattgtttcttctggaagttgtcttcatatctctgaatatgtgtgcctattttgcagtatgctaaatttggttcattttagacattatcttttgacttcctgtttcaacaggtgaggatttccctctctacattacagctttgcctcctctccttctcccttcccacatagttacatctctaattttaattaattcagggatccatgataacctctttaaattatgtaaataatgttcattgtagggctaaaaagtatgatttttttttctttcttgttcaggtttcagttttctctgtggtttctaatggcctttctttttgtcttttaccctaactgcatcccacatttgtttaatactctcaagatgtaccattatagtatgtttgtctgagtctcttgtcccccttccccttccttctgaagcaccctctcctccagtccctatctggactgcttgctctctaggctctgcttgctgctggacttcacttctctttgatgctctccaggagggcaccatttcctggattccttgttttctttattcttagtttcctcactcacattcctgaagtatatgtatcaatagattcttactgttacatcagcagtatatttctgagacgttggatagccacaatatctttattctttgattatatttgattggtagattagctgggtataaaattctaggctgaaattctttttctgtcagaatgctatgtgttgtttagcttacttctggttgattggaaactcaatgcaattttgattctccatctttggcatttagattctattttctctttatgtttagtgttctgaaatttacaaagatatgtgtttttgtggatatccttttcttaatgcgctttcaatctaaagactggtttcctttagtctgggaaattttcttctattattttttggtaatatcctcctttgcattttctacattctgtctctctacaacttagtcatatatttaaccttctgggtttacattctaatcttatccttttactgtcttggatatttccgtgacttatcttctaggtcctctattgaggattgggtttttatactctctttttaattttcaagttcttttttatgtctttttttccctacaagcattctgatcttagtttacagatgtaatatcttctcctatctctttgaggatatgaaataaaatttatttaatgttttcttttgttctctcattcatctctgttttctctgtgttctttcttgtgaaaacttctcttaaaagccccaatgggtgtgttcagtctttctttaattagctcttttatttattaattacatcatttaacatccatctagtaatgcaaatattgaaatactgaatggctaatacatttcagatgctagtaaaagtaacatatgttcacagtaatttgaccctgtgataaaatgtgagagtttttttcatggcttatctcttttattttcctttcctggaagaatttccagaaaacaatagaatttctgttgttatgaaaacagtagagaacaaacttgttagcaaatgtagataatgaaaagcactatccatctcctttaaattctgttgtggaaagggattttacactgtgcaaatacaaagaatattgtattttaactatatatttattcatacttggatgataattaagaggaccttccatggaattagctgtggatttcttttccaggtgttcatgattgtgtcatatattcaggttaaatcagacattagcctatttagtgaaattctaatgtatacaagcatctgcagcaataaaatatattttgaggattttactcctcataaaacacattccatgctgtaattatttccttcagcagttgctgattccctatctatattagtattcttaggcttttcagcaggattgaaaaatatttctgttgattgttcagctactgttctgaagtcataaaagtacacttacaatagacaacttgctatatcaatgccttaaaattattttcaataaattatggtattttctgaatattaataatgccataattaagcataaacaataaaatgaccatgatagtagcttgattgctaggaattttttaaggcaatattgcttgttccttctgaaaataaaagctgagagcaaagagaaaggggaaggagaaaggaacaagtattcaagaatggttttccacgtgaaactgtgagctgaatgcaccagcatcatccacctgcagctttctggggcctgggagggacacgtggtgctgactgagaggtggggctcctggtgctgtttcccatttctgtccttgcaggggtcttagtgctaagccttttgcagcagctcctagtgtgggcccttgaggaagctgccacttctgagtgccagaaactgatagccgggattgtggggtctaacagctgggacgaagggccaaggaggagagtgcttttaccatgggcggcacaggttgggctttgtttgtctcatgtcatttttgatctgttggacagacagggctattgagccagcttgacctcttctgtaacctcttccccactgccattctcagcaatggctctggaggaggtcatgcttcctgattgtggccagtcatgtctgatgaagtctctgtcccagaataaatacttacttagggttaaaatagaggagccataaactttaggtaccgtttatgaaatgtattgcaaagtcccttttctttgcttctgtccttgcccttgacctttaagtgttgctgtcgcccagaggcccaccatggatttcctcttgcctccttacataagttcccttgctggagacttccactgctgtggttatagcatatttgccaatgttacaaacatttttcttatcagaaactctcccctgagcatcagccttgtgctgtggattttttcctggagagcccacaggtactgtgccttaaacatacccccaaaatacattcatctaccacttggcgctctccctcccgagcttcacctttggttgtgtttgttgccatctttcctgtctcctatcagaaaatgcctggagtcattctttgctgccaccctatatcaggtccatcagccgggacctctcaggatctttcttcaagactaatcccagctggtctcaaactcctggcctcaagtgatcctcttgtctcagcctcccaagtagctgggattaaaggcatgtaccactgttcctggcccatgtgggattcctgcctctcctgacactccagcctgctcccaaacatttctgtttaggtaattaacaattatctaacaagtaattaacaaatactttcacaagtcagtggttaggttagacttacaaaaactgtcagtgaatcatgctaccccccaccccactaccttgatgtagttgccctgtgttcccagttgctttgagaaagcagattcaagagcagaaagcattcctaaggacagatgaactttccacgagagtccattcgtagtggtccacttccgtggtactctgggccctccctccccacctccctctccagagcccacatttcccagtttacaaaaggaaggaatacatctcacttcttcaagtctttactgtggtgtatgcatcatgatacaaaaaatcttagggatacaaaccaatgagacaacatttagtggaaaaaaaaaaaaagaaaagactgcctatgtttattatatctggaccctgataggatatttatcttctgtcagggagttgagacagtatctattcagctgtacaatacaccctctcaccatacacaatggtcagcgataccttgctcctgagcaaaagtccaaagaaactgccagtgagaaacatgggaggcagctgcctctgatatcgtggagacaccaaggtcatggccagactgttcatcagatccatctgtgtctatgagtggaagctcagaagcaaaagagtcatcatggcatgtttattaacatgtgcattgtagttgaaatatgaaatcagagtctttttttatgatttaactgattggttagaaagtgaagacagaggtgttgtcagagtgtggcaaaaattttccaaaacttgaatgagctaaatctgcaactgtagggtttgaaagagcacttaaggcatgtgacacagtgactgtgatatgttggagagaacctttttcacaaagaatacaatgtgagcaagcttagccctgtgtgataagagaaaactattttatcaaatggcaatgaagtagcaagaggctattacaaatgaaacaattttactttcctcaaactttgctgagtgtactgagtgaaaaaagataaatctaaatgagaccatagcagggataattaaaggtcatttgaaacttcttggtatacctctagatatacttctcagaagttaagaaagtaaatgattcttgtgactaattaacaactattttcactagtcagtggtttctgtttctttgctttttagaaaatttagaaaacgacctaatcacaatgtcagcagatagaagatttcaaataactttgcaatacagcaccatattatttttggcatacggttcagaagaaatctaaagtattgatggctcttgctgtaatgaagctttacattctttttaatgtgtgaactattaatagatttctcaggactgagatctatagaaatgagtaataggaatagaaattaaaacaaaattaagtaagatttccatttaccatttctgtgaagtataacaagtgatcaataaaataaacaaaactacattaaattatggtaaaactatatgtgtcaagtggaatggaaaacgagttcaaggtagaaggaatgatacaaaatttttgactcttcaagaaatccttgtttctattcacactagcaaagacacggaatcaacccaaatgcccatcaatgatagaatgctaaagaaaatgtggtacatatacaccatagaatactgtgcagccatagaaaggaatgagatcatgtcctttgcagggacatggatggaactggaagccattaccctcagcaaactaacgcagaaacagaagaccaaacaccgcatggggagctgaacagtgtgaacacatagacacagggaggggaacaccacacactggggcctgtgggggttggggagggagagcatcaggaaaaatagctaaggcacgctggacttaatgcctaggtaatgggttgacaggtgcagcaaaccaccatagcacatgtttacctatgtaacaaacctgcacatcctgcgcatgtaccccagaacttaaaataaaattaaaaaaaaaagaaagttgcctaagtatacagctaagagtaggagagccaggatgttagccagttggtctgactccagagtaaggtcttcagggcactgcaaagacatcaaggagttcacagtccagtgggagagacaggcaagccagccaggatgatgatatatgatatgatatgatatgatatgatatgatatgatatgatatatgatggtatgatatgatatggtgatatgatgatgtgatataatatggtgatatgatctgatgatatgatatatgatatggtatgatatatgatatggtatgatatatgatgatacggtatatgataggatatgatgatacgatataatatggcctgtgatgaggctgtgggaacagagaaaggacactgaatggaatcttgtggaggtggggagatcatagaagcatttccagaattgaggttctagccatgtgtccccagtaccctgtgatggttaatgttatatgaactttactgagccatgggatgcccaggtatttggtcaacattattctgggtgtttctgtgaggatgcttttggatgagcttaacatctaaatagggagactgaggacagcagattgccctccctaatgtgggtgggcctcatcccatcagctgagggcctgaagagagcagaagactgaccctcctgtgagtaaaagtcctcctgcctagctgccttcaaactggtacatcagccttttttccctgccttcagactggaactgaaacatcagcttttcctgggtctccagcttacagaccccctctgcagatcttgggacctgcccacctttctaattgcgtgaatcaattccttataatgaatctcttcatgtgctcacacatacagacacacacacacacacacacacacacactcattaagtgcttgttaatgtctttttaaaagtgggttgtgatgaatatctgtggtatttagaatccattagccacattaaaaagtgatgtaaatttattttatagttttaatatttataatatgccagaaattatatcttttacaactatttatccttatcattaaaaattttagatgttacctaaatgcaaatatgtagagattgcattgagtctgtagactcaaaatcccagtgacattttttgcaaaaacaggaaaacctattctaagcttcatatggaagcccagtggatccccaaatagccagaacaatctgtttggaggactcaacatttcctgatttcagaacttactacagagctacagtagtcaaaacagtgtgtgttaccataaagacagatacgtagacccaatggaatagaatagagagcccagaagtaaaccctggaatatgtaattaaatgattttcaacaagagtgccgagagcattcaattaaaaaaaaaaaaaaaaaaaagtcctttcaacgaatgaggctaggaaaactggatatccagatgcaaaataatgaagttggacccttacttaacaccatatgaaaaagataattcaggacagatgcagtggctcacacctgtaattccagcactttgggaggccagggcaggtggatcacttgagccaaggaatttgcgaccagtctgggcaacgtggtgaaatcccatctctaccaaataaaaatacaaaaattagccagttgtagtggcgcattcctgtagtcccagctactcatggggatgaggcgggtgctgaggtgggaggatcacctgagtcctggggaggctgaggctgcagtaggccgtgattataccactgcattccagcctgggcggcagagtgagaccttgtttcaaaaaaaaaaaaattaactccaaatgaatcaaagacctaaacataagacctaaaacaataaaactcttagaagaagacataaggggacagtttcatgacattgaatttggcagtgtttacttgaacaccaaaaatataggcaacaacaccaaaaaatagacaaattggacttcatcaaaattcaacatttttgcccttcaaaagattctatcaacagagtgaaaaggcagcctatggaatgggagaaaatatttgcaaatcatatatccgataagagattaatatccaaaatatctgaagaactcctaaacacaacagcaaaaaaccaattcaaaaatgggcgaaagacttgagtagacatttctccaaagaagatatgcaaatatccaataagcaatgaaaaggtgctcagcatcactgatgattaaggaaatgtaattcaaagctacactgagataccacttcatacccattaggatgtctattatcaatagaaaacaaaaaagagttacagagtatgtagataagttgaaactcttgtgtattgctgctgggaaagtaaaatggtttagccacttgaaagatagtattgctgtacctccacgatattaaacatagaattactatatgatccagcaattctacttctgggtatatatcccagagaattgaaagcaaggactgaacccatgtttttataccactgtttatagcagcattattcacagtagccaaaaagtggaaacaacccaaatatccatgtatgggtgaatgaataaacaaagtatgctatatacatacaatggcatattatttagccttaaaaagaatgaagtcctaatacatgctacaacatggatgaataaaactttatgttaagaaatataagctacacagacaaggacaaatattgcatgatttcatagaggcaaaacagggactgtggggagaggagagttgcttaatactcattaatatagagtttaatggtttaattaataccattaatacagaatttcagtttggagtgatgaaaaagtcctggagatggatgatggtgatgggtacacatcaaggtaaatgtttttaataccactgaactgcacacttgaaaacagttaaaatggtgaattttatgttctgtatattttaccataccaaaaaggacataaaacatattgagatagtttttgagatttgtagatacatggatctttagatttctcttagggaatgtgtgcacagctgctcatgtatttggagaattcatgtctagtgtccttcacggtctgaatccagccctcttctctcacttcattttccttgttccagccacctggcagctcacacctgctaggcttttgtacaagttgttctctctactttcagtgccccttctccccgcacccagttgctgaatggaatctgatacttcaagacccagcccaagtggccaccacatttggaaaagttgtgctcactcctccagacgtaacctgtttcttcctctcctgtgttcccaaagaacttttctgcacttcagatacgtcccatgcctgtccccaaacagagtgaattgttggacagagatggtgtctcacctttgcaactcctacccatagcacagagcaaaacttgaagcagggccttagtaaacagttcagtaactgaatttttaaaatatatatatgtgattctttccttataaccctccgctgggagagtagacagacctttcgctctactttccaaaaccagaaaatgagacacaaagcaagttcacaccttgcccaggccacaggctcactgtggctgatgggaatagagggatagcatcagaattctcttctgatgatcctagtctgtgcagccaggcactaaatcttactgtcaataagttaagggtgtgactttattggttataaaacacatgttctcaaatatttgccatagatcctgtccataaatgaagtgatcttatacatatttctgctaccccttccataatagaccccctgccactgttccaacaccaggaggttggaaacagctgtgtcattaatgaacgacagcagatcctaaccagtgacctccagatgaaaggctcattatttccttactggtctcaagagctattcagtcccctagcaagccagctcagaatttggactgaagagtctaagccttgaactataaaaaaaatttacgaagtccttgacacaatttggagcgattatgttctattgtgccaagaatttcttattaaaaatcaatttaattgtgcataccccatctggtcggtattatggtcttttatgggggggggggggaaacacgattttgtgtttacctgatgttccatagagtaagcatgtagttttgcagaaacagagacattttataacgctgagaaatgagtaattaaagaaaatttttaaatgtttaccagacttctttttactaacttttgtgactttgagctataagattcaactttcttgcgttagttgggattttaacggaaaagaaaatgccagactaaagtaaaaaatgtatgtgtgtacctcatctgctacatttatttccatgtaataatttctattttatactctcgagattaaaattccagtccttttattcttttttctttttctttttttttgttttgttttttgtttttgagatatgatgtcatggagtctgtgcacgatcatggctcactgcagcctcaacctctctggctcaagcaaccttcccacctcaggctcctaggtaactgggactacaggcatgtgccaccatgtccagctaatttttgaaaaaatttttgtagagacagggtctcactctgttgcccaggctgatctcaaactcctgggctcaagcagtcctgctgcctcaacctcccaaagtgctgggattataggtaggagccactgtacccagcctcaagtccttttaaacataacctagatttcccattagtatttaatttgtgttattttttattcaaggaatttggataatgaaagatgagaagattacttctgattgtctgctaggccagtctcaaccatattagcaaaagattgcaatattttcactcaaaatattgccagatatattttaaactggagtggttgcattttgttgtacaaaatggggaagatttttaaagcttgcttttcaaacagcttataccctaatcttaaaaggatcccttggcactcaaggaaaaagatctggataattcataaattttttggtgtgcttatgtgcttatagttgttaagtattttgttcaagtgaccatcttaaagtatcagtaatataataagttagtagccataaatactgatttgattctgaattgccttaacttaaatgttttaaaaattacttttaaataagtaggattgactgctagtcgctgcagtctactaaacacctatttgatatgagccataatatctttcatcttctctgtgccccgatttcctcatttgtgaaatggaataacaccttttgttaggattgttaagatatttaaattagataattcatctagagtattgcaaggttcttggaactgagtaagccataaatacactttagcctgtatcatcatcaaaaataacagaaatgactgttctgcagtgtgtggttttcttatttaacatgctcttttagtgagcttttctctttaacatcaagtattaatattctgcatatatccatttattgagcacctactgtgtgcccacctgtgtgctagatcctaggtgtacgatattgagtggaatcaatataatctctgagcacatggggtagccagataacaatacaataaaaattacagaatgtggcaagctcgaagagaaaaatgagtgcggtgtggtgataaagacaagcaagttctcttcttctacataattctttgaagttgaagtgatgcttatttgttacactgataataaaaatgtataaggaaaaaataacttgccctcttctggctccatgtctgctcaggaatcaatagaaacagtttggccaaccattcatacttttctttgcactcatacaaatgtatgtaaacatacagcatttttgttgtggtttttacaaaaaaaaaatggattctgtgcattgctctgtaactttgttggtttgccttgaaaagtccttagaagtgttattagtatgtgatgtttgctgctggcattttacctacccaagactcagtcagcaatagaaaactctccaaagattttatagatgaggccctgtcattatcacggtatcctctctggtctccatttaattctggccactccatcccataatttattgaacagaaaaagattctctagggtgtcttactactactactgttattattattcctgacaacctttgctctataatagcatttctgatctttttcccttgatttcctgcctacttacctatttatttattttgccttttcctttgtcaatctcatgctgtttcttgggcattgtttcatttccatatttataaatttaacattttaaaagataggtgtttctagttcatagatttgctgcaatcaccccctactaaagaacttcagggttttttgtttttttttttgtctgtgctttctattttgttttctgctaccaacaatactgcaaaacaagatgggtttttatataccgctgctttcatttatgagaagtggatttccagaaatagaatttctagacaaagtatatgtttatattttatcttactacatatggccagatcaaatttcaaaaaaaacctgaagcattttgacatttaaacagatatctttggtgccagtttatcagcccagacctgatatgcaaattagtagatcgtgatgttattgccacttcagtaagaaaccatatgttaatttacctcattattctccatagggtactttttcacttcagtcctctaccagggatcctgaaagagcagagtaaatagaagaacaggtcatcccttttccacattaagtagtcgtttgttaagtgtcggctgttagctgagagcctgagagtggcggcaggtacaacccgccgaggttggacgatggcagcgggacgtccagacaggagcctgtgcaattagccaagacggttactgtgtttttggcagtcaggcagcagttaaagcaaagaagggtcttttttttccaagaaggaaaagccatttaataagtttgggtcagtttgctcataacaacactacatttgaggaccaaaaaccccaggagcttggcaagccagcagtgcttggcaagtcttcctaccagctcaccaagtctgaggccatcctgcagggatctggctctctgggctttgactgtattcatttaacagcattcctagttaacaagaaactaaaggcagaggaatccttttcccattagtccaagagtaaaatttagtggctataagcaagccaccatccaagtaactgcacgtcaaatgggggacggacagtctgtttgtattgaaggctctgcgtttagtgtacacagctgggaacttgtggcccaccaaaaatgacatttatatttaggaattgggtggtgctgtctttttggtgtatgaattaacatttgtatatgacttactagtgtgaaagtctgattttataatgtgtcagagagccatcgtttacctgtctcatgaataaataaaataaaagctaagtacgtttctataaatatttaaaaatacactgccttctcatacttttcccatttcacctatggaaaccttgccaaaatgaaatcaaatttgagcgtttcaatgtaagggaaaaccagctcatggattttaaaattaagaagtggatttttttgtttgttttgtttatgttggctttgggtttgtttttttttttctctaccaagtaaatagtttcgatgaaataaacaggtccaatcatctaatgatggattatttgaatgcagattgaaattgaattgaaaatgttgagaatgagcttgtttatgcttctcaaaaagctgcagcacctgcaactgataaaaattagtgcaaacatatcaaaagtctttgaagaaacatgtggccaatccagtgccaacttggacagaatcagaacactggctgcttagaggaaatatcccaacattcagctaatcaacaatgttaaatgaaatgaagaatgaaactttttacatgactcagtattgcttggaacaatgttaatgtcaacaaggtcagttcatggaaggagatgctagatttcttaagatttttaccccctcgtatgttttcaacagcttgcgtgtcttgattataccgaattcactcagtctttgaaataatttctcattaataatttacaaagttatgtgtttgttttcaggatccaaatttgtgaaggtagcagattcatatccagttataggaatctgttattcctttttatttgaaaaagagtaaagctttctaaacccaagctcccatacatataagcagaatcatggcttcatgcaaccagccacatgttattattttgtttgtaacaaacatctgttagaaacaagatttctaagttttgtatcgggttgaccaaataaacttatttctttagtctagggtttctcaacagtggcattattgacattttggactatatgattttttgctgtagagagctcttctgggccttgtaggatgtttagcagcagcatctttggcccactcaatgccagtaggctcctcccccaaggtgtgacagtaaaaaacatttccagatcctgtcaaatgtctcctcagaggcaaaatcacccctagctgagaattactgctagaaacagctatataaataaaacatgaatgtgttaaacaagtctccctctttcccccagagaacacttctaccacctaaagatgatgaatattaatgatcccttatgtttcccagaaagttgccatgcatatatgagtatgtacatctgttctgcacagtcatggccattcaatactacccttattttttcatttttaatgtatctgtgagattcttatcttgcagtgcatggggacttatatttaaaattaaatctttttaaacttacttagagttcattacaggatgagccgtaatttctttaaccagctttcaatatacatgcaggctctagttctttgttttccatatataagggtgtggcattgttttccaaataatgccataccattatatttttgtgttgaatattatgtgattagagctataaggtataatttagagtatgtccctacaggtggaatcacttgttcaaacgaaaactaaattaaacatatttatagacaatgctatctcaccagctgggtattacagtgttgtttccccagtttaccaaacttttatatttttacccatctgataagaaaaacagttatatccatttgtgtacatgtttaataaaaatgagatttcctgtgtttctaagccttttcttccccctgtgatcacactccatatactctttgcccatttttctagcagcttgtagggttctttctgtctgatttgtaagaactttttatatattgaagaaattgggcctttgttttcatagatattccaaatatgtgtgtactattcatttaatatcagttttctttcaactttgttaatatttgtatttatagaaattagtttcaaatttgtccctcatttctaagtttaatgtcttacaggagtcatgtttcacatagagcaaaataatggttttcatgttttcttccaatgctttcagagttttgttttttgtgcttaaatattcaaggcatctgaaattcatttgagtatatagagactgaaatactacatattcttttccaaatactatggtaatttatcatgtgataagggacatttcaaacaagtgggataaagatgacttattaaacaaatgctgttgacataattgctgatatttaggtgcaaaataataaagctgggtccgtacttggtgcctgcaaggaaccaacagaaggccactgtagctgactggaggagatgcagtgttgtcagaaagataggtgggggcctgattgtgttgggctttgtaaatccaagctaagaatttgatcttttttgaatagagtgtctttttcatgttcatttggcatgtttctcttatatgtagcatatattttggattttatttttttatccatctgaacttttatcgtatgttgggctttgtaaatccaagctaagaaactgatcttctttgaatagtgtctttttcatgttcatttgacatgtttatcttatatgtagcatatattttggattttatctttttacccacctgagcttttattttttattattaatataagacacgtgtttaatattacttctgtcatcacattttatgttacttttcagcttttgatgtttccttggtttctatcttttactaaaattcctatcacactttatttccctaaggacttgtaaacatcttttactctcttttggtattgtgtactgctagagagaagtaggaagacttcttgatttttttctctttgttactttttctgtctgaatatactgaagaattgatcctataaaatcttaaaactcattaatttctatagcaggacatgtgtgggtattgatctttctgtgtctgttgcttgttttgtttcctaggatgaaggatcccctctctactggctgattagggtatttcagaaaattttcttctgttatatctttgaacatttttttaacttctattttcctctttttttaaaatacatctttttgggaattttttgcttatctttaaagtcttctgacctttgctgagaattgtgttctcaagctttactacctatctctacgtgtggtttcagcagtgtcagttcttttttttgaggcagagtcttgctctgtcacccaggctggggtgcagtggtgcaatcttggctctatgaaacctccacctcccaggttcaagtgattctcctgcctcagccttttgaggagctgggattacaggtgtgcaccaccacgcctggctaatgtttgtatttttagtagacatgggttttcaccatgttggaccaggctggtctcaaactcctgaccttaggtgatccaccctccttggcctcccaaagtgctgggattacagacatgagtcactgaaccctgctagcagtgtcaattctggctttcatttctctttagggtagcttcagtttgtaacaatgacctcttcctatttgtctctttctttgctatattagacatcttattgtaactttcgttgcaaagaaaattcactttttcattagctctcttagtctcaccaagaatgtttgagattttcttcggccgtgtggcttgttctcctggaaagattatttcatgtgcgtttgtcatatcctcttatttttttctataatatttttggaagatgtctaggggaaaggggattccaagttgtcttggagcacttcctgctctggtctcctatcactttgcaatcataagcacctcccttgctgttgtttctttcccttaggagaggaggcctgtatgccctagaggaaatttctgtgtgttataggtttctcttggatgattctgcattttttttcttttcagttcaccttgaaacttacttgatcagtgtctgccaagttgattgtcatttatattttctatactgccctgctgtcttccctgattgattcctgaaaaaaaggagggaaaaagcatattgcccttcagctttaatttgcctgctgtgttgaatccatccaggattcaacctctgcctctgcttgccctgacctctatattttatctattttatcctctaaattagagttggtttggctatttcttgcgttgtttcacctatttctttgaaaactttttttacttggtttaatctgtagattcggtctgctgtgggcattctctcttgatttggtctaatctgatcatatttgtttgcatctattgtatatcatttgtagttttaattaaagctactcatagtttcattgtgtatgtgtttgctttttttttttttttttttttttttttttgagacagggtctcactccatagcccaggttggagtgcaatggcatggtcagagctcactgctgctgcccaccttttaggctcaaggaatcctcctgccttagcctcccgagtagctgggactacagaggtgtgcatcaccacacccagctaactttttattttttgtagagatggggtctcactatgttgcccaggctggtcatgaactcctgggctcaagcagttctctccccctggcctcccaaagtgctgggattacaggcataagtcactatgcccaggctcttttctatttttatttgttttttctatttttagttgataacaagacaacatgttaactggattttgcaataaaataaaatacccactagatatctttttggtcaattgtttgaataggagaactcagaattatggcacagtcttgggaaaattaacttaaaacccttgaaacagtttactaatgtgtttgaatctgatgtggatccaggctctcattgcactaaaagtgtggttgaagtattgactgccaagacctccagtggtagggagagagtggggttgaaattgtggttttagggatggctattatttgaataaatgttgtaggaattttccaagcacagaacacagcatgaatctctggttcttagttcttcaccaatatttcttcaccgagaatagccagacctcttggaagggtagttgaaattgagtgactaggagagagagcatcagatcctacaaagaatggtgatgacagaggatggagggaattggggtgatggtcaaagggtacaaagtctcggacaggaggaataagttgtttggggttttttgagatccattgtgcagtgtggtgaatataattaatagtgcattgtacatttcaaagttgctaagagtaaatttcaaatattctcacaccctcaaaataagtatttgaggtgatagatatgttagttagaatgacttaattattctacactgaacttggaaactttaatatcactttgtaccccataaatacatacagttataaagggtcaatttacaataaaataaaaagttttaaaggaaaaagaaattaagagtgaatagaagtgtggaaggatttttgaaagtcagcaagtttatcttggatttaggagggagccctagtagttttttgaacagggtaatgacaaggtgaaagctgtatttaaggaaaacttcatctagcacttgatttggcatttaatttgatctcacggggacttggtgagtacctgtttgtaccaagtatcatactggatacagtagtgcacagagcagcatggggaagaattcctgcttcaagaaacgcagtctggtggagtcaagaaactgattttgaaaaatctgcctcagtaaaatttcagtaccagagttgacctcaactctggttgtcatggtgtctgttctatgttgccagttaggttctaccacagcagcggtctctgtctgtgatgatgtgacacagataacgttgattctatgatttgtatgggacactctaaagtctgccctcaatcagactctcatatctcatataaatgtagctgaatattcagcagcaactttttgaattccatattttcatgtttgcttccttctaagtcaggtttctgtcctcccggtggctcggccctcttctaccccagtcctgctgcctccgtgtattcagattacatctggatgatcacatctcatataaatgtagctgaatattcagcagcaactttttgaattccatattttcatgtttgcttccttctaagtcaggtttctgtcctcccggtggctcggccctcttctaccccagtcctgctgcctccgtgtattcagattacatctggatgatctttccttttctgacagtgttttttgttttttttgtttgtttgtttgttttggtttttattttcttgagatgaaatcttgctcttgtcgcccaggctggagtgcagtggcactatcttggctcactgcaacctccacctcccaggttcaagcgattctcctgcctcagacccccccgagtagctgggattacaggtgcgtgccaccacaccccgctaatttttgtattttcagtagagatggggtttcaccacgttggccaggctggtctcaaactcctgtcctcaggtgatccgccaacctcggcttcccagagtgctgggattacaggcatgagccaccacgcccggtctctgacagtgttttatcccttgtcatgtacactaattatatcctggcacttggctctgtagttgtttttatatcagtcttgcctaatcggttagaatcatagactacttgaaggcatgaataacagcccacattttatctatttatttatacatctctcattacttcaaaaaatgatttgaacatgtttcttttatatgattgtgttttgaccttggtcaaggtggtagacatctgattaaggagggtcaataatttatgaactcagaacacacagaacagaggactttttgttgttgtttttaatttatgatttatatctctttgaaagtccggcaaagacacatcgtatttctcaaatcaactttagagaaaaacaagaatgtgaagctgagactcctccagtcaatgagaaagttttgataccaaacctattaaatgcaaattaaatctatttttctatgaacatgtgcatattatctctgaaagtagatgtatgccttaaatataaattttccttacaatatggatttctgtgatatcgggaatctatgttttataaaggaacaactgctgcagtccctgtggctcatgattccttagcagctgtgtccagctggtggtccacattcccgctacttcttcagtgaatggaaacatttaggtcaatattgatataaaacttcatgagctttcttctctttcagctttggttcgcctttgttaatggattttctgggcagattttatttgaacgttggtgcatcggcctgtacaatgtggtaagcattcttcatctctatctgatagcatgcagaacttagaacttcagtgacattccttcactgtttatgtctgggaagtgtatctgagtcaatcatctgtatacttagcaggcagcacaaatacatctttgggccctttgttgctgtgaaacatcctgcagaagcccaaactctccacacatggtttcaatcatagcagatcattcctgaataaccccttgaaattattaacccatatatcttgataatagacccttgttacccccttactacatgcctgtgcaacactttcgtgtttttagctcaagtacaaatttctgaactacacctaaactcattccgcttcattatttttgttctgaattcttaaacatagatacaaatatacagtgtgtgatctggtgtccgttctgtccttcctgaaagggtatctgtccttgtggaagaacattttcttctgcagttagagctaaaataatgaattctgacttccagctactgtggaggatggtaatcagctcatctggtattttttatgattttcaagttccttttttattactttttataactatgatgaattcagaagctagaaataaatataaactgtagctaaaatggctcagtagctgcttagctttcttgctttttgtttcactggcaggaagaactaaggggcatgtagagcactctagagaccctagaatggcccattttttgagttgttctctcacttgccttcaatcctaactctgctccgtgggaatttacattctgaagcagccatcataaataaatgtagatggaagttaccagacatacaataataaaacctatggtgctataaatccactggtggctagatatttaagtcttccatgctttcacccccctttattgaataacctcagtgctgggtgctgatgtaaaatgctgaatgcagtagtttgccctggccctgtgtagcttgcaggttaagagggtcaaatgtgtggattcagacacctccaaggaggactgggtccagatcttgagttgaaattgtgttggtgagtcagtaactgtgttaacttgctgcaaagtcactagcacatttcctcctgatactgatgccctaaaagacaaagattaggagtggtaagaacaggacagaattgatgtccattccctcctgtgctaaaaaagctactctgactacctacccatggatgggggctccagggcctcccctttgtgtactaaggggagatcacagattgctaactctgtacctcctgaaactattttaagtaggttaaagctatgcaaccatttcggggaaatatgcagaatgctccacgattattcagtgcttgaaagggtcaggtatcaatggagctgacacttcacacaaacacatgccacatccctattttagaaacaaaatgctgagacctaggagagattttgttgtagagccaaggacaggtgtggtatatatatatatatatatatatatatatatatatatatatatatatatatatcacctgcttatagtatgagtggattttagcttgatttctatgctcagggcatgagggctggattcttttcttagctccatgcagtcttggccaattcaaattaatccaacagattttattgagtgcctactacagataagatgctgacaggctagagggcagtgttggtcaaaataaggcccacagaccatttgcaggagaataactagggtttatttgaaaaatgcagattcctgagccccaccccagattaacaaagagtatctcagacatattgcagtttttgcaattttttttttttttttgagactgggtcttgttctgtcacccaggctggagtgcagtggtgccatcactactcactgtatccttgacctccctggctcaagcaatcctcccacctcagcctccttagtagctgggaccatgggcaaatgccaccacagccagctaattaaaaaacattttttttgtggaaatggggtctcgccatgttgcccagattggtctcaaactcctgggctcaagcagtcctccctcctaggcctcccaaagtggtaggattatagtcatgagccgcaaacttttctagttattgttatgcatgaccctagggttgagattatattttatgcagtttttctgtcccctaaactatacagagagtacactgtgatagaaaagtgtatttcaaggtgaaagggtctaggttaccactgagtccacagtgcaggcattgaagtgggctgccagtgagtgctggcagttgggatggaatggtcaaggatctgccaggtgaactccaatgtgccactgggctctggacttgctcatactggaggggccaaaccttctgggaacatggagatttgcccccatgaaaattgttttggtgacatttgtataaaataaatagaaatatagagaaaagttacaaaaaaggtacaaagaactactatttacccttcacccagattgaacagtaattagcatttccaccaattgcattctctttctccatacttgtacgcatgcacacatgcctacactcatgcacacactagtgaatgcatttatttctgacccagtggggtattacaaacatcatgtcgctttcctgcttaacactttagtcaatagtagcaagagcttcctcttatacaaccgaagtataatgatcaaatctgaaacatttaacatggatttaatactattatctaattcatcttaatccatattccagttttgctattcttgctccaataatgccctatttagcaacttttccagtccaggatcattctagagactgcctgcaagagaacatttgtgatgtggaaggcatttgctagtgatcctcctcttctgggctgggttctccgctgtcattttcttcatgcagtatttctctcctgctttttcttctaaatgtactctttgtttgattccgcaagtcagctaaagtagcaagtcgttgttcctcaaactaattttcttttttttttttttttgagatggagtctagctctgttgcccgggctggagtgcagtggtgcaatctcagctcactgcaagttccacctcccgggttcacgccattctcctgcctcagcctcccaagtagctgggattacagtcgcccgccaccgcgcccggctaatttttgtatttttagtagagatgaggtttcactgtgttagccaggatggtctcaatctcctgaactcgtgttccacccgccttggcctcccaaagttctgggattacaggcatgagccaccacactcagcctctcaaactaattttcataacaagttaatagcattaaaacagacttgaggccgggcgtgttggctcacacctataatcccggcactttgggaggctgaagcaggtggatcacctgaggtcaagagttcgagaccagcctggccaacatggtgaaacctcatccctactaaaagtacaaacattagctgggcgtgcccgtgtgcacctgtaatcccagctacttgggaggctgagacaggagaattgcttgaacccgggaggcggaggttgcagtaagctgagatcacaccactgcactctagcctgggcaacagagcaagactctgtctcaaaaacaacaataacaacaagaaacaggcttcttcctaagtaatgaatgaatgctgtcccagaagattttcattatatccatagtcaaatttctttatttttttttattttttttgagacggagtttcactcctgttgcccaggctggagtgcaatggcgcaatcttggctcactgcaacctctgcctcccgggttcaagcgattctcctgcctcagcctcccgagtagccaggattacaggtgcgcaccaccacgcctggcaaattttctgtatttttaatagagacggggtttcaccatggccaggctggtcttgaactcctgacctcaggtgatctgcctgcctcggccccccagagtgctggaattacaggcgtgagccactgtgcctggctcattttgttttgtgggtagaatgagactaaaaataccacgaaggaccaatgctgctaggatcaaatggatttcagctaaattttatgtcttttataatgcagagaacactctagtattatttgaccacttgcagaaaatgaatcctgttgtcaagccagcatcgtttgaggaagaaaactgtaggccagtctcacttataaacataaatacaaaaattctacgtaaaatattggcaaatggagtccaataatatattaaaagaaaaagtatgtgacaaagtaagatttattttggggatacaggagtcttgaaattaaatatctttctaaatatcactatatcaagaaaataagaaaaacatgatcccatcagcagatgctacaaaaacgtttgaagcaattcagctgccattcccaaaataagaactctaaataaaatagaaacagaaaaaagccatttaaccagaattcagaccatttacaaaaaccagtagcatgctgcccaaaatggtaaaattctgaaacggtttcatttaaaataagaaattaatcaagatgcctgccatcactatataattcattgttttcatgttttcggcaactgcaaagaagattacaaatattgggaaaacagtgaacaatttctgtacgtatacacatatgctcacagaaatatggtaatgtaaatatgttcatatatgattgtgtatctagaaaacaaaagaaaaaacagtagataaatactcgaattataagagaatttgataaagtgaccagataaatgataaatatatttttaaaatcaatagcctttttctagcctagcaataaacagcttttttttttctctagcagtggacacctagaaatgcaaaggaagtacgaattctttcaaaaaagcaattaaaattatacattgcataggaaaaatgtttacagtacctacatttttaaaagtcttattgaacaaatggaaaagcatactattttcttgtatgggaagacttagtatcataaaagattcaactcttctaaaattaatataaatatatatgattccacatagactcaatcccaacaggtgaatgttttgggaggaaagggggaagttgcataaagttatattaaaatataaatggaatttacacatatctgagaataaatatgtaaagcatgctcaaaaaaagaacataaaagtagacttatttttactaaatatcagactatactatgaagccaccataaccaaatcactgttattgacaaataagttggagattctagaactacattcccattctagagtcagatgtgtaatacatgaaaatttgattagccttaaaggtgatctttcaatgtagtggggaaagtttggcctcattaattatgttatcacaattggctctttatctggaataaaatggactcctatatagaaaaattaattccagatatattaaagacttaaatgtggaaaataaaatagtaaaatcctacaagacactcctggaaacatgtacttttcatggaagagtaacttctgtagccgcaattggacatgcagaagcatttcttggccatttaaatattaaaagcttttatatggcaaaagaacccatttaaaaaaccaatagacaaagagtgcatttgcatgaaatttcataatataaagacagggttgatatctgttctactcaaagaactctttaaaaagaggataagccatggatagaaagtagacaaaagacatgagtagacatttcacagaactgcaaatgcagatagccagcaaatgtatgaaaacctgctcaaactcactgatagttggggaattgcagctttttaaagtaagaagtagacaaaagacatgagtagacatttcacagaactgcaaatccagataaccaacaattgtatgaaaacatgctcaaactcactggtagttggggaaatgcagctttttaaagtaagaagtaacatctttaatttttaagactggagaacattaaaagaccaatgtaacaaccattgctgatagggaaatagcgaaaaatctatgattttcttttgcaatgggagaggaaaatgctttcaaaatcctttgaaaggcagaatctagtaaaattaaaaatgcatgtatccttttaactctcctgctgggccttcttcccatagagataaaagaaaaagtctgtatgttataatatagtatagatatgtattacataatgtttgtggtaacaaagaactggaaagaaaatgaatgtctgtcagtgggtgaatggctaaaaaaaatggcacatccatactatgaattattatgtgaccattaaaagactgcattaccatcaaacccaagggctttggggggctttctgtaatgtattgtttagcaagaaaagcatgatgaagaaaaatgtgtgtaaagtataatgtctacctttttggttggcaggagacagggtctcactctgtggcccaggctggaatgcagtggtgcaatcatagctcactgcagcctcaacctcctgggctggagcagccctttcacctcagcttcccaagtagctgggactacaggcacacactctcttggtgtgttctgtgaaattgagacagggtcttggtgtgttgcacaagctggtctcgaactcctgtcttggcctcccaaagtgctaggattgcaggcaggagctacatgactggccagtgtcaacgttttatgaaacaaattatgatccctaacgtgtgtgtgtgtgtgtgtgtgtagtatggtataggcagagtggaaaatatgtaggcatgctgggcttcattatagcatggtgatgaagggcaggggagaatctgaagatgggtagaaggagaagctcaagtttaaaaaaagaaaaagactgccacgtaaacagcaggcatgacatcacatgtacacatggatgcagagcaatggaggtgagagtatgtactaagaaagtgtgcatggctcctggcttctggtagaagctctgtccagctataaaacaaacaatttttgttgttgtgaggaaagtgagtgcaacaagtcccctgtggatttctccttgaagtctttgtagcacattgaaatcccagggctgctttccattctgctgtggactgaaggaagagtgtgagagttttactgactctactcaccacacatctgattgcctgctcccaatagacttgggaacagcttcctctggccatatactccatctccaaatagctagtgtgagttcagaattctcgtacagacacacgtccaattcccacaggcctgagagcttgctgggtttgtgggtggggatttgagggacgctcagcagcaagtgacccaggctgtgtgaaccattcccagaaccaagcaggagaaggaccctcagggccaacatgtcctgagttaaaatgacatgtttcttccaagcaccttcttcagctcctgcttgatttttctaatatacaaatgtgagtacaggtgaaagtcacaagtcttgcaaggcaccatctgcccaagaactcattgtcactggagattgtttggtctggtctccttcctatccttgccttacaccgcaccctcagccagccaccatcctgtgtatcttagaaagttcctcgtcctttaaatgacaacaatttaaagatcgaattggcttttattagccattctggaattgggtaacatctcatttcatgaaacagaatgagtgctccgatgagctgagcagaggaggccagctttataggcagaaagggactaaggaaacagaagtagaacaaaaagtgattggttgtttcaaagtggctttctttacagagttcaaacaggggacttctgtatcatgctgcctcaggtaaactgggccctttctggtgcctaggtaaactggttgctgtgaatctcctgttttttgtttgtttgtttgtttgtttgtttgtttgtttgtttttggaaaactggcctgtttcaaagtttagtttgatgacacagctcttagcacaagtaactccattttggtttggtcaggtctgctggggccgagtgcaggagctcagtccaaacagtggcctcctataaacgttgttcaacacctccaaacaggcatgctgatgtctcagagctttgtaaggggtgcatctctcatgggactccttcctcgcccacatccctgtcatcttgccaaatcatgttggtctaataccttgcaggtcagatactctttggtgcaagaatcctttggtgactctcccttctccttctgcgtcctcccctaacaggtattaatagttttgcagagctccgcgttttgtatatttacctctatgcctgttgccccactgccctcccccacttctgcagtagatggcgttcctggaggtcctaattcctttccttctttcttctgtttgtaaatctctccattcctggtgcttatcacagtatctagcccataatttgtttattgtaaatgtctgttgaatgaataaatggatgaagtacattatgcttcctgaaatttgagtataacgtcagggtggaaagttgtaaattttacgtcagctagcgtgagcagaaaacaaagcaacacttcagacagctaactgtggcatgattccacatcagtcttcgttttacaaaggaaggtagttgctaatttaacaagaaatcttggctaatcagataatgtacgatgtttttagtgttcagtgtattcatttgatagtgattaacgtaaaaatggtctttcatttatttcctttgtttggagggtgtctggggatctgtgaatcatggagtctcaggtttggacttgactggaagtgaagtcatcatttggtagaagggaacaatgaagccgtgtggatccgaagggctgcttttaatggctcattgttctccctgcagattttcaccgctttgccgcccttcactctgggaatctttgagaggtcttgcactcaggagagcatgctcaggtttccccagctctacaaaatcacccagaatggcgaaggcttcaacacaaaggtaaacagagtgtgatctcagaactgtcacctcagaaaggcgtggctgtttgattctagtcatctgcctaggagatagttgaagcttgagaaagaacatttgagaagtgctgaaaacatgatccactcaccccaccaccacacacacacacacacacacacacacacacacacacacacacacacgccacaaacccagtgaattcaagacgccttctcaggtgacgggtccatgctgtgtgggctgcaacctccagtcccagcatgctgactccttcccgcttctccccgtcagcccctgacatcagtgtgggcagcagttcccacagcccaggttcaggatccgctgtcagagatcccccttgcgtggtcctgcagccccatgtggaggcctgttggcagcttacctagctgttgctgggtttgtcatttgaaataaaatgtgtctttagctagtgcgtaaaattgactagatatgaactcagggatcacatgagttgcaggggatttggttttgtttttctggaccagagaatcagaaaggaaccaaaaaaaaataaaaaaaagaaagatataggtgatcctgacaaacccgcgccaaagctgggtggggtgttaaaggggtcgtgcagtctcagacagcagaggggtctgccacacagatgtcatttgcggctgaatgtggcagagtgcttgggtgaccccatccaaagaaaagggagatgtgtgcctgggcacagaggggcgagatgtgagcatggctgcacggccttgtttctgcctctggtctttgcgcaggggggattcagaagtttagacagaggtctgttgcacagttcacctcctgtgctgtgtgctggtggcggtcatgatttgcgtgcatggttcctgggccgtcagtgagaaggacacagggagtcacctctccaggcctcaaggagagaacagtctcccagggcctttcttctgagccagatgttcctgacgtcccttacagctgcttttttctggggaggctcactagttacatccgaggcagggaagaaacagaagggctccttattggttctaccgtctcccacatccaaagagacccgagggactcattttaccaatccttgttgactgtgattccgttaatgggaaaatatgacccattttcactgcattatttacataaatccattttctacagaatttgaattcaaaggccatttgaggtgggaagtaagtaagagctgagaatgcacggaaacttatctgcaggcactttgaagaattttttttttttttttaagtagagaggtcagagatggtgcaaaatgaacatttaaagcaggggaaaattccattgtcttataacatttttcactattttctgttgtcttaccactacttaggctcaaactatatgataatttccagggacaacttgtagaggtttaaataaatttaatctggctttaatagttaataactcgaggggggcagccaagatggccgaataggaatagctctggtctacagctcccagcgtgagcaacgcagaagacaggtgatttctaatagttaataactctgtcatcacggtggttaaaacaatgattgcgatgtattagtgaaactaaagtttagaataaactaaaccttgtgttcttttttctgacctttaaacattaaaataaagagaattttcaaatatgcatgttatctaaaatcccaaaaataaaagaagaagttgagtgagagggatttgaagtagtaaaacaaaagagtgagaatgccatgtaaaaagttacaagtggaatgttttcagtgcttttaagacatcccatctgccccgacacagtttaattgttaagaagagacacagttttagtctcttcttaacaattttgacctagtaccctttttctggatgtttgtaaaatggtgttgtctctcttacaatgctaaagaaaactgatcagagtgaatttttcacatgtggatagattgtgttggtctgcatacatgtgagtagatatttaggtctttgtaactaaagtaatatgatctggagataatccagtcatttgtatgtaaaaattaaataatcgatttgggtgggttttttttttttcaaattcaagaataatatgctactcctggaaccgtgcagcgcacggccaggatccttcacaatgtggcgtttgttgagagtttcacagaggtcaagcgttttgggcagctcctgactcccttggtttgtttttccttaggttttctggggtcactgcatcaacgccttggtccactccctcatcctcttctggtttcccatgaaagctctggagcatggtaagggctgtgtgatttcacctgtcagcaaggagctttgcagccgctctgctgcctgtgtgttcacaatttttttttccagttctgcagaacaagagatcacaggaacacattttagaggaaaaacatacctaaagcataatgagagctagtcccaggtttatagctgttaggtttcatcagttctggccttgagaacccattttctttccagttgactggatagtttgagtactaggaatactcaactcagttttaaaaactatttgagtcagagatcttcaaggaaagccctgtactgtaatgaaatgttgatgctttttgtccgtggtttgaaattctcttttaattactttgacttttatttctgagcctcccctacccatatgcagaataactcaaatcttataagatttgaatcttattcctagctttctgaaagagtgtcctgtccttgatgtacgccttttgaaattagagtttgagaactaattctccagattggtgtttgtctttacagctagaagaggatgtctgagaactgtggcagactcggcgttttttcacacttcttaacacatccagaacgtggcctcctaaagagacatatttttattctcagaaaatacaaatgtatcatgagaatgctactctttcatccctctcaaatagtaataatccccctgggaaaaattactccaaatgttgactagacaaggccctttattgttcaaagaaccaaagaatataaagtttccaagcgtctttgtttctgtgtcagtgagttttatgcttcaaacagaaatgattcatcctcactgatattctttaacctattaaatactgacagagaaaatgcatgcactgccattttcttatgccacgtgatatagtctttcaatttcatcagaactccttttccttcgagggttcataagtctttaaatcagagaatacaattttatgctttctagccccaccccaaaaaagagcattccagtgaaatcattttcttttaacttgaaacccttcttgtgattcatctttactcagtggatttaatttattttaaaatggttttataaataagagtgtatacgtataagagtttgggatgtgattttgtttcagaggctgtgatattttggtgacagactcagccatcattgtagcaggaaggattagtgatgggaaatggtatgtctgatgagcataagagaaatttgagcaattatcctccatacctgagcccaggctttggtacttaagaagagtctgcaaatagcatgaactagccacaagtactctctgaagaccccttaccacttcttatctagacatcctactgtgttcctaactcagaattgcttgccttttgactctcagaagctttacaagatggtcatttacttacctgcttcaaaaggaactagtgtggctgttctgcagtggagacgatggttttctaatcctggaattatgatcatatacgttcagttggtgccttgtggtttgtggtgaaattgctatagtttaaccagattccattatgtaagtccattcattcacctaccatggtcagtatttaaaaggatgtagactcccagcagttgctaacttacctaagagacagcaccaaatgaattttaaattagtgctatccttatctaattcctccaaatttggcaaattacctggcaggcagccaataggatgcttttttcctctttttattatcaccatcatcatcaatgtcattatttcattgtatttattgagccttcagcataggggttttctttgagttgtgttgcaaacaataatctattgagtgaaactgtgtaaagtgaagtaaattgcaaatattaagtgtatcagaacaacagagggacattggtgttcttggtcattagttgacttcccctaacaaattgaatattttataattaatttctaaattctcactgttagtacagagaaaaaaatcattatattattgttcattaaccttattcctgttatgttcaagacactgtggtagattctaagggtgacagtagatatatcaatgtcggtctcaccttcaaagagtttgtagtatggaaagggagattagattttgtcttagtccattttgtgctgctataagagcaccatagactgggtaatttatagtgaacagaaatgtatttggctcatgattctggaggctgggaagtcccaggtcagggagctggcttcttgttaggacctacttgatgtgtcatcccatggtggaaggatatggggtagagagagaaggaaggaacccatgccagtgacaacagcattaatttattcatgagggtggcgcccccatgacccaaacacctcctatcaggccacagctcccagcaccactgcattggagatcaaactttcaacacatgagctttgcgggctgcattcaaaccagagcagatttgcaaatgaataactccagtacaaggtaaaaaatagctgtttcaagtaaaccatagataaaatgctattagatatcagaggactgagagatgcctttcatttggagttattaatagcttcctaggggaggtaatatttaagtttagccatgaaatccagcagaaggaagaatcaagcaaagtggggaaatcaggacaggtgtggaaaactgagcagctgaaaggtgaaagatggggaaatttaggaaggcagataaaagctgaattacagagggctttgagtatgaggttaagaaactgggatgtggctgggcgtggtgtctcacgcctataatcccaaaactttgggaggcagaggtgggtggatcacctgacatcagttcgagaccagcctggccaacatggtaaaaccccgtctctactaaaaatactaaaattagctgggtgtggtggcaggcacctataatcccagctacatgggaggctgaggcagcagaatcgcttgaacccgggaggtggaggttgcagtgagccaagatcgtgccactgcactccagcctgggccaaaaagcaaaactctgtcaaaaaaaaaaagaaagaaagaaaaagaaaagaaaaggaaagaaggaaggaaggaagggagggaaaggaagaaggaaggaaggaaggaaggttggaaggaaagaaggagggaaagagaagaaagaaggaaagaaactgggacttaactgtttaggcattgaagggtcagtgtagaatttagatctagaattttatgatcagggcaatttgggaaaataaacctgtcatgtcttgtaaggtgagcggtagaaagaaaactactggcagagattccaggggacaacttagggagggttaaacccaggaatgggatagtgtttggagagggtgttttgaaaggagcttctttgtttgctgagattgtggtgtatctacaaggtaagaggctctctgagggcacagtgaatatagatatcagcaagccaggcactgcctctcctgccctctggaggcttccctcttgaaagaggagtagggggtggtcacatgggacaagggagatgtggggcatggttgggagaaggaacattcctggccaggaccttgcaggtgcacaggacctgagctgctgaggccataggaagtgttttagtgggactgggggtgcctggactctgaactctgtcagcctctggtgagaggctcgggacactgggcattcctgccccagactggaaaaaacagtaacctcctactgtaatctgactgctcatgccccccccgcccaattcatatgtcaaaacctcaaactgtaaggtgatggtatacaacatagggcctctgggaggtgattaggtcgtgagggcggatctctcaggaatgggattagtgtacctataaaaaggaccctagagagctcatttgccccttccactatgtgggaatatagctagaagacatcacctatgaggaatgggccctcacctgacaccacaactgccacttccttgatcttggacttcgcaggctccagaactataagaaatgaatttccaggggttataatccatgcagtttatagtattttgttatagtcagccgaaagaactaagacactccctctcctcctttccctatccttctggaagtatcaatcaaaacacatctctacatatttctagcatcccccttgtagtggacaaccacccctagtcaagacgactacagcatagagaggaggtaggggctggaaaagggaacaaatacttgagagaggatctgatcactaacacctggcggagggggggactttttctcagggcagggttggaggtaggagagttttgtgatgagatttgcctgtaaagaagattaagactgctctgtagagaaacacataggatctggcaagagtatgccaggaccatgcggttgcacaggacctgagccactgaggccatgggaattattttagtgggactgggggtggcagggatttttttggtagggatgggagtggcagggataaagactgtaagcaccagaggaccaggatatgtcagctgactggaggacttgtttatgtgtgctgatttgctgtcctgagtacaagtgaattcttattacacttttttttttttgagacagagtcccattctgtctcccaggctggagtgcaggagcacgatctcggctcactgaaatctccacctcccatgttcaagtgattctcctgcctcagcctcctgagtagctggaattacaggctcatgccaccatgcccggctaatttttgtatttttagtagagatggggtttcaccctgttggccaggctggtctcgaactcctgacctcgtgatctgcccacctcggcttcccaaagggctgggattacaggtgtgagccaatgcacctggccttattacactcttaattgtcatttaggagaatgtatatcctccccacccccaaagaggcataggaacatggcaccaatttgagacaaactagggcactgtcaaagctgggggcccttggtctaacagaggggtgccttcaggactctcccctcctgcaagagctgcctgaagccatccctcagatggccacccacacccagagccccagaggagttttgtttgaccgggggctgaagtccctagagtagtttcatttcccacttgataccttatggatgatgtcacaaagacaggaggttttactagaaaattctgcctccaccatctatggagagaacctcaggtatatatcaacagtgttcactttgggcaaggcaacagaagcacacttcttcttgggaagaaatattttgagaaggtatatcgttcattccctagaatgcttccaagaattttgctttgcttattttcatgtggttttggagagacttttcaaagcactcctttgctgatggagtttgtgatgattcatttcaaatttcaaaataaatttttccactcaagcaattcagtaaatcagatttcttccaaccatcacagccatacacttactgccatggtctgcctgcagctcctcgcctttgatctggaaagcgatgctaggttagacctaggatgtcaccttcacagggacccaagtccatcaggagccctggtgtcagcccacacccgggtttcctgttggcatgtccagtcggcagagttgagcaaccctccttgaagtgtaatgtggttattggcaaaataatacaaaatcggtcttgattttaaaaaaggaagtattcagatttttcttgatgaaatttaagagggaggtgatgggaaagagactatgcttaacaaaagaaaagagctcctaaaaacatttgttcttgattccccagagtccacaccgtagaaactgctccctcaccgtttaaggagaataccatacggattcttatgtatgggtactaattacgcaactgggcctttcgacatttttggagaagtctattttataatttttaataaatttgctcctgtaagatcagccatgttttgtatactgaaatagtagtgcacgtgtataaaataaaactcagtgtgactctcttttcccctggcattcttgggtcatattagtttaaactatttctgacccttactttattactgaaaacttgagtgtttcataccatataaatcctgagacttgcgttgtttcacattaagctaaatttgggcaagattgccagtgttctctgagactgcaacttcttaaactcaattattcactcatttttgtaaaaagataaaagagtggctgggcacggtggctcatgcctgtaatcccagcactttgggaggccgaggcaggcagatcacctgaggtcaggagttcaagaccagcctgaccaacatggtgaaaccccatctctactaaaaatacaaaaattggctgggcttggtggcgcatgcctgtaaccccagctacttgggaggctgaggcaggagaattgcttgaactgggaggcagaggttgcagtgagccgagatcgtgccattgcactccagcctgggtgacaagagcgaaactcagtcccaaaacaaaacaaaaaaaaagattaaagaatatgttctctatgccaggctcctcctgtgttctggggacacagtagtgcgttaatagaggagttcccaccctcatggaactgacacctagagaaggcaggatttgaacaggaaatgttagcaaagtagaaggtcaagttcagatgggatgtcttccagggaaaactaacctgggctgagctttaaggactgcttcctggaggatgtggcagcagagttgaaggatgagtcggaatgaggtaggagaagaggagagagaggaaagagtttcaggttgcaggaatagaatagttccaagagaaagatgacatgaagcagttggggggagatattgcggggcagattgtgagacacagattgccttgggatggtgagagtggagatagagaagtcagacctttccaggccttttggaataaatgagccttttggaggataagtgtaataaggccattggcaggttttaagcagggagctgtgcagtctgatttattgtaatataaccacacaggccaggataatgattggagtcctgttcctgggctgttgctgatctaatgtagcaatcatggcacttgagaaaagtggatgggttggaggcaaagctagaaggactcagtattgcattaattaataatccccttctccacctggttgcacaatgtcctaaacccgccaggagaatgtgctaatgcagtcataaagagcaacaaaataccatattttacagtaaggtatgtgaaacaatacactgacattttgttcccccataaaagtcaccaacagtgctatgtgcagcatggaaaagatctaaaataaatttaaaagattcagagacaagcattaaatgctaaatgggagaggaaaagagggtagtaactccatgtggcctctgccatctgggaagacctgcagggaggacagagtgtggtggaagttcataaaatcctgaagttagtggaacttgctccctaagacctagaaacacagaacattctgggagtctttcagatttgtacaaatgaaactaaaactcataaatctgcataactggttactaacccgatcatagtacattgaaaatataaacaggtttccaaattcaaatgcaagatttttgtttctgttttgttttaaaccgcagttatgaactgcggtaaagctctgactttagctgttttcctgtattgtgacagtgcacctcacacatcctgaaacccagaattgggctggaagggccattgttttcattcagttaaatatttcttatgtttcaatgtctcttttaataaactctgtgttgcgcgtattttagacagttgggtttggtgtaatgttgtaagaagtgtgagccagagttcctagatttcacccttagcaggaagttgaatcaagatggattagccagggaatctcaggggcttaacccagtaaagagttatttctcacccatgtccctatccagtggagaagtgcattgttcgcgggtgtgttgagtatgtttttcttattttccatattcctgatgcactggcattaggggccttgattccggagacactgtcctcccagggctagctaattcctgaagttagcaaatgcctcccctgcctgcatgcctttgacatacaaatcaaccaagcccgagcccacacccccagccacctcctttatcaaactctcacccactgagcaggtgttccctttgcccaacagcaccccagggccaggtacccaacaactagggaccatccttacagccctgagcctgccagaattactcccattatacaatcctaagtgtcctcagtcagcatacctaccctgcctcacctgttcctccctgtaagaaccccagtagaggcctgggccatgctcagcgtctctccaacctcctgagctccgtggcgctacctggcatggccttgccaggcatgctgtgcctcctgcttctagcatctgtgagtacgaacttctgcctccatgacaatcattccatgtctgcctgtcttaccatatctgttaaaactatgcctgcttcatttcaacacagtgaggctccatggagtacaccctcagcctcaacactgggaggggagaggcaagatggtttgcagggcaaggatcatttgctcttacccacatctggcaggaagagatccatcagttctgcccatatctgattggcaagaactagtcacagggcctagcacggcatggggtgctgggggatatcacttagttgtgtacccaggagtaagaaacacgtgtggcctcactgggtgactgcctgggcattggcaatcaagtttactttgcgtcatttttacttcctttttcagatttatttttagtaaacaaaagtgaaaaaagagaaagattgaaatttgagtttcatgtccttaactttatccagcagaaatggcaatagaggagaaaatccagcaataggcttatataaccaggagcttcacccggcagcgctggttgtgaatgtaattgtaatcactaacacttgtataaaccctgctttttataaagcaacctccgatactttatactactttttacggggaggaaaaaaataaattttctcttcatgaattcatagtgtcggaggcagaaagcataattttaattctagttcaggcactataggcatagcaggttaacttctgaaagtttgtaatttagcgtcctggaagttggaatatatcttcactcttgatgtaaatctagaagttgctagttgggatggggtgcgcttcctctgagccactggagtcttgagaggcccagagagtaaggtgggggcgggggctggctcagttaatgttctggaatcccggctgctttgaaacagtgctgctggaagctcctgaagggaaaggaggagagaggaaaagcaggagaaacttggtatctgctcttggacaaaaatgtcttggcagatgtcttggtgttgagggaatggtgccacctctacctcagttctccctcctgagccctgcatgagtgtgatgcctgcattgttcagttcaggtgttccactgattctgactaaatcaaaagtatacatgtaaatccagcccatctgttttcatgattgttaaacgccgtctcttctgaccactatgttataacattgtcttgaaattttgcctttgtcagagccatttctgaatacattttgtggtttagctggatgatgatgtaatgtttttaatgagcatttaattgaaatggcatctttataaaatggcatcaacctagctctttggaatattctgaaataagttccttgatcattttgtctctttagaaaatgagacatgcttttcttataaattgtggcttttcccacaaatattttcaaagagatttttgcagacaacattttcgggctgttactactaatgttggagagctcatgtggttttgtcccagatgttcacagtaggctggtttagtgactatgtttccagacctaatttggctaatcctatgttagttatgtctgttcctgaaccccaaccagatttcatgactgataggagtctggaagaacagactcacctgctgccttgggtcaggggatcctggagccacacataacactgaattgtctctaagagagcatctgggactgtgtttctgtctctctcattttatgacacttttcatgcatgccataagcatcatcattatattaggtttgtatcacatgcaatcacagatcattctaaatgtgacttagtattttatcaaaccaagcacatggagaacttgtgttaccttttctgttgttgttgttgtttaccctgtagaaattgtcctctggatttctgagatgggtaatgccctcctgtctcatctcagccctcaccagtgttggacctgatcctgaatttgcaaaaggcaaactgatctcagtctagttccggtaaatgccagccccactgatgcgatggggaggcgaagccttcttagctttctccttgccctttaggcctttgtgtaccagtgacgggtgtctgcgaggaagagcttggctcttggagaacacaggtttggtgagatcacatctctccatatgcactttggataaatttctttatttatagagacttttttggagcctatacatttgacccctgctgacctcaccgctgtagccccacccccacctcatcagctcacctttccacctccgcgcccaatacaggctggttttctttttgcctgaaatgttcttccccctctcaactgacccccaccccaaatatccatctctgccccccatactactttctctgaaattatgctcttaccatggtttgcacagacggtggataaatactgttccaaaggctggcttggggaacccaactattcccggtttggggttttgtccccctttgaaaaaattcacttgagattttaaatatctgactaaagtgaaaacaggaaagactctcagagtggtagaattgtaacagagctgttaagatttcactcagtgggaaggaatattttgtcagcaacttgctttaggaataaactggacaatcgaatggggcttttccagcctgcattaacagcaagctgtagcttggaaacacctgcatgacaaacactttcttaggacttcttttttccaggagtagcttattggcaggttttaacaagaaacgacacccacaggtgtttgcctctaaaactgttgaaacagaaccatctagtccccagggtttccctacagggtgtgcagggtgatgactgtgacttgtttgaaggatgctatcttttcagaggctcttggcaagtcccagaatctcaccttggtttgggactttctcctccaagggaataaactatttccagatggtgttagctttgcctagggaaggaagtactctttcctagactgaaaactaaaatgcaatgctgagttacctctccaaaacaaggaactgaaatattaggcttagcccatcttcattaaagtttaatgctcaaattaccttgtgtgttagcattttattgaatgccagtagcattcactgtcatgacaagttagaaattaatgcattgtcagccggatgccgtggctcacgcctgtaatcccagcactttgggaggccaaggcgggcagatcacctgaggtcaagacttcaagaccagcctggccaacttggtgaaacccccgtctctgctaaaaatacaaaagttagccaggcatggtggtgggcacctgtaatcccagctacccgggaggctgaggcaggagaatcgcttgaacccaggaggcagagtttgcagcaagctgagatcgcgccactgcactccagcctgggtgacagagtgtgactctgtctcaaaaaaaaaaaaaaaattaatgcattgtcaaactttagaagctacatttagaaaacatcctttagatttctctgtttctgctgttctgccaaattgccagcctctggtacatagtcttaagggttcccctccatgcaggtgttctcttcataggttaacattcagtcctgaatgatccaagagtttgtctcatgtaaaggccatccagcttcatgaattgcgttgctctgtgcgaatgcctcatgctatttattttattttcttttaaaaatgttttttcttttttagagactaagtctcactctgtcacccaggctggagtgcagtggcatgatcataacctcaaactcttgggctcaagcaaccgtcctgcctcagtttcctgagtagctgggataacaggcacacaccaccatgcctggcttcttcatattggttctctctcctgattgcgtagaggactgtatccgaccccaatgtctcctcctcagtctgacgggagagatgagaattctctctgttagacattctgtcttcagtgtatgttctctgtatttactccacctcctcctatttcttccctctgaggcagtggttctcaaccaggattgatttttgcctcccaggggacatttggcaatgtctgcagttatatttggttgtcacaactaggatgggtgctactggcatctagcgggtggaagccagagatgctaccaagcagtctgcgatgcacaggtcagcccccagacaaagaattatctggcccaaaatgtccgtagtgccacatttaataaactctgggctaatgaaatgtccacaccaactcagaataaaaggtcagatctccaggcgttcctggcactcccggagttgttcactttctgtgcttccttatgtggtataaaatttctgtcatatgagtctaattttctgtccaccgcagttctctcctggatatttcctttccattaggtgtcagtatttcaaatgagtacttcttagtctaattgtttttttctttgaaattatctcctgtcattcttaggagtccatttttctaactcagttaattagtacaaactctcatttacaaaatttacagtttcttggccgggtgcagtggtgtgtgcctgtaatcccagcactttgggaggccgaggcaggtggatcacctgaggtcaggagttcgcggccagcctgactaacatggtaaaggctgagacaggaggatcacttgtacctgggaggtggaggttgcagtgagccaagatcatgctattgcactacagcctgggcaacaagagagaaactcagtctcagaaaaaaaaaaaattacagtttcttactaaccatgtgaccttgaacatatttgacttctctttgctgcaccaagttcctcatgtgaaatatgcacataattatactatttcatgtagttgctaaagtattaaaggagctaatatgtgtaaagtgcttagaactgtgtaaagtgtttatataagatattttttaaacatagaatttcttggtcaggtgcggtggctgtaattccagcactttggggggctgagacaggtggatcacttgaggtcaggagttcgagaccagcctggccaatatggtgaaaccccgcctcttctaaaaatacctcaaaaattaaccgggtatagtgatgcacacctgtagtcccagctactcgggaggctgaggaaggagaattgcttgaacccagaaggtggaggctgcagtgagctgagattgtgccactgcactccagcctggtgacagagcaagactctatctaaaaaaaatatatatatatatgtatatatatatagaatttcttataatgtctaaaaattttgtttattgtgtgtatatccataaaatatgaaacatgttctatgtcctccctattaaacaaatactttgtatgttttagtccctgactcaaccagattggaaatattggtattagaagaaaattcaaaaagttgtcaaaccatagctacaaattttgactttcagcttagtctcccatgcctgctaacccttttgtctgatcagagttttctctagggccccttagggctaatgtaggtgggacttcaagcacatagatcattgctcttctcaattcagatggattaatgagcagatgggttgagatggagatgaggaaagacatcctaagctatgttgaggagggagaagatctgagactcaagtttctgctgttaaatccatgaggctgatttagcagctaagaatacaggccttagccttttagagttccctatctgataggagccttagagataactcagttgtcatcatttgcatctgatataaaaatctccattttatgggtggagaattgagactcaaaacctaaacttttaaaaaatgaaataatggcagagctggaacagagagcagggctgttattgggttttgtaactcttattacggggactgcctccactaaccctagttcccttctctccacctcatgttttctttgttttggaatatggtcatgtttcattgctgtcttttcttcctctcgtgaacttaaaatatgaatcatttggtaccaagttttcatatgtcttcctgtattcatatgaccagaaccagtcttctccatcccaaacaccgctgtttatctacatactccagccaaaaactttcttgattcctcacattcttttctaccctacatccaaatcataagaaaattttgtttgtttgtttgtttttataagagacagggtcttgctctgtcacccaggctggagtgcagtggtgtgatcatagctcactgcagcttcaacttcctgggcttaaggaatcctcccacatagctggaactacaggcatgcaccagcatacctggctagtttttaaaaaatttgttcatagagatagggttacccaggctggtctcaaactcctgggctcaagcagtcctcctgcctcagcctcctaagtgctgggattgcaggtgtgggccactgtgcctggccaaatgctgtcatttccaccttcaaaatatttccaagtggcttctgtccaagccactctgggcctgcattgttcaatagcactttctgtgaggatggaaatgttctgtatctgtactgcccaatacagtcgccattagccacatgtggctattgtgaatttaaaatgactgaggaactgaagtttttatagcagctttattgggctataactcatataccatctaattcattgaaagtatgcaattctatggtttttaatatattcacagagttgtacagccatcatcacaatacattatagaacatttttatcacccccaaaagaaaccctatattcattaagaatcactcctggccgggcacggtggctcatgcctgtaatcccagcactttgggaggctaaggcaggtggatcacctgaggtcaggagttcgagaccagcctgaccaacatggtgaaaccccgtctctactaaaaatacaaaaatcagctgggtgtggtggcgcatgcctgtaatcccagctacttgggaggctgaagcaagagaatcgcttgaacccaggaggcagagattgcagtgagcagagatcaagccattgcactccagcctgggcgacagagtaagactccatctcaaaaaaaaaaaaaaaaagagtcactccccatttctcccaagcacctccagtacctggaaaccactgatctactgtctgtctctgtagatgtgcccatttctggacattccatagagatggaatatgtggcctttggtgtctggcttcttcacttagcataaggttttcaaggttcatccatgttgtagcatgtatcagtacttcattcctttttattgcctaataatggtgttctatcatattgatataccacattttaccatttcacagtggatggacatttgggttataaataggctattgtgaataatgaataatgctattcattattttaagctattatgaataattataataatggtgctatagtttttaagtacaaggctttgtgggtttcattcatatgttttcatttctcttggatgtgtacctaggagtacaatggctaggtcacatggtaactgtacataacgctctgaggaactgcctcacagttttccagggtttgcaccgttttactttcccaccagcagtgtatgaaagatctaatttctccacatcttgttattgtctgtttttctgtaggcaccccggtgggtgttaagtggtatctcattgtggttttgattttatatttctttgatggctaatgatgttttgctgttcttcatgcacttactggccattttgatatcttctttgcaaaactgtctattcagatcctttgcctatttttaaattttttgggtggcctttttactgttgagttgtaagagctctttgtgcattttggatacaggtttcagatacataatttgcaagtacttttttccatttttcaggttgtctttttactttcctagtgttgtcctttgaagcacaagagtttctaattttgaagaagtccagttcatctacatttttctttcctcactgtgcttttggtgccatatctaagaaaccattgccagatccaaggtgataaagattcatcgctatgttttatcataagagttttatagttttacaactcaaaaacaaaaagtcaaatactgcatggcctcacttataagtggtagctaagtaacgtgtacacatggacatggagtgtggcatgatagacactggagactcagaagggtgagagggtgggaagggaaagggtgatgagaaattctttaatagatacaatgcacattgttcaggtgatggagacactaaaagcctagacttcactcccatatattcatgtaacaaaattgcacttgcaccccttaaatttacatcaattaaaaatgattttatagctttgtttctatgatccatttttaaaaatttttattatgttaaaaacatcatcttttccattttaacattttaagcatacaattcagagacattaattacagaatgttatgcaaccatcaccactatgtttttccaaaaattttcatcaccccaaactgaaactctgtgctcattaagcaataactcctccttctccccttcctccccagccccaggtaggaatgaagtttgtattgtattttattttaattaatttaaatgtaaacaactaaatgcagctggtgattaccatattgggctgcacagttataacacgactagtatcatcctcttagatagactgctacagtcatttctaagctggctttgcatttattattatcctatttatggttatctatggtccattctcccataaaagctggactattcctttaagaatgtaacttattccatttcattcccagctctgaatcttccagtggttacctattacaattaacaaagaaatccaagctctttgttgtggtccacatttgtctgcccctttgactgtctgccttctccttttccttctcccagtgcctgcagccccactggtcttcgtaatgatccttgagctcatcaagtgctgtctgcattcagactctgcacagtttctctcctctgtctggaacactcaccctgtagatccccatttaactctctccctcgtaccattcagatctgctcaaatgtcacctcctcagaaagattgttccagagctccctatctaaaatagccatgctattactctaccttatagctcctgtgttttattcttattttttattaagacagggtcttacactgtcacccaggctggagtgcactgttgcagtcatggctcactgcagcctcaaactccggagctcaagcaatcctcccaccgcaagcctcccaagtagctgggaccacaggcgagcaccaccacacttggctaatatgtttcttttcttttcttttttttccttttttttttttttttttttgaggcagagtctcactctgttgcccaggctggagtgcagtggcatgatcactcactgcaaccttcacctcccaggttcaagtgattctcctgcctcagcctcctgagtagctggcaattcaggcaggtgccatcatgcccagttaatttttgtttttttagtagagacagggtttcaccatgttggccaggctggtcttgaactcctgacctcaggtgatccacccaccttggccttccaaagtgctgggattacaggtgtgagccgccgcacccagcagctaatgtatttcttcatagcacttattacacctgacattttatcgtgtatctgtttaaggttttatgtcctgtctcctcactagaccacaagctgtataaaaacagggaccttctcttcccggttttcataatagtgcctggcataaaataggctgtaagtaaatatttgttgagtacataaaagaagaatcttattcatttcaaggctataatctatgttagaatcaaagagatggtctccatactaaactgaagtatttcttcattgaggcaggcatttaaaagtgttgcacctgttagtaaaacagtcttaaggccagttcctgaaaagtgaactcctacaattttgagtaactatttgctaatacatcagcatgttgccttcttgggattaattcagcctttcttttacttttttaacttgctcccttccttcccttttaatgaagtcatgcctaagctccagtctgtccttgtcccctctcccctaagctttgagaccgttcctttttaagtcagtggccatgtctcgccccgttctcccgatataactcttactttacccagcagcggggcctccgtttagtgcagcccgtgatgttgctttcctggttcatcttcccttatccacagatttacctggctggaatcgggagactgtgtgtgcccaggggctggattcggagacccatgcttctgcagttccacttatgactccatcattatgctgttttaggaaaataaatagatattgattctctaataagagtgggattgttcaacaagcattgggaaaatctgcgagcccagatatgtatgtatagcagctactggttggaaatttgaacacaagcatccttatctacccagcctgcgggccacagaccagaactgagtataaaaaaagaataaaaccaaatgccacatgttgtctcttataagtcagaactcaacattgagtacacatgaacataaagaagagaacaatagatgccggagaacttgacaagagagggagagaggaaaggcttgaaaaactacccattgggatgccaggcacggtggctcacgcctgtaatcccagcactttgggagcctgaggcgggtggatcatgaggtcaggagttcgagaccagcctggttaagatggtaaaaccctgtctctactaaaaatacaaaaattagccaggcatggtggcgggcacctgtaatcccagctacttgggaggctgaggcagagaattgcttgaatccaggaggcggaggttgcagtgacccgagattgtaccactgcattccagcctgggcgacagaccgagactctgtctcaaaaacaaaacaaaacaaaacaaaacaaaaacaaaaaaaaacactacccattgggtactatgcttactacctgggtgtcagagtcatttgtactccagacctcagcatcacacagtatacctttgtaacaaacctgcgcatgtaccccaaaatctaaaacaaaagttggaagaagttgaaagaaataagaataaaggaaggttggcagtgtcatccaaggaaactaagcctgatattaaaataggctctgaccactcaggataaaaaacagacttctctgtgcaggtgtagcggagatgatgaaacaactctattagcattctgccttagtggttgttatagtcatagccatccttgaaaagaaaaaaaaaaaaaggaaaatataggaaaactgaggcttaaaatccttcttctattttctaaacttctgtcattggagtgcttgcgttcccccaggtgatagactccggaagctcatacagttgcagatgagaacatgagtaataaatacccccaaaattctttccaagttcagtcatgatgaattggtttaatatgcatgtagttatctttttattggtccataattccaatttagcaaaatgtaaagatgaatcataaagaatacctggaaaaagccccaacattgatggcacttaataaagatagatgagtatgttcttactcctttttttaaaacaaactggacaaagataaattttaatgtttacaaaaatgtaaatttcagtgcagatcaagcgtttggttggttggttggttggaagcttgactttatttgcttcatttggagagaatataagatgaaaaagttcatcattagaaagagaagtaagcattagagtcacaggatgggattttgaaatactctgtgagttgattgatgttcctaaagttccctgtttaatgctctgagttaaataggtggccatgctcagcttcttggatgttaatagtaacttctttgtttttcagatactgtgttgacaagtggtcatgctaccgactatttatttgttggaaatattgtttacacagtaagtttatctctgtttattaagccattcttaaacagcttatgtgtggcttgcacttctctaaacccttaaaaagggccttcctcattattattatttatttcaaatcttcaaaatgtattttatatatccttcaaagttcagaatggttgtgaaatgcttacatcatcgtttctgaaggttatgccaagtgaaggtttctgggcaggtggttaacagatttccccattcttcaaatgaccattttacacctacctgcaaaggaaaacaacactcaggaaggtggtatctcccaagctaagaaaagggcaaaactattatttatgagaaagactgttactagaatgaaagctcttctggaagtgaatctgcctgtatgtcccctgaaaataacccttagagaattagctactgacatggctggtgctttcaaaccggagctgccttggggaagctagttctggagtggagagatgggatttctcatggaaagtgaaaataactcattgagaataatgtgtttccaaactgtcttttattttcacagtatgttgttgttactgtttgtctgaaagctggtttggagaccacagcttggactaaagtaagttttctctagaattgtttctctgttcagtatagatatttttcatgctaggatttctttttaagccttggggaaaccataagcaatatctggctatcttctttcagattttctgtgtaaaaattgtggtttgatcttgatcagggtaaatttgcaatccaaagtctcttggtgattcatttgcttggcacgtaatacagctctaagctattaacagtcatctcacttcaaatgtatttgctcattgtaaaaacaaaaaccatattatacacacacatatatggaaaatatagaaggacaaaaaacatttaatgtccataattttaccaccaagagacagtcactgttaatgctttcctgtggaaccttccggacttcgttctatgtctgcatgtgtgtgtattttttaataagatgatgcattataaaacataggactttgtaatcccttttaatttaaatatatattaggcacattttctgtgacttaaaatacaagtcaacaaagttattgttcttgattaaagagtattacgttttacagatgtcccaccatttacttcatcactctcttattttagacattttggttatttccagcatttaaagattataactaaagcttcatgtgtgtctctcatagtgtcatgacctggctgctgtttaaatgctctgctaagaaaaatggggatggggtggaaggtcagtgaggaatcagggaatcccctaagagacagtggcaattaatccgggtcagaggtgatgatgacttcgcttacgatgttagaggaggaggtagtgagaagtggtcggagtctggattcattttatctttctaaaagctaacagagcttgcacatggattagattgtggggtgtgaagagagaaagaagtcaaggatcatcacattaagaggacaaagaagaaaaaatgaacaacgcagtagatgcttaaaggggcattgttaagaggcaatatccatttcagatttaaaaataaaaaactcttggctaaaggaatggaacaaagtcttgaaatgataaataaaaacatcttatttattttgtctgttcagccactctgttaccagattaatgagtccttgttgtatacagccgcaggttggagcaaacacttgctatgaactgagaggggcccgctgttactatgggagaaatcttagagtaaggtcacctgtgacagcaaaagcaccttcatcttcagggtactttggggccattcattacttgaattcattgttaaaaattctgagacatgggaattagaaagattgaacttcccattaactggtgagtcatcaaagtctttccataaggaaaggtagcttggatgcaaggattctgcagcaagtggagttggggtgaatctgccaggctggtcgagaagcctgtctgagtgtctatttccctctgcagttcagtcatctggctgtctggggaagcatgctgacctggctggtgttttttggcatctactcgaccatctggcccaccattcccattgctccagatatgagaggacaggtaagtactcctgattgggagtgtgtcttctgtgtcttgtgacagcaatgtttctccatgggcgggtgagcaggcactgtgtgtcttacagccatgatgagcttcaggagaggctggtccttcctgcttccatcagaatctatcaggagataaaccaaaccaaagcacctggaagaggtcatccagtccacagaaaaggcatttgaagtttcaagtattatgaaaactgtcaacttaaatcctccggcttattggcatgcccacatttccataataaattatgtgttaattacacacagtaccaatatgtacagttggaaaactggagctattttgaatggttcctaatccattgattatgttgattacagttttgatgttgtactctggtttgttgttatactctgctgggtcacctgtgacagatgaatctaacagctctatgaaccagatcattgataaaccagaatctctcattgttcatctctttgaactagagaggctgagattgaagacctttacactcatttgaatgttttttattttttccttcatattatctttgtccagtgcataagattgagccatcaacagtgacaaactgtatcctagaatcccacagtattgggtgtggagaggaatgagctgacagtcctctggtacacacctcctcagtttaccaaggaagctgtgcaggcccaggtctccaagcccaccccagagaccccaccctggagttgcccacatccagcactgcccttaaaccccaagaggctgctgggccctgtactttaaggacctctgctctggccttctgtggctgggtgtgttcctcggcacggagtgaaaagctatgatgcacagagtccatcttcccacttgtaatctattctctgggctcccaggaccccttgtttccttcccaaacagccaaaagcctcctgcccaggcctgcctggtcctctctccatatctaggccagtgtgcacactgggccaaaggggcagctgttttcaagggtgtgcactgagtagatgatgtttgcaccgatgttcccgcccacatttgcaggatgcttgtgcaggggcacagaacccagggtgggatgggaactgtgggtcaggctttcattggtgttcctgccccaggatacatactttagggccaggcctgttcatggcacacctggctgctatctctgctttacttactctgtagaaatgagcaaaacctcctgggtctatccaagtctggaccatgtctagcaactgtttctcgtgagatagcccagggtagcattacttgccatttcacctggtagctctgtcagctaatagcccaggtcgtctgagacctccactgagtgtgggtgctgagcaggacggacctgtcctataggagtgggcttgcatgtcctctagtgcatctttgctttctgtgaggaaagaggacaaacatataacatgcttttcagtttttttccaaatccagacagtagaggaaattagagggcgttcagtgaacccagaagattgttgtgtagcaaaatgagcattttccaacaaagatattttgtgtttaaataaatcagttctattttaaagcaatgtgattgatccccacaaaaagcaaaccaagaaaagtatccactacaagacaacgatccattggtaaggcattggtgcttagaatatctgctttgtgttctcttccttctggttcaggatggatctgctgtgatgaatatttcatttggggaattttgtggtgatggacaatagatggggcctcagccaatggccatagacagtgttctaaattagagagtgacagctgacaggacggggtcgcttggcatgtgactgacagacaaagcccattcctttgaaagctcctcctgagtcctaaacagagagctgtgccagggaaccacatgtacttcagtaactccaaatgtgcgtgaattaggctgcttgccaactctcactcccatcgagataccgactttccaactgcagaaggaccaggctgatcatgcagctactaaggtgccgacattttcactgtaccagtcacataagcatgatggtctgtatggttataaggctcagattaatggtgacattcacatgtttaaggactcttccagcagaactttagtgagttgtttctaccatccgaaagcaaagaagtgatcatattcaaccacattgcatttttctgtaaaagcttatttttctttaaaacatgtcattttaatcactttattggttggttcccatgaagcagatgataatgatgtgaaatagatgatagctgggtgaaaccgaggttttcattaagcagtacatgagaggattaatgtggttctctagtggccggacttccgagtaggtactctgctgtctgagtctaaagaactgtgtatcatctctagccttcctccagggcagggggctcctgagtgggtaaagggggccaggaaatgtgtaactttagtgtcacagccaacttttacactgtttcacctgcagtctgccactctgtattttgactcagtgctttgttcattctttgaaaaatggcagggaagtattacaaaacatttttttaaacacctttgaaggattgcttgggtggatagtggcttacactagcctgaagtctcagaaagccttcctcctggctcaggaggacttatatgctgtcataaaaaagaggaactgggttcaggtgtagtcagtaaaaggaattggctcttttggggaattactaaaaacatgcccacgccctgttcattcctgggggtctaggttggtaactgcttaggagtaaagggtattctaggaaaaggccactttttaaaatgactgtttgaagaatgcttctagtgatttttataaaccactttttgtagttcactaaacagtaggtttttggcaagtgaacctggttatgtgaagttctagaattaaactagtgcctaatagcaaacagcatttctcactcagaagccagaaagagatttgacacacaaaacattctgtctattcataacatcttcagccattgaaaagatgcattgtttctgctgggggtttcctaaactaatttgattaaatatttctttgtcttgtccattatatttggagtttttctcacggagaagaatatgggttttcccttgagggcaaaggaaaggaagggctatagaattgaattattctacactatcaaagagtctttatcttccctaaatcacctcatgacatggtatgtgaaacccagccagacaacatgtcaggaagtcccagtggaagtttctgaaatcaaagaagtcatctgcatccttcccctcctgaaaatacgccacatttgtgggattttaaggggcatcctgtttttccgtttttctcttttgaagcttggatttatagtaataaaaacttaggttgtgtctatcctggggaatgccagtcctcggctatggaaaatacatgatgatgttttttttccgtgggggaccaggtgtttttcttttccccagtagaataaccatgagataaaatgggtccccaaagcaaatacttgaaaatggaaaatgacaaaatcccttaggtcaccaccttccccaaagttgcctgctgaagtagaactttgcattggaaagatgatggaaacttgatcctagaccaggtcaggaaatgtgtttctgttttcttcatgcatttcccagcacttctgactttagtagtgctggagggaatgccatcttacttgacctctgttcaaaagtccggagacctggctctgttcatgccccagctatgatagttacgtaaccattggcaaatcattttacttgcattaatctcctaatcagcaaagtcagaataatgccacccaacctaattactttagagaattgtgatgaagatataataggctaacctgtgggaaatctaaaacatggatgctcttctttttcctggagtgatgaattgtttttgaaccttcatcaataagaatattgctgtgatttgaactccaaattcttttagccaaagaatttgaacattttataggttctaaatgggatgtttttgagtaaggtctattgaccacctgcatccaaatcatctgggttgcttgtcaaaatgacaacccccaccccccaaaaatatgtgcaggcaatcacgtacacacacagagacacacaatgcacacacacagagagacacacacacagacacacatatacacagacacacatagtgaattgcaaactctgggtgtggagccccagcatgtgagcttcagtaaatctccaggtgattcttccctttaaagtgtgagaaccactgctttaaaacacctaaaatatgactctattagaatgttttagctcctgctgggtgttacaggagaagatggtacactgaagatacagctgagtgattgctcatgttaagtggttatgtaggatgccagctggtgacggtgaccaccgtaagggcagctagctttcaaagtagggaattacaccacgagacatgaaatcgttaaccatggaaaaattctcctcactaacttttgctgcttttcctttaaagttcttttcattgctagtaagagaggggagaaaaccttttgacttcaaagcatacaatctgcaactctgcctgcagtgacaagctcctgactccagccagtttctggactgggacaggcttttttttttttttttcattctaaatacaggaatgggtttactcttgagttttatgtacacacttgtgtacacacaatgcaaatcccagtggactgtaagtaaacagagggaggaatggttctgtcatcagtgaatcagtgattaattcctcatcttctccaattgtctcccctggatttgtagcaggcctaggtatgttccatgtgaaatttgcaaagactgatgtttgtttaccagttgtatgtgctctaggaggtaagctgagaagttggggtgatgtcaagtaggtggccatctttgctcagctaccattccaggatgtctgtggaggatgggagcttaacggtaggaatccacccgagggtcaggagaggacttgttttcaggttaaggtctgtgtggggcatgtttggttgtcccacatccatcctccttcaccctttcctaagggtgcctagtgtgtattcactgatgtgctgtgacttccacccctaagtccaggtgaaagcttcatcccatcccccctgccacagtgagcgggtcaggaagcctgaaggagacacagggagacacttgctgggggcttccaggatagcagcgagtttgctcctaaaacaaatccatgaaagagctggctttcccatctgaaccatgtgggtgctgctgtgatgctgggaatgggtcagccacaggaggaaaaccaccctcagaatcctactatagcctgaaagatagactaggaagacaaaaagacaaacaaaaacaaaagtgtcttttttttattgttttattactttttatttgacaagtaaaggactccaaaagtctctatgcaattgttgagacactgtatgaagccagcctcgaagcccatcccaggtggggcgctcagtgagaatttcctgtgtgctgcccggccttgtgggtagccccggccaaggaatcctctcttcacccaagtgcgggtgttgggatgttcccttagcttcctcagccaaggaaataaacgcttgttaaaaacaagcttaggactttagcatatttaaactgttttattatactcaaagttacagattggtttaaggagctggtaaaaattactttagcactgcaattattagttttttagataacattccagaaaacactgaatgagcatatcttaaggttactggaattaatctttaatgcaatattgaatagactcggtccagttttcctcaagtatcgtattttagaaacccgtggcatggctggtgaggagcggtcagcctcgtcaaggaggaagtcctatcagcagagattcacctttcggtttggaataacatcgtgacatctttttgtacagttttcttgagtattgaaattggcccaattattcattgaagtccaattcacattctggcttttcaactcgtacattttgtggaatagtgagactcatttgcaagaagtaacacactgtgtttctggatgacattctcatctgaatgcaaagcacaatgagcgaagttaagacagtaccgacttcctggcttctgctgcacctgtgactgttgtcgcctgcaccccagggtcccccatccgtgtgcatttccttcctagaaggctcccaacaccagtccctttctgaggcaatccctagaaccaaaaacaaaactatagcaacaacaacaaaagcactttgggaggcctgggtgggcggatcacaagttcaggagatagagaccactctggctaacacagtgaaaccccgtctctactaaaaatagaaaaaattatccaggcatggtggcgggcgcctgtagtcccagctactcggaaggctgaggcaggtgaatggcatgaacccaggaggcggagcttgcagtgagccgagatcgcgccactgcactccagcctgggcgacacagcgagactccgtctcaaaaaaaaaaaaaaaaaaaaaaaccttttaattggtaataaagaaaaatcagaaacattcagttgagcagtgctagctaagtgagttctcacagcctgtaaatatttggattctaaaatcagaaaactcaggcatccatcagacaacagttctgtcagaattggcttttgtcatggttacacataatgccaacttgtttttgtttttctcctcctgcttaaaaacaaaggagaaagttttttaagttggaagctccttaaagtggtttcagattctttctacaggcggtgatgggaacagaactcccgttatcctaattgcctctggattctctggaatcctcctggattaaagtgacccgaatccgatttctttcttatttagtgcaaattgtaactgtgaaagtaggatttgaactaaattaagctaatgcctaagacatttatgaagctaattctattgtctgtaatatccatacttgcgttatttctgagcttgtttttcaggtatatgaaggagataatatctatcttaggatttaatagggaaattaaggaaaataagacatgtcagtaacagtaggtaatgtttattgaacaattgagatgagaaaagttctcttgtccccctggcagggcgtgtgagaggggagtggctcgcttcttcagcgccccgctgctcagacctctaggggagcatacagatgggcaggctgtggggttctgaccccacggtagtgtctaggggtgaatgtttacagctcctgaaccccagtgggcatgtgttacagggtactctttcagtttagctgtccgtaggcagcttgtgtaaaccagctcagttagaccctctactttgtcacaaggacagagggctttgtgtatcccaggttcttgccttggtttaccggaagaatcagatcacacgtgggcttggagaatgagtgcaaggtgttattgagtggaagtatctctcagcagatgggggagccagaagggagatgacttttccctggagttgagccacttgacagcccggctgtcctccaattgttctggccaaactctgtgtcattctggcgataggtggcctgacggcgcgcgggtgcctgtccgtgcattcctctagacatctggctttccagtgttcctctgctgatgtgtttctctcaacgtccagccacctctgtgtctgctggctagggtctcgatttttgtataggcacaggataggggcgtggcaggtcagggtggttttgggaaatgcaacatttgggcaggaaaataaaaatgcctgtcctcacctaggtccctggacacaggcctgggggtggagccctagccagggaccatgcccttcccccattctgtatcatttaaagggaccactcccttcccttcccagcacttcccttccatatcacaattactacatatcagacaaaacatattcatgaaaatatgtttaatatatgcagttacatgtgtaatgaagtaagcattggctcattcagtaatctgcaaccacatgaggaaactgaggcttagagagaaaggatcagtctcttgaccaggcagggagtagagtggctgggattcttctggagtcggttggactccaagctgggtcttctcactttgtgactatggaaagcagctacagtgatgatgaaccaggtgtttgagaaatgttgctcaattctccttaacgttttgcttttaataaattttatctgaagtgacttaccccgcaatgcaatagaatttttaaaatatgaatgttgagttagaaggaataagcagactttgtgtttgagctgcaatcttctgtccacgagcccaatcttttttaaagtaaagcaggtttcaaacaacaggatttattttttacgttcattatagaaagccctcatttttttagtccttgtcctcccttcccccgtatacaatttcctccattttggcagtttattttctttttggcctctcatttcaaggatgctgtgtgttaattagaggccccgcggctttgattgagtggtttttttttttcttcagaggttttgttgtggtgttggcatttgtcattcattctgatgttaatttttaaaatatctgtcagcaaattaaagtacacattacatgctgattttgtttgtttgtaatatttatgctcagtggtcacagtgtacgtctgatgtggttttgaacttttcctttcttgaaacatgtggaaatgtgtatgtgggccactcttattaagagtctgcacaggggttttcttctccaacatcttcagagggaggtggccttgtctgatgactggaggttatcatcatcacagttcccccacccagagatggcagggatcttcaggtttatccaatttaaaaggtataaaagtgccagagaaaggccaccaagtccggttatgcaagaaaacatgaccacggtaggttagagaagagagaaaagagaagcatagcatgctattaggcatgtaccaagaagtttctgtttcatataaatgatgatgcaaaagctattgtggacagtatctgagaggcccaaaatactgaacagacttaaaagtaggggatattttcagtgactattgcttacatcatcattgtaacatatcgaagcatccactgagtaaattggatgctttctgaactttgattagccagctgtcataagtgttggcattcctttggctaaagacaagaaagagaaatctaggtcgcttgtgtctgtgcttgtatgtatacttcgattcgcaatacttttttagtgactgaaacctgatttcaatgcaggatggaaactgaaagacaggcatatttaaatgtgcagagtgctttctactgtgctctgaagacaaaccctatccactttgctcagcaggagcaaagacatctctcatgcagggtacagtgacatcttgccatcttccgcctgccctgcgtccattcccctcacccccccgccctctttcggaatgcgcattcaaatggtgctgcttctgcctctttgccacctctagggtctggatctgtgacccaaactggtcagccgggtcctctgcctcactgaccatggcagttgattcaggaatgcacatggtgccccaggctggagtatcacctagagacagttcaaggattttttacagaaactaattgggggatggagctcttttgctgctgggtctcttataggaggacggtgtcagcctggagcggctaggacaccctgcagaaggtggctggctgaggatgaattgagcacagaggaagggtgcactgagagccatcagcattgagcacacccctggatccagctctgcctgaagctagagccatctctgacctgttagatattgtcgttctatagcagaaacacagttggttccattttcctaccatgcatctaccaagttggagtaggaagggactttgtctactttttatagacttcagtatgtccttcccccagcttctttacccaaggaaaagaagacagcgttgggtagaagcgaattgtttgaaatagagagggaaggaaataggagcttttctaagcgaggcctctttctcttggcagccaacaattctaactggcttagagtccaatagtcctgagcagtgctgtccaatagaaatataatgggagacttatgtataattttacattttctagtggccctattaaaagaccaaaaagaaattcattttattgatatattttatttagctcaatatttccaaaatattatcactttgagatgtagccaacataaaaagaagttagtgaaatagtttgtgttcctttttttttttgtactaaatctctgaagtccagtgtgtgtgttgtaactaccgcacatcttaagccaggctagacgtatttcaagtactcagtagcatctggccagtggctgctgtgttggacagcacagctcttgaccaacgcagatctggaaatgcagattcactccccaacgctaaatttagtgcaggcaagatcaagaggtaggaaactcagcctcagcccagatcctccaggttcctcccacacacttggggtgtgcactgcctgacttctattttagtcactcatcattgaaagggttttggctcttaggcaagactttccctaaaaataaaacttggggacaactgagctcttaatctatgggcttattaattgctttaagtggagtttataaatcaagatttataaagtgtggatctgactcaagtcatttttccacaatgttggctaatcattttctcctgaatgttggaaggaagaggtcacgacttgggtcatacttgtgtcacactgcaaccagctgagcaaaaagaatccgtgccactgaaaataggttaggtctgttccttctaaatggttcctttattatgtaagtgacaatttctaagcaagattattatttaatgtctaagattgtgggaacctctcacctttgtgtcctttttgagtttcagtcctctcccctcttattatgatgaatccaggctctgttatttttaccccctaagtatctcttttttttttttttttgagatggagtctcgctctgtcacccaggctggagtgcagtggcgcaatctcagctcactgcaagctccgcctcccaggttcacaccattctcctgcctcagcctcccgagtagctgggactacaggcgcccaccaccacacctggctaattttttgtatatttagtttcaccgtgttagccaggatgttgttgatctcctgacctcatgatccacccccatcagcctcccaaagtgctgggattacaggcgtgagccaccgcacccagcctttaccccataagtatctcttaaatatatctgtttccacccagtttcatcccatccagttagtttgcgcagcatcatttcttgcgtggacaattgcagtagtctcatgactagttcttagcatctgatctgcctggacccattcctctaccggagccagagtgatcttgccaaatgtaagtctgatgtcattgttccctggcttcctgttgccctcaggataaagcctggggacatttacctggcccctgaggccctgcgaggcttaccactgctccctttatgctctccctcacctcatccacactggtggcttcccacttcctggtgtgaggagcgagctcctacagggcgtttgtgcctgctcctctcacttcctgactgcactggtctccgcctcctaccaagttaatgcttacacgatgtttagatctcagatgcttgatcacttcccaagggaagcctttcctcacatcctggacctacgtgctcctattgtatgttctcttaacacagtttacctttcgcttgttgtataatactcaccacaactaaaactctacatactaatgtatgaggtgtcatctcacacccattgggatggccactcttagaaacacaagaacagaaaacagaaaataagtagttggtgaggatgtggagagatcgaaacgcttgtgacctgtcaatggaagtgcaaaatggtgcagctaatatggaaaacagcacggaggtggctcaagaaattaaaaatagaactaccatataatttggttaccccacttctgggtatatacccaaaaggattgaaaacagggcctcaaaaagataattgcacactcatatttataacagcgttattcaaaacaggaggtagacacacaattcaaatgcccgttagaagatacatggatgaacaaaatacaatatatacacacaatgggatgttattcaacctcacaaaagaaggaaatcctgtcaccattctacaacatggttaaagttgaggacattatgtaaagtgaaatattctaacatggttaattaagaattgaggacattatgcaaagtgaataagccagtcacaaaaggcaaatactctatggttctgcttgtatatagtgagtactcgtagagacaggaagtgccatggcagttgccggggctgggggaggggaaatgaagagctgctgtttaatagacagagttgcagttttgccacatgaaaacgttttagagagccgttgcacaacagtgtgacttcggttaaccatactgaactttccttaaaatggctaagatagtaaatcttaagtttttatcacaattttaaaaatgtacgtttgtgtgatttactgattcatatcagcttctctctgtaaactggaagctctgtgagtgaagtgaatattctcaaatatatccttagtacctagtacccatctttttttggtattcagtaaatatttaaatgaaggaattcataacattgaacaacctctcgtgtacaattgggtgggtctgtagttggctctgtgcagttagtgcctggtatctgtttgctgcattaacacaaacagatgccaagtatttcagcatttatacaattataattgtataaattacacacaggatctgcacctaagaagtgattaatagattaatgaatttagcatttttcttaagagaagtgtgtgcaaaaagtcagtaccacaaaccatatatttttttcacccaaagaatgatagacacttccatttaaaatttcagcccaactgttttagccacataggtgatgtctgtggcatgatattcattgatattggcgtttggaaacagttaatagtcacacttaattacttcatggaaaatgtttgttttggagatgatattaaaggagaggcataaatgaaattaagatgggtatttttgagcacctaattccaggaagtactacgctaatcattctccgatagttttatgataagagattaaaactgaggaagacagtgggccacagatggcactagcagaagtttatgtaccctaaaccaacacatggttgggcagcattgtcattatgatgttcaagggactgccatttccaaagtcataaatataagcgtgtagttggagacaggttttggttgagaaaaatgtgacgcatagatagcagccagcctccaataaatctgggatgatttcacggaagaaatagaacttctctggggcattgttcctcagcagatcagggggtgggtgctccaaggcccgctgccttggaagaggctgaaagtgaagggtggatctggccctgccagctcagttgaggcgtaggatttcagtggcaagtaaagctgtattacaagagaagaaaagtttaggatttggaaagtctatccccagcacagcatcttaattaaaggaaagagtaaggaaaagcagagagtaaagtggctgtgagtgcagtaaagaagcagaactggggaaaggagagcgagggaggaaacagtgattgataacgggaggacgaggagcctgactgtgatggggaaggccaggtggagccatgaaacctggaaggagaagctttaaaaatttcaccgcaggaaattacaggcctgttgagaaactttactacgtatggcatcaaaacagagtaagactgaccatgaaaaaagatcctttaacatagtaactcggaattttgcctttttatgattaatgtgggaaaagtaattcttagaaataaaaggaaatggagggaatatcaacatatgaattttattttgtgctctttttctgaatgctaaatcgtttaaaatgaatccttaataagaaaaaggaataagcctttgtctggaatgtaaagaaagaaagaatttttccactattcaaatagaattaaatattgcattggggcattgtaatagttttctataatataaactaattgattctaagtgagattttaaaatctaagatgagcatgattttggaaaatagctcattattgctgaaattgtttcgaacaggaaatataaaatcaagaagcaactttaaataattaacaaacttgtctacttggggatttatttttatttaaaaaaaaaaactaatccttttttcccctcaatgttttcagtggttcaaacttagtggaataaacctaatgaagtaatattctcatacatgatatgaaagtaaatttgattcaagcttttatgtagttcttctgacataggtcatcttagtgacagattgccacctaccagatgccattttaggccactttctcccccaaaaactttttttaaaaaaggaaagtaattctctttattcttcagtatcactatgctagagttaggagttgtccagaaagttacagtttgggtccagatggtctacagagctcacctctttgtttttaaaaattcgatagggtgaaatgagcttccaacacttaaagctccaatcatggaacatctgactcataaagcgatgtttgaagctgtattttttgtgacttctccatgttgttttactttgtttcattgagttgtttatattcattcgtgttgtatgtctcttgccttctttaagttagttcttagttgtctttccttttgatgtccttggcaccgacctggtcctccccccgaccccacaattctgtttccagttcagtagtagttacttaagggtgtctcctcccatgttccttagagcaagtgcctttctaaactttcatactagccatgtggcataagtgtctgtttagtttatctttcccaatttttgcctagagactcctcttaagctgtttactgccaaaatcaccattgcagttaattctaaagccattgtataagcccccaagcccttcagacatgtcaaggaaagtagctgtgttcattaaggacaatacttagtgctttcaattgctgacaaagggaacatgctgcatttccagcgacttcctaacagtgtcacctgtgtatacagagaaccctcaaagacctgatatgtgtatgtcagactcagaagattgcccaagaaaataactagtttgctaaatggattgtaaacaaaatgttatcagtttaacccctcacttccactcagctctagagaagaatgggggttcacttacgccctttagatgagaaactttttgaggacagcatgttctgtagcgtgaagaagacaactcgggaagtgtctaaggaatggaagacaagaaggaggggagggccagaagagaaaccacaggagcccccttctcagtcaccgccagttaggctccttcagacaaccctgtgacttgctttataaggtatgtcgaaacaaatgaacctagatcattttgagtaattccatgtcatccacacacattggcctcccagtgttacaggaaagaggtcccgatccagacccaagagagggttcttggatcttgcacaagaaagaattcagggcgagtccatagagtaaagtgaaagcaagttttttaagaaagtagaggaataaaagaatgactattccataggcagagctggtgggagtgtagcagtgagaatgaacagaggtcgtacctgtcaccatcttggtttggtgggttttggctggcttctttattgcaacctgttttatcagcaaggtctttatgacctgtattttgtgccaaccttgtatctcatcctgtgacttagaatgccttaattgtctgggaatgcaagcccagtaggtctcagcttcattttacccagcccctattcaagatggagttgctgtggttcaaacgcctctgacaaccagtacctcaggctctcaactctctgaagcacagttcctgccttcccatcgccccagcaccttccactcactctgtctccactcacgtccatcaccacttccccaggcacaggagcttaaaaccatcagctgccttcccactctctctccctcatccctcacatccagagcagggtcatgagtgttcactcctgcagctgtgtcgtttgtgtgtcccagcatttatagcattctaccaccggtctccttgcagatcaccatgcgatttgctcccagagggcacaagccatgtgcacacatacttggtctatggggcatgtggacggggcaggagagcagagggcatttggctctgaggacaagaatttaagtcaactcaaagaatcaggactttgtgtatcttcttttgttgtggtttattcccacaaaagcgtatcttaaactctcattctctgctagtgactctttttgagaaatgctttatcgagcacctgggacaatatctccagtggtgtcactaattgaaggtggctactgagagggacagcaggaggctctcttggccactggccttgaccttagaagttcagggctgtaacctaaacatgctaaactttattaaatatgccagccaggatctttggttacaatgaaggaaaaaaatggacgttacttaataaacagaaaaagaatgcatagacagttatcatgcaatccatagaatatatgaaaaagccgaagaaccaggctgagaaagctggtagaagccaaggaggctacttcggaccacctgatcaagacccaaccctagcactgccaccactggatgtgcacctctgctggcgatggattctggactccaccctccaagtaatctttgaggtggccagtgctggcaggcgcatctgatggacaagcccaggtctcccactgtgcaccagctgtttcctttctgcagtggttcttcaagcagatttatgcaaacagccccaaatgtgttttaggacagtcctggcgatacccacattctcctgcaaataataggaggaaaatgtctttttcatttggcttccataggggaaagagttaggaggaaaatcctagactttttcttgaatatcttctcccagtgagaagacatatttgcctaactcaatcgataattgattaagtttaagaaattaaacttttttgaaaattcagtaatgcacacagacaaagcaagagtttttcccgtgagaaaaataaggcagacctgagcttgatacactttaaaaaggtaggtggtgaagaagaggtggcctcctagacaaagccacagcggcgtaggcctgtccatggagtggcctgtccatggggtactgttttgggcacagtgacagcaaggaataatcagttatcagataatcctaagatcagaaattgactacatgtaatcatacataattcgtcagtgtctaaagcaatttgaataacaattttcctttccctcacgcttccaagaaaatccagcggctaatccatagatggctatctcttggcaaactttgctttttgtgaagtagccacatgtcccatcagattaaaaagtgtaatttctttgttttcacaggatactgtccagtcaggaacaacaaaaaaaaaaaaaaaaaaggaagaggggaaaaatgtgattagtattatgtcattttattaatgaaggcactggtagtttcacacttaagtaaatcagttattacaagcaaggaaagttgctctccagccataatcctgacaggcctcaggggtattgaaaggttccagatgacttttgtttttgcagcagaatttaggcattgtgaacttctttctagaacacaggtcagttcatataaatctgctggaagaacctttacaataaggaaatggtattgataagctaccatttttccattcccaggagctactatttattgttacaagttacgttcccctaaatgaaaaaggcaacctcacctatcccttcatgcccccaaagctattcagcataagttaatcttttcaacagaagcagccaacttttctagcaaaggaatttgcagtctttgtggtttgggtaaaaaggtggctcattttaccagtttcttgatgaaatatgtttcatgataaattcaatctttcctcagaaaaattccccaaatctacttttctgtgcaaaattcagcatgaaagcctttctctgttgaagcagccaaagattgagtttgtgtagacctgggcaaacagtttcaggtccaaggttaaggatatttattgctggaggtattacatgtattcgtatccaggaagaacaaaattcaacaccttgacactggttttcaaatatattaatttactttcttttgtttggggggcatttttttttctccctgccctccttttaatccttttccacacttggtagaatgtggaaggatttttgccaggggtaactagcaaagctatacaatgtgttaatacacaggagatctgctggtttcttgcacagacttcagagaaagctgcttgcactctgactttggcataacatgcaggaaattcctcattggtctgcccaatgcaataaacagacctcctgcatctaaccacatccatgctgaagtttctcatgtggggttgcttttgctttttctgtaaaagttaagggtcccagcattcccattccacactttctttagctccttggctttggaatttgtgtaggactgtgcttgagagttaataggacttgtggctttattttttaatgttcgttatgtatacaaaaaggatagactaggtaaacgtgtcctccatggagagagagagagagaaagagagagagagagagaaagagagagagagaatagatgctcttgatataccttacagcttgataagaaagccagaagtcaccatttgcctgtgggtactctttagggacattgcttgctctattcactgcaggtgtttccctcagtaacccctgctactcaaagtgtggtccccaaggcagcaacatcagcctcatcagagggcttgtagaaatgctgagtctcaggccccagcccagaactactggactagagtctacattttaactaagccccaggtaattcaaagaacctaaaaggcagagaggtcctgggtgatacgccatgccaccagagtgcctgagtccatttcagtaaggacgccatgggagggtgtgaggggaaagcaggctgaccactggggcaaagagaaaaaagagcctggaaggactcgcctgagttcaattatgctcattaattcaatttgaggcaggaatgtgtgtaaataaacgctggcagctgcagcggctctgtttcccgcagggctcaggcaggaatgcaggggccattggacgtaaaaacctgactcggcattgggtggatgtttctgcaaccacgagataatgacggaaaagatggtattatcattatcgtattaggaaagtcttaatgcagagttaagtgccaaaccaagtggaactggagaggctgtgttagcatagataaaatcttcattatttgaaaagattaagcttacttgactgctccctcttctattttttaagtcaatacagatcggatttccagggggttacaatgagtaggacagcgccatggtcagacgcagcctgtcagtgtttccaagtaaataacctgttcgcatccactttttctcatacaaaaaagactaagttcgtgagaaacaggaaagagaaaattgaattatgtaggttaagaacaactccattgtaccataaacctgtgatatgtttattgtttaatttttggctcacagtgtgttcattcattgttttgagggctaggcagtgatcaccagttagccagttaatgtttgttaaaccccatgcggcatgctgggcaaagacacttgctcacttaaccattggaagatggctcttgtttgtactgtcatttttagaagctcattgaatattatgaattctaaagagatgtctgttttgcagcttaaaaattagccacaaatcccaagcgtctactcactgatggaggggcgctataaatgaagagagttgtgttcttcttaaactgggcatgttgtccttaaagcccctgtgcctgagatgatgatgatgatgatgatgatgatgatgatgatgatgatgatgatgatggtgatggtgatgatggtgatggtgatgatgatggcagcagctacccacaagctgggcactttattcaagctatatatatttaattcacactgtacctattctctatgagaaaccgaaaccaagtcctagtgaagttaacagccctgctcaagatcacacagccaggagtggggctgggctctgacctcaggctgtctccagggcttctaacagcagccattcaccctcagctcccctgctgtctcactctctagctctccctctccagtgtgtggcatgctttctctgcactctcagagctcgctgcatactcttatgaaaaaatacaaattagctgggcgtggtggtgggtgcctgtaattccagtactcaggaggctgaggcaggagaattgcttgaacccaggaggcggaggttgcactgaactgaaattgcaccttgcactccagcctgggcaacaagagtgaaactccatctcaaaaaaaggaaaaaaaggagaaaatacttgtgttatgattacaaactggggtgtgtgcaagtctctcacccactggactgtcaggagttttagagacgggactggcatggaataagccctaggttcacagcaattccttcctccttcatgcggacaggcccgtgtcttcactcctgtgccttgcactggtcctgtgggatgactagagagacagtctggcattgccaacatgtagtggacatctggggaagagtggagaacgcttgtcccctggcttctcccagcttcttgtcacagccagagaaagacctcccctatcagccactgcaggtaaaaccagagaaaacctcaccacctcccagtctgctgcactgcctgaagcatgtgtggatgttgatgtggcctgcgtgtgcaagtcagggtcatgcaggaaaaccttgcaagttcctgagaccttgagcgaccttcttggtggagacactgcttttaccttaggagaggtgatttaaaatctggctgagaatgacaggaagcagagcaaggagtatgggtctctggttattttatcccttttgtgcacatggccttttccctttaggagaaatggagttcagggggccagaaagatgagaaatggggttcttcagacttacctgtctaggccaccctcagtgttactcccttgtaccgacatggtgggagaatggttaatggaaggacagtggggcctttcactcctgcctcctgaacctccacctttgggagggtcagtggcccttagcaaaccaggacaagttggagttacatgggtctctgttcccttctccatcacagcagctttgggaaggattcaacaagtttatgtcagtccttggggattggggatgatggctgcacagtgttggaggaaggaaatcatgtcgggacctcattccctgccactcaccacccacacgccccactcccaagtattcaagggccaatttgtttgtggataaagcagatcccccgcttctgctcccacttctcgcgggtgccttctagcttcctttgctcattagcaggctcttagaaggcaggctgcagaaggaggcaagagatcactccaaaatcagaagtgctttggctggcacttcccagcagcttccttgggaagatagaggatgttgtgatcgcctggtctgggacagtgatgagctttctccctcctgatcctctgtcagatgcaggcagtccccgctgctctgagctcttcaactgttactctaaccttggcctgagactctcctaagcatgctttgaaaagtaaaattcgtgagaatggggcccaaacatgagagcacctgggtgaacagagtttgatttcattgcccctgcggcttctcctgccccactcaggcacttgccctcctcccacgagccatcccagatccctggggcccttctgcatcacctctgacgagtccactcttgtcccctctcctggcctctgccgactgttgactctgcagggaacacaggaactctctacagagatgtaaggggcttgatgctgtgcccttgcctgcatggccttcctgttactttgtggcagggcccactatcctgagctggcctccatgtcctggtctgcccagggctcgcttcctctctccagcctgagagtcagtctcctttctccgcttgcttttttttttttttttttttttttgaggtggagtcttgctcttgtcacccaggctggagtgcagtggtgcgatcttagctcactgcaacctccgcctcctgggttcaagcaattctcttgcctcagtaccccaagtagctgggactacaggtgcccaccagcatgcctggctaatttttgtatcattagtagagatggcgtttcaccatgttggccaggctggtctcgaactcctgacctcaggtgatccatctgcctcggcctcccaaagtgctgggattacaggcatgagccaccgcaccaagcccgcttgcttcttttctctaatgtctcttttcctgaccctggccctctctccttcttttggggtggctggcatgcttctcacagaggccatcgtaaaggctggggaggagggctggagcctgctggggtaatagtgcctgtcctgcccagctcatctgcagagcccccggggttggcgactgcagcagtctcagcacatcagtcccgaaccagagaaattgcagtgtcctgctgtttttcattatgctattttcttcctatttattctatggtcttgtttctcttagaattaaacaatcagaaactgatatgaggggaattcaatcagagcagggtatttgtggagccagggcatttctcctctttgacacagccacatggcttgttttcatgcattactccttaataatgtgtttatttatctagactcacacgattctctcttgccctgggtaatccactattaaccgttaataaccaggatccctagtgaaggaagggatttttcaaagaaaagcaaagggaattgcaggtttgaaattctagagagaatttcggtgggggtgagaatacaccctcactgaagagaatgtgggaaaataactgagagtgctcttcaagaggcagatgttgtacttctgctgatgctccactgtattcaagctgcattttgtttgaaagaagcttttcctccaagaatattacagtagttagttctgaaattgacaagcaatgttatatcacgtcttggataaagtatatatatttatgtatctgtaactaatgaatactgacattaagctttccaaattacttaataggacacctgtccctcccaaaagaaaagttggaatgtcggggtggtgatggtggaatagcgtatttgttgctgggatgaggtcataaagctaacttaactcttgttctgaaagagtctcagtgtggaaacggtggcacttgccctggctgggtttgactgtgtgagttttgtgttttgtaattagaagggaggtgtgcctctgctttatggacaatgcctggcaaatgctgccctccctatttttgtcgcatctgcaagtgtggtatgcatcttgtaaacaggtcactaattccaggctaggggctggaaggcagctataatctcgctcacgtggtttcacccgctccatgtgcgctggatgccgacagcacgaggggaagcctctgagagcgcggcttcgtggggcagagcatctcccaggcccactccatggaaatctcttccaagtggcagcccagagcctcttcgtgccatctgatagctgttccatagcgtataggaaaacagctgagactcagggccttctccagagggagcgccagagattactgccaggagagtgggaaatggtgagaaaaacatgaggtggcttccactctgcaagcccttagtactacataggctttatttacatggtattgctggttgctcattgtagggtcaaatttatgaagaaaggggtaatcagctcaggcacattgacaacagctggtctgctagctgacccagaacacttttccatataccagccaacaatgcataatgtctaagtaggctctataaacatccattctgtgtgactcatttgtgtaaagttccagagcttgcaaaactaatttatggtgttggaggtcaggagcgtgggtatgcctgggtggaacagaggatgagtaagaaatggaagaggtgtgaggaggcttctgctaagtgtctggggttttttcaaatctaagttctgtccatgggtattcattttgtgaaaatggaaagtcacttgagatgcacacatgtgatctgtgcactttatgtatgaatattctacttctataaaaagtttacactaaaggtatgacatcagatcataaggaaaaacttccttcctcagtccaactctttttttttttaagacagagttttgctgttgttgcccagactgaagtgcagtggcgcgatcttggctcactgaaacctctgcctcctgggttcaagcgattctcttgcctcagcctctcaagtagctgggattacaggcgtcggccaccatgcccggctaatttttgtgtttttagtagagacgggtttcaccatcttggccaggctggtcttgagctcctgacttcgtgatcttcccgcctcggcctcccaaagtgttgggattacaggcgtgagccacagcgccaggcccctcagtccaacttttattattaataaattcagacaagagaggaaaggaagacaacaaatgttaatactatgtgtcttctacatgcaggccctgagccaggtgctttctttacatccaccctgtgagccatttagcttttaatcacttcttattaagttttgatttgtctattgaggattcccagtttgtttgtgtttttttttagtttgattcttttaacagaccaatgatcatatcaatatgtttttgaatctcaatggaatacttttgaataaatgcttctgtgggctgcttatccaatgaataatctagaaattcatttcaacacactaacatggatatcaccaccatttgagtgacttttgaggtcgtggaagttgatggcactgcccatggagagtaggcaaggaggcagaaaggaaagaacccagaccccccccccgccccacccccagagaacactggcatttgcaggacgaataaacagccttctgcttaacaagggtagcacagcacaggccagctagacagaggttcatgatcgctctgtaaggatgcttggataattcaatcttgttttcactttataaaagtgaaatagctttgggctgttgtgaaattctctgtctgaaattttaggttaggacccaaacaataacctgatgtgaatttagtagcactgcacttgtcctccttaaacaactttatctaaaagatgcctataaatattttgtataaaacttccggaattggctgataaggggactttcctttttcttctgcgtcaagttcagaaaaagctaaaagcaaaaaaggaagcaaccaaatatgggcagtatgcagtaactaatgaagtgagtgatgtggcttggaatatacaatgtgctcaaatgttttaccgctgggttcaacccagttagtatatagaagtttgtagagttcagccgggtgtggtggctcacacctgtaatcccagcattttgggaggccaaggtgggctatcacctgaggtcaggagttagagaccagcctgaccaacatggagaaaccccatctctactaaaaattcaaaattagccaagcatggtggcgcatgtctgtaattccagctacttgggaggctgaggcagcagaatcatttgaacctgggaggcggaggttgcgatgagtcaagatcgcaccattgcgctccagcctgggcgacaagacggaaactcttgtctcaagaaataaaactgtagagttcatggggtcatttgtatagaaggaaattttattgaaatcactagttttttttcttttatgtatgtgaaaatactatttctgaagttctcttctcttcgtcacctaaatatggcaattttttcctacaatctgtcaacgactatgccaagaagcaaacaatgtgagttctaccacataagagaaacttcctttatacattctccacaaaagatttcaatgttatttcgtataccatcttcagacagtaatttatttgttttactatttttgctgttgttgcttcaggcctgatcattttccccatttcctaataggaaccaatttcctgttaattgctattaaatttgtttgctcatcctttgtcatatatatatatatatatatatatatatatatatatatataaaatttaaatgattttaaaaaataatatatggtcaaaaatccttgtattgaaaggattgaaaatcccctaggtgaaggtttgtattaatactttttgtttaaatcaccttcttttttatctatttctgagctatagaactcttgaagaaataatttcactgttcttaagaaaaactcagagatgtggtttggtcataaccctattcacacttgcttgaggcccattggtggattaatgctctccttaagaagcatgattatctgaggcttggtataggttttcaggcaccttagctcttttcctgttagatgtcagtatcatggctgcatcctccttccccagtgcatgaccactccttgaccttcacggtggtcagtctccagcagcacttacctcctgcctatttgttccttctagaaattcttgctgttttttgcttctgaagcataattccttcctagctcccttgactgtgactttgccactatttcattgcttcattctcctccatggcccattccttaaatgtaattggtctgaaggttttttttcctcagatacttttttaaattttttaacactttttaaactttaaaaacaaatttggccgggcgcggtggttcacgcctgtaatcccagcactttggaaggccaacgcaggcagatcacgaggttaggagatcgagaccatcctggctgacatggtgaaaccctgtctctaataaaaatacaaaaaattagccaggcgtggtggcacgtgcctgtaatcccagctgctcaggaggctgaggtaggagaatcacttgaacctgggaggtggaggttgcagtgagccgagatcgctccactgccctccagcctgggtgacggcgcgagactctgtctcaaaaaaaagaaaagaaaaaaaattttaccgtctctctgggttacattatatataccaaggtttcaattccagctgaaaactaacagcttccaaatatatatctttagcacaacactttatagttgctaacaactcagtttcctttgaaagtggagacagatctttttcatcttttgtatctctttaaatacctaacagaacgcctggtacacaaatattagatagaagaaaaatgtacatcagttaaaagttcttaatttctatatcaattttagaattgtgttctaatgaaatatattgtactagaagatgtactggaagcatgaacgtagatatttccttccctgatacgtatttgtacttctgtcttcatgaccagcagaccagcctcacaattagtccatttgtaactaaagtctctatcagacagaagtgcatactggggttttagatgacattttacacaataattgttttcttcatttttctgggacagactgattttgagcataagtctgtgtagtagaaatacgaaaatatttgggaattcttttttctttagtgggagccttttattgctagaaatgaatatcccatagagctaaagaaagacctatgaaatttagcttttaaaaacaaagctgtgtttaagttctttggaaacagaaggtattgcttaaaaatgacacagcagatgttatgaaatttgttttaaagcattactctcaggttaagtcatgtttgccaagttacaacccagaacacgtttttacaactcagcagtgctctgaaattgagggtctgtgatgataaaagggtactcatgttgtgcagtggaccacgagtgctctgtcaagctgtgggtgaggaaatgaacctcacatcaccttagaagagtcgagcatctcttcctgagttgactgagtgaagccaaagtaaagttgaaaatgcaagctacattgtcccctaagatttacttttgttttaatagatgctgtgtgttgctctcactcagttttggagttatctgtgggttttcttcaatgtgtatttgatgtttctttagggcaaagttacgccactcgaaaacgatcgtgttgaaagtgtgtcatattcagaatgggatagaaatcaggttgcttgttagacctgagccttttgttttgttttgttttgtttgagacacagtctcgctctgtcgcccaggctggagtgcaatggtgcgatctcggctcactgcaacctccccctcccaggttcaagcaattctcccacctcagcctcccaaacagctgggattacaggcacccaccatcatgcccgcctgatttttgtatttttggtagagacggggtttcaccaggttggccaggctggtctcgaactccctgacctcaggtgatctgcctaccttggcctcccaaagtgctgcgattacaggtgcgagccactgtgcccggccagatctgagccatttgatccctgccttcatccctattaactgataatttatctattcattagggggctctgtgaggtgggttctgactgatgttggaggggatgcgctataattcctgcctctgcatttaagtgtatgagtgtttcaccagggatgtccaaactgtcccactttgggtaaaggacaaaaagcaggccaaacaagattttcttttgtctgacacaatttaaaaaaatattgcaaggtaaaatatttaacagaatgattgtactgggttggtagtgtgtgcgtgtgtgtggtttgcttgattttgaggcttcataatcttttaaaaagatggagatgtatgaccttcaaagcctttttctttttttttttttggagatggagtctggctctgttgcccaggctggagtgcaggggcgcgatcttggctcactgcaagctccacctcccattctcctgcctcagcctcccgagtaactgggactacaggcgcccgccaccacacctggctaatcttttgtacttttttagtagaggtgaggtttcactgtgttagccaggatggtcttgatctcctgacctcatgatccacccgcctcagcctccaaagtgctgggattacaggcgtgagccactgcgcctggcacctttttctcatttttattagtaggtagtgtcagcttgggttcttactgtgcacagcctatcttggcacagggtggcatctctttagttatgagacattcaatttggctttatgggtggaatttacttgatgcctatgaaaaataagttaaaaggcaatggaaacaacaaatggaaacatttctctctctctctgtctctctgtctctctctctctctctctctctctccttccacctgtgttatgcagatgtactgggaatgaaaaataagtcaaaaggcaatggaaacaacaaatggaaacacctctctctctctctctctctccctcctcctctccttcccctttcttccacctgtgtcatgcaggtgtactgggacacagcatacagtgcgatgctctcctttgtgcctgggagatgctccctccatccccctcctctgccatagcctatttgatgacgtctgtgactgtatggggccacagtttgggtctcaactttgtgtgaagcacagacttttttttagtctgttttttttttttcgcatcaaaatgaggaccaaatatttgatgactcctgatagaaaatattcttcaaagaatacccagggctgaaaacattaaaagttagcacaaagtgttaagtggttggtaatattagtattagataggctcaggtttgggactgtttctatcaaacataggacatatcaatcaaatgttgttgtagcgtaagtccagagaagatttttttttcttttagaaaattttcttttttttattattattatacttttaagttttagggtacatgtgcacaacgtgcaggtttgttacatatgtatacatgtgccatattggtgtgctgcacccattaactcgtcatttagcattaggtatatctcctaatgctatccctcccccctccccccaccccacaacagtccccggagtgtgatgttccccttcctgtgtccatgtgttctcattgttcaattcccacctatgagtgagaacatgcggtgtttggttttttgtccttgtggtagtttgctgagaatgatggtttccagcttcatccatgtccctacaaaggacatgaactcatcattttttatggctgcatagtattccatggtgtatatgtgccacattttcttaatccagtctatcattgtgggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcgccacaccaacttccacaatggttgaactagtttacagtcccgccaacagtgtaaaagtgttcctatttctccacatcctctccagcacctgttgtttcctgacttttgaatgatcaccattctaactggtgtgagatggtatctcattgtggttttgatttgcatttctctgatggccagtgatgatgagcattttttcatgtgttttttggctgcataaatgtcttcttttgagaagtgtctgttcatatcctttgcccactttttgatggggttgtttgttcttttcttgtaaatttgtttgagttcattgtagattctggatgagtatgttgcaaaaagtttctcccattctgtaggatgcctgttcactctgatggtggtttcttttgctgtgcagaagctctttagtttaattagatcccatttgtcaactttggcttttgttaccattgcttttggtgttttagacatgaagtccttgcccatgcctatgtcccgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccatttcttctttttgtcaggtttatcaaagatcagatagttgtagatatgcagcattatttctgagggctctgttctgttccattgatctatatttctgttttggtaccagtaccattgctgttttggttactgtagccttgtagtatagtttgaagtcaggtagcatgatgcctccagctttgttcttttggcttaggattgacttggcaatatgggctcttttttggttccatatgaactttaaagtagttttttccaattctgtgaagaaagtcattggtagcttgatggggatggcattgaatctataaattaccttgggcagtgcggccattttcatgatattgattcttcctacccatgagcatggaatgttctccatttctttgtatcctcttttatttccttgagcagtggtttgtagttctccttgaagaggtccttcacatcccttgtaagttggattcctaggtattttattctcttcgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacaatggggttttctagatatacaatcatgtcatctgcaaacagggagaatttgacttcctcttttcctaattgaatgccctttattcccttctcctgcctgattgccctggccagaacttccaacactatgttgaataggagtggtgagagagggcatccctgtcttgtgccatttttcaaaaagaatgcttccagtttttgtccattcagtatgatattggctgtgggtttgtcatagatagctcttattattttgagatatgtcccatcaatacctaatttattgagagtttttagcatgaaggttgttgaattttgtcaaaggccttttctgcatctattgagataatcatgtggtttttgtctttggttctgtttatatgctggattatgttattgattttcgtatgttgaaccagccttgcatcccaggaatgaagcccacttgatcatggtggataagctttttgatgtgttgctggattcggtttgccagtattttattgaggatttttgcatcaatgttcatcaaggatattggtctaaaattctctttttttgttgtgtctctgcccggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttattcctggtttagtcttgggagagggtatgtatcgaggaatttatccatttcttctagattttctagtttatttgcatagaggtgtttatagtattctctgatggtagtttgtatttctgtgagatcggtggtgatatcccctttgtcattttttattgcatccatttgattcttctctctcttcttctttattagtcttgctagcggtctatcaattttgttgatcttttcaaaaaaccagctcctggattcattgattttttgaagggttttttgtgtctctatttccttcagttctgctctgatcttagttatttcttgccttatgctagcttttgaatgtgttttccttgcttctctagttcttttaattgtaatgttagggtgtcaattttagatctttcctgctttctcttgtgggcatttagtgctataaatttccctctacacactactttgaatgtgtcccagagattctggtatgctctgtctttgttctcattggtttcaaagaacatctttatttctgccttcatttcgttatgtacccagtagtcattcaggagcaggttgttcagtttccatgtagttgagcggttttcagtgagtttcttaatcctgagttccagtttgattgcactgtggtgtgagagacagtttgttataatttctgttcttttacatttgctgaggagtgctttacttccaactatgtggtcaattttggaataagtgtaatgtggtgctgagaataacgtatattctgttgatttggggtggagagttctgtagatgtctattaggtctgcttggtgcagagctgagttcaattcctggatatgcttgttaaccttctgtctcgttgatctgtctaatgttgacagtggggtgttaaagtctcccattattattgtgtgggagtctaagtctctttgtagttctctaaggacttgctttatgaatctgggtgctcctgtattgggtgcatatatatttaggatagttagttcttcttgttgaattgatccctttaccattatgtaatggccttctttgtctcttttgatctttgttggtttaaagtctgttttatcagagactaggattgcaacccctgcctttttttgttttccatttgcttggtagatctttctccatccctttattttgagcctatgtgtgtctctgcacgtgagatgggtttcctgaatacagcacactgatgggtcttgactctttatccaatttgccagtctgtgccttttaattggagcatttagcccatttacgtttaaggttagtattgttatgtgtgaatttgatcctgtcattatgatgttagctggttattttgctcgttagttgatgcagtttcttcctagccttgatggtctttacagtttggcatgtttttgcagtggctggtactggttgttcctttctatgtttagtgcttccttcaggagctcttttagggcaggcctggtgtgacaaaatctctcagcatttgcttgtctgtaaagtattttatttctccttcacttacgaagcttagtttggctggatatgaaattctgggttgaaaattcttttctttaagaatgttgaatattggcccccactctcttctggcttgtagagtttctgccgagacatcagctgttagtctgatgggcttccctttgtgggcaacccgacctttctctctggctgcccttaacattttttccttcatttcaacttttggtgaatgtgacaattatgtgtcttgaagttgctcttctcaaggagtatctttgtggcgttctctgtatttcctgaatttgaatgttggcctgccttgctggatttggggaagttctcctggataatatcctgcagagtgttttccaacttagttccattctccccgtcactttcaggtccaccaattagacatagatttggtcttttcacatagtcccatatttcttggaggctttgttcgtttctttttattcttttttctctaaacttctcttcacgcttcatttcattcatttcatcttccatcgctgataccctttcctccagttgattgcatcggttactgaggcttgtgcattcatcgcgtagttcttgtgccgtggttttcagctccatcagctccttcaaggacttctctgcattgattattttagttatccattcgtctaattttttttcaaagtttttaacttctttgccattggttcaaacttcctcctttagctcggagaagtttgatcttctgaagccttcctctctcaactcgtcaaagtcattctctgtccagttttgttctgttgctggtgaggagctgcattcctttggaggtgctctgatttttagagtttccagtttttctgctctgttttttccccatcttttggttttatctacctttggtctttgatgatggtgacctacagatgggattttggtgtggatgtcctttctatttgttagttttccttctaacagtcaggaccctcagctgcaggtctgttggaatttactggaggtccactccagaccctgtttgcctacgtatcagcagcggtggctgcagaacagcggatactggtgaactgctaatgctgctgtctgattgttcttctggaagttttgtctcagaggagtacccagccgtgtgaggtgtcagtccgcccctactggggggtgcctccaagttaggctactcgggggtcagggacccacttgaggaggcggtctgcctgttctcagatctcaagctgcgtgctcggagaaccactcctctcttcaaagctgtcagacagggacatttaagtctgcagaggttattgctgtcttttgtttgtctgtgccctgcccccagaggtggagcctacagaggcaggcaggcctccttgagctgtggtgggctccacccagttccagcttcccagctggccaccttgtttacctactcaagcctgagcaatggtgggcgcccctccaccagcctcgctgccgccttgcagtttgatctcagactactgtactagcaatgaacgaggctccgtgggcatagaaccctccgagctaggtgccggatataatctcctggtgtgccatttgtgaagcccgttggaaaagcgcagtattagggtgggagtgacccgattttccaggtgctgtttgtcacccctttctttgactaggaaagggaattccctgaccccttgcgcttcccgggtgaggttatgccttgccctgcttcagctcacgcatggtgccctgcacccactgtcttgcacccactgtccggcactcccctgtgagatgaacccagtacctcagttggaaatgcagaaatcacccgtcttctgtgtcgctcactctgggaactgtagactggagctgttcctattcggccatgttggctccaccccaagtccagagaagcttattgctggcgagcgtggaaacatgcatgcatgggtttctgtctgagtgctggagctctgtagagcaagggcagcttgggatggcctgccagtatgccctggcaattctgtgttacaggtgctgtcctttctgctccttgtggtgtgacatgccacaactcatttaaccccctgcctgggtatgtctgacaaattgagaatatagaacctgatttatctagagttttgccagataatgcatacgggtgtctggtatactctcctgaaaatatactatggttatacagagaattacaatagcaagtgactgggtacttcctgcagatggcagggataatagaggcctcccaggagggccactatctcgactgagattgagatctgagtgaggagcagagccggtggtgtccgcaccaggggaggcaaagctgagcggaggacacagagcatggtgtgttctgaggacagggccacagtcagacaggcaggaaggaaggggttggtgcaggggagggtgcaggaagaagagcagaggggtgcacggtagccagaccacggaggtctttgtaaaggacagagcaagaaacttgattttcctgcagatgggatggagagtctttggagagctttaataggaaaatgacatgctctgatgtctatttccaaagctcaccctgcctctctatggggaaaaaataggtggtacaggggaaagagtggaggcagggagtccagctgggtgatggggacttggagttgggagtcaggtggacatgaggcacacagctgtgttcgaggatgctgggacctgcccagggactggagtagaagctgtcaactgaagaataaccaggatcatacatttggaagagctttatttctcataaagggttatagcctgcaggctggccattcctcctgctgggaggcagagctgagagggagggaggataagacaggaatttatgctgaaatttctgggtggctggaaatacatatttaatgagctataggaggagtcatgaatatttatgagaggagaaacatgtacaggcacaattgagttccatgcctcttcatggattacatgttcaaaaaatggcagtgttagcatgatctgaggtggagttttcagccctctgacatgaaaaggtgcagtggaggacaccagaacctcactgcatcctctgagagtcagccaaaacgtgtcccaaggtggtcgtcagtgtttacgaagggatgtgttgtgagacaggtgagctgtcacgtggaagaagtgaagagggaggggcatctggtcgcagtttcagatgattggctaaggtgataaaggaatgagttgtccatttctcattttccagagctgatttctgcttactccttagaaagagttttggctaaaggttaataaggaaggggcacactgaggcgtgttcaaccttatgtctgatgtggtcaaaaactccgtttttaaggtttctccaaggtctccttggccaagagggggtctgttcagttgcttgggggcttaagattttatttttatttctcaaagacctgggagagagaagtgtccaaggcacctgctagagttttacctaagcaaaggggtgggaaggtattagcgctgttgactaagatggaaaacacgggagaagaggggcttgtggagaaaccacacctccattctagccacgtccactgcgaatgcaggtgacacatggaagcagcaggaacacccctgagcatcttcatggagtttggatcaagatggaagaaaagcccatgcgttgtctaaggctgcctcatctcagaagccaatgggcggtgtaattagtgctgaaaggtgggctgggggatgactgcattgctctagcaaggaaggaggagcagggagctgaagggagacaggtggaggaggccaagcaactggctaagcccatgagggctaagggaggcctaaaatgcgggacattggagaggaaatgttctggaagcttctacaggcaaactgcattgtactggaaggggccgatgaatagtgctgggtcaagggtttttaagtggaattgagaataagggaagcagaaaggtggtttgaagaggcgaaaaaaggaaaatggactgaaccgaaagggccttgggagtgttatgggattggagaacttttcctaaataatttaggagctccagtagaatttatgtttatgtgaaagaaaaaaaaaaaaccacatgttacttagaattgggaagttttgtgcacccatgtctaggaattaaattttatatgaattcatatattatatattatatatacataatttaaattgtgatttttaagaagaaatcaaatcaaccagcaagggcaaaataaaaattttaattatctatttgtttttccattatttttatacacaaatcttagaagcaggaacagagtagtttcaaaggccagtttctgagacatgcttaaaattggcgctgataacaaagaaactactatgaatggctgaggtttcaaagttagattagagttcactctagatcgtatttgctaagctagtaaagccgtgtaggcttgttctagcctgttggctgggaaactatctctaaacaggatgtggtgattatttgtgaatgatcattactcattctgacaacagatcctcactgcatgcccaaggggacatccccttttaaacatgcgtataaagatgactcaagtacgaatatcatatgtacagcgtatcaatattagctgacctaccaaatctgaaaatgcttaagtaaagataatacacaataatctagttatattaagctatattcgggatccattaagtagcctcatagttatagaaaaggataacaaaaaaattttttggcaatctagtggaataggggtatggggtttaaaaaggacaatgaaaaagttcactgagcaggaaaggaatggaagattgctcaacagatctacaggaaaccattcccccgccatcacctctgcatttcaaaaagcaaatgcaattccggtcagaagacattgtctacttcggagtgatatgcttataatctatctgtgtgtgttttttaactcttacagtgaagcttcaattatatcttcttaaccccttcccaaagccttgggaaacactggacatttttctatataagcagattgggttatttgtccaaatgacgggtgtttttgaactaggacatctagcttctatccataggaaaccccatatctggtgggcaaagaatagagtataaatattatgtatctgatatttacactttgggccataagtgtttgaaacagttatatctattcatgtgaaatttctgttcacattatagcaacaacatcaatttaaaaaaaaaaaaacaaaaaagaattccccaagactgtccattctgcgtgtgtgtatgcacgtgtgtgtgcatgtgcaggcattttgcaccatgctgcaaaacagctcctcttcctacatttgcccttgactgttcatctcccaagactcaggtcttcattctcctctgcacgttcctgtgctttcaacccgtcttatagtgaccccaattctatgtgttcagcccagacctcttcctgaaccacaggcccacgctggttgagtgaatttccagttttcagtacgacatttcctcctaaatgtctgtggtctttcggtccctgaaaatcaactgtcaaactattaactgactttatacatcctcagcatgcacacacacacacacacacacacacacacacacgtaaatgcacatggcaggggttggggcacaaagtagataaaaactcctgtctcgaatcacttgaacctgggaggcggaggttgcagtgagccaagaccatgccgttgcactctagcctgggcaagaagaacgaaactccgtctcaaaaacaaaacaaaacgaaacaaaacaaaaaaaattccggtctcctgccatagctcctgtcttggtttcaggttactcatactaggaacgcagagacttattcttgacttttctctctcccacagtctccatacgcaaacagcccccagatatggctgctttaaccctgccgttgcatttgaatctttcctttccttcctgctgcccctccaccacagaccctgctaggtctgactgccatggctctcttctttcccttcacctcaatctcacatgtcacttcccactaaccccacctggtctcccatcctccatcctgtcccctctaagtctgttcttcattggaatgatcctttcagaacctgaatcactcatgtcattcattcctctgttcagaaacttgccgtggcttctggcctcattaagagagtaagtctaagtccttgcaatgatccagaccactgttgattatccctgccactgctgtccttgctcattgctctctgccacggtggtctcgttattcaacgtccctgggtagattttgtctttaggttctgaacttgctgttccctttgccctcagccctctcgaggggtcactcagatcctcagcactgccctcctcagtggaccgacatcgacaccttaccctgtttccaagtcacttttcacctctggacacactgtgggatttacttatttctttggcttgttttcccacacacattcacacaatgtataagctctatgaggctgcagtttttgtctgttctgcagttgatttctcagcttctaacaggaagtaaataagtagtttttaagtaaatgaatgtgaatcttctggggagcatttaaaaaaaaactgttgtacaaactctgcagattgaggatcccttatccacaatacttggaatcactggtgtttcggattttgattttttcagatttttgaatatttgcattggacttaccagttgatcatccctggtctgaaaacctgagatccaaagtgctctagcaagcgtttcctctgagcgtcatagcacactcaaaaagttctgggttttgaagcatttcagatttcacatttttggattcgtgatgctcaacctataccttggacctgtcaaatcagaaaccttggggagtctgatccaagagatgatactttttcaaggttccccggtaatccactgcccagctcaggctgagcgccattgctgccagacagatttcctaaaccgtggacatcatcccaccttcatgcccttcgacattctccgtttcctcatagaatcatgcccagactcaaagtgacagtcacaaacccgcacccgttgccccaggggccttttggcctcgtgtcctgcccctcaccatgcgcctcttcctgcctgccggaagcgctgttgtcttcccttgggtgtgttgctgcctcgtgccctcccttgcctttgcctgtgctgttgctctgctgaaaatactttctttccattctctgatgggtgagttgctcaaggataaagtttggattcaaatgtcagtgttatagttttccctaatgctctctctttttcctcacatctccccccggtaattaatggttgcttatataacacattgtgtgtcatatccatatcctacaccattggagttcctcattctctcatcagactctgagcacctgaaggataagaacatttcattgatttatcctcaacattcagcgaataatcacatatagttcttttaccctcagtgtctgccaaattgtcaaatatggttgtttagtgtgccaaaacaaaagttatgttattgatgtgaggtatctctttatcaagtttttccgagtattcagtagtcagatacctgcatgcgcatggctgtaagcatgtgtacgccccacccccgccaccgccccgaggagaagagtgtgtgcccagcctgggcccttggtcctgaagggagagcacgtcacccattgtcatgttattatccattaacgtgacattgtatcttctctctacccagagacatcacccatcttctcctcattcctgaagacctaactttagcctctactactctctctttccgcagataacctccttaggtactttacttacttaaaaaaaaaatttttaagggatgctttctaagtgacatctcttatacactcatttctaaaacgataagtttttctcttcctctccgaatttagtttcctattatcctgatctatcacttcttaacggacactgattctgctctaagcctctttcacttatttttatatgctctctctctctctctctcttacttccctgttggtctttcagttttctggtttctcctagcattaaataaaaacaagagcagtagccgtcctgcctggtatcccgtgctatccctgtgctccctcctccacagtttcgccaacagcggttggtgcgtgttgagtttctgttcacacctccggcccctctccatgccctctgcaggccgctgccatctgggtttctctggaagtgcagaggccacaggttgcaatctactctccagcctcggtgcctgtctctgccctggttctcctctgccagctgacctcttgccttctgattcccagaaggacagggcgttggttcctgtgattttccactctcctggggccccttcctgcctctagagtggccatgcccatctcagcccttcctcgccctgagggctatcaaaccataaatgagagaacttgccagaaagcctgaggccacggaaacattccacacactgtgttttccttcccaagtcttggttatttcctctttgttctttgtctatactcctcaagcaaacctctttcttgaaatattacacttctcccaactctctctgcagttttttttctagcaccagtctatatttgcctgcatgatgaggccttaccttaaactttacatgtctaaaacacatcttttgtcttcctcatcctttttaaaataagtccttccagatttctatctttttgtcattcatcttctgactctagtgccccaagtctctgatcatctctgtattcctccccctttatttgcccttcatggccagccagtctttgcatcctttcactaccctccccgccccccgcccaatcctagcataaactttcatatcctgtattacttcctgtcttcaatctcttcttttgtattacagctacaaacttgacctttctgaaagcctgttttcattgtgtcactctgctcagaatctgcagtgatgcccttatttctcttccaggattaggtaactctacccagtcttcaagggtttccacagcatgccccaccttagcaattcccagcaccccgaggcctgagcagcggtggggtctcctgtctcctctcctctctgccttttgatgaatgctcttgttcttcctgtatgaaacgctcccccgccttctctctccccctcttgccgtatatctcctttctttctcttcttgttcttctgtgagtacatctgtcacaggcccttggttttctgtcactgcttctacttaactattgagatgacagaatgagagccttcagatgggaaatcctggtttccaatgttgcttaaagtcttaccactttattaagcaagcctaaagctcagtggcagagtccctgagtaagccatgtcttcgtctctttctccctggtgatcaactctgtacttggagcatggatccttaataagtatgttttgttaatgaacagtcaaacagatagaaaagactcacgaaactgtttattgtattccaacaaatgatagctttgaaaagaagctaacctggtggctcacgcctgtaatcccagcactttgggaggctgaagcgggcggatcacttgaggtcaggagtttgagaccagcctggtcaacatggtgaaaccccgtctctaccaaaaatgcaaaaaactagccggcgtggtagtgcacacctgtagtcccagctactccggaggctgaggcaggagaatcacttgaacctgggaggcagaggctgcggtgagtaaccactgtgctacccgtgtggagatcgcgccactgcactccagcctgggcgacagagcgagactccatgtggagatcacgccactgcactccagcttgggcaacaaagcaagactccatgtggagatcacgccagtgcactccagcctggcaggagagcgagactccatctcaaaaataaataaaaaaataaaataaaaggagctaagttaaagttgaatgctcagttggataatcgtttactaacaattgataggagcttggcctctggtgagtttctagatgacagtggtcttagacctgtctctatcccttgctgttttcattcatacagtaaagaggtttattgactgagccactcaacaaccatttcgtaatatctatgatggggatacgttgatctttaagggtcctttcaactgtaaaacagcgttgatgacattttctgaagacaaacaaacactcaaaagccttacttcttaacaggcctgttgaagattttctttttcccatctttgccatcacaggctttctttacactccctccactccactccacccctgctttttcttgtcctaactctatgtctacaccaaggctaggcccttgtgcttttagctgccaaacaccgtatactcttaaataaaaacagtagaatttgagtaaaaagagattttcttagagttctgtgatggaccaagcatgaaatgatacagccaactctacgaggaaataggaaataggaccttgaaggttcttttcagagttaaactgtcctgttggattgcttgttcattttaagactttgacttattttagatatttttttcagataaaagttcggtgatgacaaatgaactctacagtctggcatctaccctagcagactatcaaaattgaaatgattaatataacattcgtcatttgagataaataccttagaaatctcatttaaagatagtcatgtaacgccccatggttttctaccgaggcgtgctttctttgctcctatgtctgtagggcagttttctaatgcagtggtgtcagtagttaccgtaagtcagcagtcattgtgtgcagctctagtccgagcactttaggtctgtggtaacagtgacttaggtgtgttgaacatagtttcacccttcaagttgtcttgtccagctgggattacagaggaaatgagaatttcctaattagtcagttagactgatcttggatactttcatctttgcaacgtcttgtcttacaagaaagtaatgaagccgagattgttcttcctatttagaatagaccagggtgtccacaaggcctcaggtccttccgaggtgtcttgtaacagcattccacaacagctgttctgttttaaggctcagtgcactccacaaattccagacgccccatggctgctacagttgctgaatggtgacttcaggcttcacttggttcaagcctcaagggggctgagccaaagctggcatgacttgctcttcagcaacaagttccaaatagagaaaacatttcaaataccaactgactgctgctttcttcaaaagaaactgccttcagaggagaagctcttccctgtgctcatgatcctggttccatgacttccacagcattttcatttcccagcccttctgtggtggggacagtcgatctagtgattgtgaataattttagtgtgcaatgcttaacttttacaaaacaagccaacaaagctgaaaatattatttggatgataagaggagcaaacaaccttaaggaatatttttaaagtgtggatttaaattgaatcgtaatattaaatttttaggtttggtaccatgtaccttgaacttcaaggattgttatttaccagtaatatctacatattaaatctttatttaaacctgatatcaggaggaggagggtggggagagaatggtcaatgggtacagaattccaattagaaaggaacagtaaatgctggtgttctattgcaaagtagagtgacatactagtcccccaaaatgatcttagtacctgctactctagtcaacaaggtattatatatctcaaaatacctagaggaaaggattttgtacgttcccacctcaaataaatgataaaatatttgcagtgatgaatgtgctcattagacttatttgataactacacaatgtaaatatgtaccaaaacatcacatcgtaccccataaatatgtataattatgtttcaattaaaaataactttttaaaaagctgatatattttagctgagtgtgaaagctctgcaaatacagtagagttgttgattaatttttcgtattattatgcattttaggttggtgcaaaagtcaaccgcaattacttttataccaacctaaaatacgtaatacaatatttacttccttgaaaaggaaatccttaatgcacatttaaattatgagttcccagaataatgtggctggtaaaataatacattttaaccatttttaagtgtacaattcaatggcattaagaacattcataatgttttgcaaccatcaccaccatccatttccagaaccttttcatcttcccaaacagatcccgttacacagtaattccccacaggaattcccgccgccctcccccaactcagccggttatatccactgttctacttcctgtctctgtgaatttacctattctaggaaccccatacaggtgcaatcatacaatattttcctttgtgtctggctcatttcactgactgtgttttctaggttcattatgttgtagcaggtgtgcaatttccattcctttttcaagctgaataatgctccgtcttgtattggcctattttgcctgtcccgtcatctgctgcgggatggtggtagtgttcgcgcctgtggcttttgtgaagaataccgcagtgaaaagggatgcacaagtttctgttttggcattgattaattttgaaatgtgcctcactctttttcctataataggtaatactttttgacaagaaatattaaatatttttccaaaagtggtgcagaattggcatttttgctgttttcataatggaataatacttgaatgggtataggcccttattggaagttctgggttctaggttggctggttacagatttgtgtaagtcctcatgcctcactgtaaataccatcttcacgcagtagcgagccctttcacggcacctgtaaatgattaagtcaatgtaaagagaagactcattatccctctttagataaggccaggagatttgtgagagaggtttttgcaagttctgtgcagaactgcagtatggtcaaagctgagctgttaccttatcagctgtgtgtgagccctgcaggtgttatgtggacagcagtagagagaagtcaacagattggattttttttcttaatttctgtattggaaaaacatgggacaacgggtgtctcctatatttaatttgtgcttagatgtctactagaacctgatgaaagtgtttttgttttccagttaggaaaacacgctgtttcgctcacaaggttgaatgaagatggtggtctttgcgcaatatccatgtattaatacattaataacaattgagcttataataaagaattgtgccctttcaaattatctgaactgtctgctgtatgtcacattttacctttttagagaagtgctaattcatgttaagtccgcctgagagatttgtttaatgagcagattaaatggatgattatccctctcaatttttttttttttttttaaggaagggcttcttgtgatgctcctctgttatttggcgcaggaacacagaggggtctttttaaaattacccctgcagggtcaccaggacccaagctgtttgcttcattaaaccctggtggcttctttagagccagcccctccaaacagccctgacacaattgtatctaaattagcatctgactgacccctttctctcctcttttcaagcccctgctgacagggattggcaaaagatgttaattggttgggcctggcttggaacaatagacttgccaagatgacaaaagaactaatgtttctttcaatatgcatccagattcacataagtacctcttttaattcctgggaattattgtaatgcctggtcaatgggataattgaccctcagcagctagctcttactccataatacagcatggcacaggcctatcagagtagcaggtactagggtgatttgcaggggactaaaaagagattttctcagccagcgttctgtgatgtaccaaggcagcccagtgggagtcccagagaggggactaatttgagcttaacagggggaaaatgtgctaagagccactaaaacttatcctcagaatcataaaggagttgcataaaggaatgagttaggagtttgaaagaagtgagttagtagcttggcagcttcgaactcatatggtgaaggataggacctgggcccaacaactctagacaggtggagacgccgcagaatgttgacttccacacaggaaaacacaaggtttatttccagcacataccttcgctgctcgttttatagaagaggcatttccagttcagatgttaggctaaatgagcccccaaaccttttcttatctcactctttactatcccaacttgctagaaatcttacagatcgttttgcctggtactgaggctctagaatttgttttaaaaaattaactgtggagaaaagggaacccttgtacactgtagtttggaatgtgaattaatacaaccattatggaaaactatatggaggttccttaaaaagaataactagaattgtcatatgatccaacaatcccacttctgggcatttacccaaagatttcaaatcagtatgtcaaaaagatgtttacactcccaaattaattgcaacactattcacaatagcagagttatggaatcaacctaagtgtcaatcaatggatgaatggataaagaaaatgtgagacacacacacacacacacacacacacacacacacacacagtggaatagtcttcagccttaaaaaagagatttagtcatttgcaaaaatatggttggaattggaaaacattatgctaagtgaaataagccaagtacagaaagacaggtgctgcatgttgtcacttacatgtgaaatctaaaacaatcaaactgaaagatgcagggagtagaatggaggttatcagaggctggggatgggggatggagagatgatggtcagagggtacagagcctcagtgagacaggaggaatatgtttttttctttgagatatattatacagagtagtgaatatagtaaataataatgtatcatacacttaaaaatcactaaaagtaaatttcaaaagttctctccacaaaaagatgcgtatttgatgtgagggatatattaatttgcttgatttaattattccacattgtattcgtgaatcatggcatcactttgcaccccataaatacatgtaacttgaatctgtgaatttacaacctaaattttttttaattaactgtgtaagtatggtatagtatgcactacagagtagtcttactttgaggtttgggttgtaattccaatcaaggttaatgtttaaaactagctgtctccgacctccattacggtaacaattggcactacatggtgctgagtgggagcttcattttgtggttatgacagcccaatctgagaaggaggtgtttgtggaagcactaaatgcagcagtgcgttggtcaactgagtagcctttgaggtcagatagccctgcgtctccctcccaacttgtcacctgtgtgacttttagcaagttactatcatccctacgtgtaggttcctgctttcaaaaagggataaagagttaaaaatagcaattttctaaagaatcgcagagcaaagtgagctgatctcatgttattccatacagtgccagatatagagtagtactggataggccatctgttgtcatcattgccccaggatcgcatagccaggaaggaatagagatgcaattcacactgactgctgtttgactctgaagcctacactgtttcaggatgctgcgttggcagttcattcctaaaatttaagggaaaatatccaaacacctcaaaaatggtgaaaaaatagaaatgcttgtttccatcttttaaaagagcaagtgagaaaaaaatatatccattaaatataacaaaattcagatacatcattctgaccttctttgccagaaaattattttcctttcataaaactataatatacttttttctagtgcatgtctgccatggaaggagaccatttaagcaagatattgattgttagttctcaagtttattagtttctcacaaagaaaaaggtctgatttatacaccagagcgtggggtgcatgccactgcctgaagctggtgtagagcatcctttaggcttcaagggtctcaatcagaaatcatgttgtgtttgttcagatgcttgatctggcgaataagttcagtctttagaaattaagttatcttaggttaatgtgaatcaaatttaaaaaatggtgaaaagcagcattttttgaagtgatttgagttaggaaattagtatagtgtacaaagtctttctgagcttctctgggagcagctctggtttttatcccagaaagtgtatcctttagcaggagggcttctagctgaccatggaagtcaaagttctagtccagcttcattactaagcagctctgagcccttgggtggttttgtccatcactccaggatgtttgttccctgagcagtaaaatgaagggacacaaccaggtgacctcatatgactcctcagcattagaccaaaagacactctcgtcatcatctcacttgatgtttgtgccattagatacttatggctacctctgcttcctgaaactcttctttgtggacatccaaattatttcttgcctagttccctcttatccatctctttccatctcatttgccagttcttccttccctggcttccatttaagtgtgtttttccttagagttcagcccttcctggatttcctgtgttttcctatggtatcacttccattcccatgacaatctgcaatgtgtatgtgtgtattaaatattaatataaatatcaagtataaatatccagcccttacctctttcttaagtgccagacttggcttttctaggaacctctcccactttacacctgtgtgtttacttggccacctaaacatcaacatacttgaaaataaaatctattttctacaacctgtgtactgatgagcacccttatccatctcaatgctcagaagtggaatgtggaaggtttttttatgctcttactattccctaacctacacatccatctgtttccatccctcctctccttcaccagtatgtcttcaaatccacattctcaatgctgatgtactggtgtggccctgtcatcttctgctcaactacagcagttactccaaaccataatccccttcccgccatgctttaccttatggtacacccctgtcactgcacagacaattgttaagggtcacagctacctacagagcaaaccccagtctccttagaggggcttcgcagtgctcccccatggggcttctgtctgcccgcctcagccaccctttctttaactccacctcttgactccaagcctggaaccaagccatggctttcacatgccgtgcatccctctgtggaacgcccttcttcccccttcccgatttgttaggatttggctcacctttcaagcaccaaactctcatcatttgttaaggtttcgccatgaaaggtgttactgcctgtgtggaatcttctccaaacttcctagcagaattcatctctttctgtgccgacccacagctcttaagcatttctgttctaaagtgcttctgttctaaaattatgttgcactctaccagtgcattggtccatttatcataatgttgaaacaaaaacatgaaacatttctgtgaaattcttctttatagaaatcatagaatttgtgtaattatgtacttaaacccacgctagtggagcatctgtcatactgtgttaccatcaacgggttgtgtatcagtcagggtctaactggggacagagaagccaggctaattatttaaaagattgtcatttaattaaaggaattcattgcagatgtcatagaggggactgagagagaacctgggggtgaacaacagcagaaaatcgccaccaccctgtgatgaaaggaccaagacaagaagcaataaatataccaaagctcagtagctgggtcgctgggctcattagctcaggagctggagccctagtgggccagtccagcaggggcgggagcaataagtgaatcatggccaattttggaaacctccaggcacagggggagaagtcctggcttctcccttcttctctaacctcttgccagcgcttcccactgggaggacccagttggaaggtgctagaaaatgcagcctgcatgagttggcccctgcaggggtgaggcagaactgactccagtcctagagacccagcacagacccaggctgtatctgtctccctcatgtgttttcttaaacacaagaacctcatcttacttgcttttgcaactgcagtgcctagcaccaagtaaggtttaataagtatttagtgaattgcaatgaactctaaggtttccttccaagactaaaattatgttgttctctaccagtgcgttggtccatttatcataatgttgaaacaaaaacatgaaacatttaccaagaaatttttctttttttctatcgtagagtttgtgtaattatttacttaaacccatgcgttagtgcagtctcaatcctattcctttattaacatgaagccagtgctatttatcagctcttggttggttttgaaaacattttccaccaactgtgcgtcagattaaatacaggaagggaaatggagacattgatttaataaacactaacaatgtgacagaaagggaaaaaattatgttgcagaccattttcacataactcatcctaaatatgcctttgaacaggctcctgctggtctgtggccaggccctctgcgccactcagcacaaaccttctgcagtacagcccacaaggccgtgggcacagcacaccgggtctgagccagagaactgtgtcgacggtaccagccttcctttttaaattgtcttgcattcccttggtggggacattccaaagaagacagacagtccccgcagcaggtgcatgtggtgctggtgttcagctgcgtgcattttcacaggttgctgtcttgcaggcgagtcaacctttagcctcacccttctgtcaccagcccgctgcagaatcttgtcgattgcactgatcagacataaagttatcgcgtcggctgtgccatgggatccaatgtttgatgtacgtggtccagcgaggttggaggaaatcttagaaaacaccccaagttctttgtttccaaatgaggaaatcgaagcccagaaaagggtcactttttgtagcttttggcctgtaactcatgtcactcctaacccatcatcatttttgttttgctgcacaagctctggaagttgttttaaaccttaactctgaacagagtgttacactgtggttgtatttgtaaattagtttgcttctcttctttctgcctcctcttatctctatttatgtttttctatatacctcttcttattaccttgagacttgaactcaaaaatcacatgttgggcacttgctgagtcctagataatatccagggtccatataacttggggtttttttctggcaccaacatccttatcatcagtccaattgctctcacttcaaagtccttaaatcttgcacttattttcacttcttagtgcgttaacagattgtacacaactcagaaggattgactctagccgcccatgcctggtagtaacctctcttcatgtcagtagaattttagagtctttgtctttgaagtcatcctccaacccaggccagggcagggatctctcctgtcctagatatcttcatggatacagttagcaaagttgacaccaaatgttaagcataatgagattagcctggttttcttccttcccttgtcttcccttcccttccttctttttgtccccccatttaaagactttctaaatctgcagagaaccagttttaacttactccgcagctgaaattaccagatgcaaagtcaaggcaaatatgatacagtagtagttgttttgcattgattatatctgctcctcatagtaaccctgaaggggtttttatagtctgcatcttatgaagaaattgagaaagacagagaagaggtaatctacccagtgtcacagagatgttaagctgcaaagctaggctatagtcttgggcctcatggatttcacacctgcccattacactgtgtcactcactctactgcattaggaagtacagcatcagctggtggctataacaattacaattcatacaaataagtgtaatttcaagaccaatcactcattaatgttgacataaataatttactagaaaattctattttggtgaagttttaaaatagcatggctttcactgtgctaataaatatttaaagaaagatgtatttgttttttcccagcaagtataaaaataatttcttcaaaattcgatgtattattttaaattagttaatagatgtatcacagccatggactgcagaagttgtaaaaccttatttaattctaaaatttcttaaatatcagagaatacatttttgttctttgaatattggaagccccaaaagatagttgaccatgaagaagaagatgagggaaatatgagaaggcagatgtttgaagagaataattatctgtagagggacatgtttttagattcaatgaattcatcacttgtaaagtggaaatcctggccaaaccacataaatggatttgagctgactgccagataaggagcatttcagaaataaaagggcaatggtgcagcttgaaggataggcttccaaaagcattctgataaaaataaaatgcctcaagatgctcaaggttcctgggtgatagataggagcttttcctgggaagagcatcagttattaaaataggaaggagggaaatttgtaacaagaaatgaagaggccaaagtgtgatagttgttgattgggctgcatatgctttcaactatgtgatagtccagttacaaggttacttgttgatggtggctccgttgttgcccaaagagccagatccatgattaaacaagaaaaaagccaacgtggtatattaacatccaacagtgaaaaaccaatgtctgttacccaggacaccaaagggaacccttcagtccaaaggggctcttaatttggaagggaataagcagcagtttatgttataatatattataattgcttattttaaagataatttgtcctagtttgtgaaagcctcccccccgcaacaataaattttctatgaattgcacaagtcaacacatagaaaatttggatgcagtgaaaccaaggataagatgatttggtgtttgattggcacttgtctcccatccctcccagcagccgatcctggttatttcatttcattttggaccccacttgtaacatgatgttagaggactgctgtattggttactgtgattattttaaataacttattgtgtattcctcataaaaattattaaagggtgcaaattgcaccctgggggttggtgttcaaatgggagctaaacagcaagaaaaggtagtttaaaatactattcctcataggcagagatacaacacatgtgatccccaaaagtagatatgagcaactgtgttgcatgaaaaccatagataatgaattctcttttttaaacctgaactaagtaatacctggaaagtaagtgaaattcacatgtaaaggaatgtatatttttccagatatgaagctacccatcctttaatatgttcttttccaaaagtatacattgtcctttttactcaaaatgttcaggtaagcccacagttaagactcagacctgagggaagacaacatcagttcatctggggaaaatatagacaaggcctccgctaaagcatccagcatatggcagatgatgtcagccagggatagccacttacaacatttagaattggtgtgattcttatctgagcgtaccctctcctttataactgtattcagatctccacatctgagagactggagggatttgggttttgcatttttggtttcgggatgtgaaagaatgtatatctttctgctgaggagggctgtctgagctctgagtttgtagaaggtgctgcgaggtgggctgcgggagcctcaggattctctacccctcctccagctcctgccctaagagactacagtgtcactttaagggaagtttaccctccctcaacccacttccctacttccaggtcagcccttacctgtcagagcccatcactgcccctcatactctgaaactagtctcacctgagtcggcagctggcttttaattccaattccaaagattttctgtatctttcttatagacctctctgtacttttgtcagttttgggagattttcttgagacagagtcttgctctgttgctcaggctggagtgcggtggtgctgtcatagctcactataacctcgatcatagctcccataaccttgaactcccacgctcaggcagtgcccccacctcagcctcccaagtagctgggaccacagacatgtactacaaggcctggctaatttttcaactgtttatacaaacaggggtctcgctatgtcgtccaggctggtctcgaacttctgggctcaagcaatcctcccacctcagcctcccaaagtgccaggactacaggtgtgaaccactgcgaccagcgttgttttgtcttgaactcacttcctttggttcttaaaaacccttcttcagattctttttgtgttccagctagcccaactccttctcggccttttccctcttctgtaacttacaggtttgggttctacacctcagcattgagcccgtagatactggctcattcttcctgaatggtccttgtactcttctggcttccattcatacctgcacgtgtatgacctccaaatctaaatctctgaaaagttaggtcacccttcctggtgctggactcagtgacccagtgccctccagatgtatcaatctacacacattattaacacacacacacacatcctaagctcggcacttgtgaaaaagatgtctttgtgttcccctgcccacttcctcctctgcctgtgtttctgccttagtaaatggctccaccatccaccagctcacagagccaaaagccgaagtcctccctcttaccagactcatcagtcaccaggcctggtaatttgccaagtctccttgcaggctaccctgcccagcctcacaagaacctcacggtctctggccaggatgcccatggaggcccatcctgcagcttctggtgctctgaggctcccatgcccttcctctgcctttgacagactccttttcctaaatactgtcaacatttctttattttgcttttacttatttatgatctgagaaaaactgttcgcatccagagggcaggctgggcctgcctgtaaccccagcacttgggaggccgaggtgggtgaatcgcttgagcccaggagttcgagaccagcctggtgaaaacctgtctctactaaaaatacaaaaaaattagccaggtgtggtggtgctcgcctatagttctggctactcgggaggctgaggtgggagaatctcctgagcctgggaggtcgaggctgcagtgagccaagatcatgccactgcactccagcttgggcaacagggtgagattctgtctcaaaacataaaccacaaaacaaaacaaaagcagagggcagaaactgtatcttccttccttgtagcctgagaagccatacagtcctcttttcctcactcccactgcgttgtaaaagcaatgactcaggaatgagatcttagcaaaatttaacagtgaggctaaaagacttttcctacaaaacagtatgctaatattagagtacatatcatggactctttttcctcaaattatctgaaaaattatcagacatcagaaaaactgagttgaggccaggcgcggtggctcacacctgtaatcccagcaatttgggaggctgaggcgggtggatcacgaggtcagaagttcaagaccagcctggccaggttggtgaaaccctgtctctgctaaaaatacaaaaaaaaaaaaatagccaggtgtggtggcgggcacctgtagtcctagatacttgggaggctgaggcaggaaaattgcttgaacctgggaggcggaggttgcagtgagccaagattgcaccattgcactccagcctggcaacagagctagactctgtctcaaaaaaaaaaaaaaaaagaaaaaaactgagttgaagttcatattttgttctacgtgtaatttatttacttgtgaaatcttgtactgtcatgaaagacttaggtctaaagctgaatatgctattttgattgattaggtgatatgttgtagaaccgtataatatttatggtttgaagtatagtttatggtatttatttgatcgaatgtgtattaaagtgaaaagtatattgaaatattaatatagttctaaaccagattaagtaaataacgtattgaggtagtgaatctttttccttctatagtttatttgttagatttttgtaaaaccattgttagattttgtaaaaccatttgttagattttgtaaaaccattggcacttttgtgaagtttgggaaataagaattaactacatttttggggttttagaatagagcaggaaaattctggtgttaatgattgcctataacctcaatatagaagaataaggacgtggaattgtaccacatcatcaataaaagttctccttaccctaaaattctgcaggtgggtccatcatcctaatcagtaacacgcaatttcaaaaaatctctgtggtcagtttattatgcttgttaagagtttttcttctaaagtaacatacagaatttggatgatctgagtgagtctgagcagggccccaggtggatttataggtgtttagaataaaaggatgcttttacataaatcagtacaattagttttattattgcaaccttgttttaggcatttatgttagctggtgacaagacgatgaaatcttcagatcctgatgtttcagtgaaccacaaatagaaggaagttgacaactatcacactatggaattgcaacaatttgcagagatgacagaaagggacatctgtttccagtcagtgggcagggagttggtttcccgtaggcagctgcctgcaccttctgtagaaggccaccaagtgctcagaggttatacactcgcattcccggagctcttcggagagcacaaggcaggagggtcagtgacgttctcgcattctttttctggctggccattagaattagtaggccacatctaatacgtccacacaggtccagatatcctacacaggggtgtgggttcccaaagaaggggggatcggtaggccctacacatttgttgctcatctgtttgcatctcaggcaactgtgagctggctgggcttcctgactgtgacagacacaaattctaatccttgtagcctcattcctgcaattgtacccagacccttgcctgctaggaagcccaggagatgccttctcttacagggaaccagtcttggaccctgcgccatgttgatccagaactgatgtggactcttttccgttgattttcaatgtgaagggaaagggacaagtggggttaaatagaaccagacctggccaccctgtttactttagaaagcaaaggaacaacctagaaacacatgtcttagtaggaacacaaattaagaaatagtggccctcctcacaccagaaaaggattgcaattatcatatttagcctaacaataccagtcaagtttccccttcccagatccaccagtgtagccctgccaagagcagcagcaatttacttgccagttcatgaagtctttctaaaattgtattttattaaagtcttttatttcactttcagcgaacatttattatttgcctcctacaagccagcacaccgcaagacatttgggacagaaagggtaagctgcagtccacagctgtagagggccaggctaagtgctaagagcctgaaacgcacaagttgtgaaatccttatctgctttttcctaccacctttttcaacttaagaaaaatgacgctattaatattgatgtccagcaggccaacatttctttttgtaaattgtcaagactgaagttaacagtgaacaagtccagatcccatcctgccatgtagatccagtgtagcctggggataattcaacccttagcctccatttttttttttctgtaaaataggcatgatcataagtccctctgtcccctagaagacatcaaaataataaaaaaaaatggacatgaaagatgtccattattctcataaaagatgctacctagatccagcgtaggaatattttatgatggctttgatcttcatctttctgtagacatggggtttaacaatttaaattctttctggctttgtttttctaagattgccacataggtagattatgtaatcctagcatcttctgtgtggttgttctctggctgcataagacattgcaggaaaatgatagtatagttacagtgtctggtttgttaaatgatggactttcatcattatcaaaggataattcttttccaaatagctgagatggatggggaaaccagtactagccaggaagctacccttcagcctgcttcccccatctgcaaaagaactgaatggatggatgatgtcctacagcacagtccctcctccttccacgttgtctgctgtgcctctcccactcagaacagagtcactaaaggcttaacaagaacaattaatgcagtggtcacagacctgacctcctgtagatatctggattcatttcctagggctgctggtagaaaatgccacagaccgggctgctttaaccatagaaatgattgccttgcatttctggaggctggaagtcaaagatcaaggtgttgacagggttggttccctctcagagcagtgagagaaaatctgttccaggtctctcctaacttctgtttttttggcaatcttctgcattccttggcttatagaagcatcaccctgatttttctttcctcttcacgtgcgggccttcctgtgtctgtgtctgtgtccaaatttgccctttttataaggacatgagtcatactggattagggctcaccctatttacctcatttcaacctaattgtatctgcaatgaccctatttccaaataaggtcatattcagagatactaagggctagggcttcaacatttgattggggggggaatacttaatgtataatgatatttttttcattgaggtatgatatggtttggctgtgtccccacccaaatctcaccttgaattgtagttcccataatccccatgtgtcatgggaggacccggtgggaggtaattgaatcatgggggtaggtttttcccatgctgttctcataatagtgaataagtctcacaatatctgatggttttaaaaagggtagctcccctgcacacactctcttgactgctgccacgtaagacatgcctttgctcctcctttgccttctgccatgattgtgaggctcctcagccatgcgtaactgtgagtccgttaaacctctttttctttatagattaaccagtctcagatacgtctttattagcagcatgagaacagactaatgctaggtgttctgggttccttctgtataaaattctcagtaataactaaccagataaaagactgaattgcctttttcttttttttaataagtgatgtggtacttttattccctgaaaaaaatcctctctcagctgggtttgtgaagtcacagtgactttcaggtgcttactgtttttattcagactaaaaaaattattaggtgggggctgggcgctgtggctcaacgcctgtaatcccagcactttgggaggccaaggcaggcagaccacaaggtcaggagatcgagaccatcctggctaacatggtgaaaccccatctctactaaaaatacaaaaaagtagccgggtgtggtggcaggcgcctgtagtcccagctactcgggaggctgaggcaggagaatggcgtgagctctggaaggcagagcttgcagtgagttgagatcgcgccacttacactccagcctgggcgacagagtgagtctctgtctcaaaaaaaaaaaaaacaaaattgtagatgggtctccttcttgacaggcattgaactagttgctgagaatgtaatgaaatgcttggccattgtcctcaaagaactagtaaagggaacaaacatgtaaaatatgtttcatgtaatgattgaaatatatacacagaacaaaaaaattaacttggctaaagttgtcaatctttttttttttttttgagacggagtttgctcttgttgcccaggcaggagtgcaatggcatgatctcggctcactgcaacctccacctctcaggttcaagcaattctcctgtctcagcctcccaagtagctgggactacaggcgcgccaccatgcctgcctaatttttgtatttttagtagagacgaggtttctccatattggccaggctggtcttaaactcctgacctcaggtgattcacctgcctcggcctcccaaagtgccaggattacaggcatgagccaccgcacccagtcagttctcaattttcatagtaaatttccataattaaattgtcttaaatgtggatctgagtgtatttttatgctgtttaaacccttcaataagcttcagcttgacattatgaaatagtccatgattcctaacaagacttaaagactctccacaatctaacttgtttccatggcaactttcccttgtactctgtgctccaccatggtagctcctggaatgttcctggccctctccagcatctggggccttgcctatacctagagcagggtcgtctatttttcccattccatggcccctcccctgtcaccacatcaactcctacacatctttcaggcatccaggatctttcctgatcactctccactcctcccctacctaccatcaactcccagagcactgactgtaacttttatgccatttatcattcatttaatatatttgttttccaatacatggacggggactctggggagcaggaactgggtctcccttatagtccatggtatctgctgcatggaatactgtgtctggcatgtaataggtgttcaatggctgttttgctaaatgaatgaatgaaacatgcaacagatcatggggatttggggatcatgtccccaaaataagcttaaaatttgaaaataaaaataaatgatttattaccagtcacaaaaaacttaaattttaaattatcgtaggctaggcatagtgattcacgcctgtaatctcagcactttgggaggccaaggctggaggatcatgtgaggccaggagtttgagaccagcctgggcaatatagcaagagcccatctctacagaaattctacaatttttaaaaattttaaattattgcagagctctcggaaatgtttgaaagcatgaacaaatagattgaaaatgacttggtagtgacttctattggtgcccagagagccctgggagggccacaggcagataagcaaggcactttccctgcatcctgctgtgcctcccgctccttctccttgccactctctcctgtgtgattgttttgtgtttgatttgcctcctacccagtcttcattcattcaccttcttccctttcctgtagctcacatgcatggtttgtcctgatacgagcacacaaacactagctggatattgccctccgtgctgcacggcgggtccctgtgccccggagccccactcctcctcggctgctccacacactggaaactgcatctgacagaaagattaaacgtctgcattttatcacctttgttgaacaaaagtccatggcttcttcatttcaggagtgagttcagtgtttggtttttttctttgaaaataaatcaggtttgacttttgggggcccccaaatgattcccaatctcaaaataggctggtagctgcctgtgtcagaattctgagcttttctgggtcataatgccagttagcatttctcaaaccatggcgctgcttttgggccagcagagtccgaaaagaaataataggatgtatgttgtagttagatgagttcatgctgagaaatacgtgtctccacacgcagagatttaaaaggcctgaatattcatacggtcttatcaaagccactcactggttattagttcttcatagcaagtgaaagatatgtaaatcctcagaggttcatggtatatccaggctgaataaatctgaaccttaaaaaagaattggcacattgaatttttcgtagatgttcatccatctctgctgttcactcatataacaaggtgtttctttctcaggctgctgtcctgcctagagtatggcaaaagcccagatgaaattgcgattgctttgtctccaaactgtatttgatttagctttatgttgataccatttatcttcttttgcttcaaacattttacattgccgaagatggctttgaaagcagaacacccacatttggtatcactgcattcatttctcttatgttttggcttcaattcagtgcttttaatattcatgaaggttgaaaaaataaacatcctagactatttcctctgaatggaaatgttatggtttcaaaccctagagaaaacaactggtaagttctacaaacccacatcttctccccgtcagttggaaagtggccccagcttggcagaagtcacagcccccttgacactctggggctttccagagcagatggccagggggcctgtgttagggaagaggagagagtcagcagacatgaatatttaaagactccctttggaatcatagatactagaaccttttcagttgattcagaattatattatttctgtcacgaagaatatagaggaatcatttattccgttgacttctctgtgttcaaatgaacatcattgaaattttttcttagtcctctctccttcatttacattgagcctgtattgattttcatcctctctaaaattagctcagccagtcccttctatatagagaagaattcctatggaatatcagagcagggaatagagagcaagaactccacgcaaattcgaaagccaacctttaaagagaaagaaaatgattactctaaataattaaaagaaaactgatactcagaagtggtgtttcaataatagaacagttgtaggattcctgtgccgtggtaactccgtggattacccatcttgttgactttccgtcactattgtccaagatgacattcccagactcaccagctctcttcttccctcccttgcattcagagggtggtcccatgcctcaggctgatggctgcactgtttcataaatggcagtgaaagttctcccttattcttccacagtacaaggtgagcctccctaatgtgaaaatacgaaatctgaagtgcccccaaatcggaaacgttctgagacctgacaggatgccacgggtgaacagttcgacccctgagctcatgtgctgagtcgcagtcaaaacacagatgcctctctttttcaaaacttctctgtatcatctatcttctctgtcttttttgggaatccctgcaatttttctatgtgcttaaggctaacaacctcttcccgaggttatgttctgcatctctgtggctgactcacaagccgctaacaacctctttcattcctaccacttcccactgaggatgctgaagagacaaatatgggcatccccagcctccatcgtaaatgtgcgtgaccatgtgagccagagtgggctggagagcaccagggaagtcaccggacgtccagcacgcaggcagagctggtgggggctgccttctctcccttccctgaaggcagatgggatgcccgttgccatagtgaccatcctggaacggtgaggctgcaagcaagaggaaaggtggcccacatgagggtggcggtgctaaagcactgaaagtcctgggcacctgagagcaccaagaaggcagatatatccttcagaattacattgggtcacaaatcaaccactgtttgtttgagccactgtttgccgaatttttagttacatacaaacacaacctgatactcccctccatgctacccctgaacaaaatgaagattttcaaaaaaccttgccagcggccgggctcagtggctcatgccagtaatcccagtgctttgggaggccgagatgggaggatcccttgagcccaggagtttgagaccagcctggcaacacagtgagacctcgtctctacaaaaaataaaaaattagatgtggtggcgctgcacctcgacaatggctggagcccatgagtttgaggttgcagtgagctgtgatcatgccagtgcactcaaacctgggcaacagagcgagaccctgtctctaaaaaaaacccaaaatccaaaccttgcctaatcctgtgactacttgtacatttttaattcccctatccccatgggcttttccctaatgtcactgaacttcccgaacgtgaactcccaaaatgctttaaatgactgtgctctgttgctccacggttctctccagcttgtaggtagggcagccccacgtgctcctgtgctgccccacgtgcctttgctccttgcacaacgtggggcttttctctcatgggtcatgagggtctttctagtctctgagacccataggtctttgccagtctgccccttagcctgcctgcagcatttaatgctgttctcctctccctccacgctgacactctcccctcacttctgcactgcacctggaatgatcttttaacaatgtgaatcaaaccatgttccttctctctttcaaaccctttaatgatgtagaattatacttagaacccagatacctgctaacaagtcccagtctggcctggccctgtcctgttagcttccccgtaaagcactatctgcccacctccgcccccatcccccaccccgcccagttcctcctgtgcattaggccttgcactcagggcctttgtgtgggctattgcctctgtgtgcagctccccaaactctcttgccaatttctgcaccttctgggggactcagctcaaatactacctcgtgagggaatccctaagccctctctgcaatggcatcaaaatgctttctttcattgccatttatgacaagaatgttaattgtgttatttgtttcgtgttaacatgtttccccttccccagaatgtaagcatcttcagatgaggaaccttatgtggtttttttttcgtcattgtgtgcccagcaagtggctcagtgtctcacacataacatgggctcaaaagtattttttggttggataacaaatgaaggctcagtgccatctcactgtctgtcagatagaatctcagccacccagctgccatgcatgggccttagggtctggctgcagccgacctgtcacgcctcctccacatcccccacatgggaggaactactcagccttgccgccggtgttcctttcgtcctgctggtcctgcctctccagctccctcctgttgctattttaatatgaaaactgcacccactttgacaagaccagttcatgacacattttggatttgtccccaaccagaagtgacctctgcctcccttgttcttccacagtacagggtgagcctccctaatgtgaaaatccaaaatctgaagtgcccccagatcagaaactttctgagacctgacaggacgccacgggtggacaattccacacctgggctgatgtgctgagtcgcagccaaaacacagatgcatagaacacggttcatttaacgtccctaagggaaaaagaaaatcaccttcaggttatgtctgtgaggtatatatgaaatgtaaatgaatttcgtgtttagacctgggtcctatctccaggatacctcatgatgtatatgcaattattccaaaattcaagaaaatctgagctccaaaatacctctggccccaagcttttcaattaagggatattcaacctgtatattgctttatcttcattatggctcctgtcctatgctaagcagttcgaatgtaagatgccacagaagtgactgtgccccatgggctctggtgtcatcccccacccccctcgactgacgagtgcagaaccttgtttgacaggcatgctggataagcagtgggctgtgatggtgggtgctctgcccgtcgtgaggctgagagcactgaacagtctgcaatacctgaaccaaatggaagtaaattagaaggagcttgagctgggggaagaatcttgaagcccgtggccaacgttgaaaagagccttcatcagagtgtgaagtggcatccaagacagggaaaagccagggccaggtgcggtggctcacacctataatcccagcactttgggaggccgaggcgggcgtttcacctgaagtcaggagttcgagaccagcctggccaacatggagaaacccccgtctctactaaaaatacaaaaattagctgggtgtggtggcgggtgcctgtaatctcagctacttgggaggccgaggcaggagaatcacttgaaccagggaggtgtaggttgcagcaagccgagatcacgccattggactccagcctgggtgacaagagtgaaactccatctcaaaaaaaaaaaaaagaaagaaagaaaggggaaagctggagagttgaggtttggggacctgttataaacttacccacacagtgatggatgctccccgtacagtagaaaaaatgtagcacggaagcacgtcagcttagctggctgagcagatgttgtgctgaatgtggatctcagaggggaacagaaaggaaaaaggcctctggtgtggtcctcagaaaacagcacctacctccagtctcttgggattagccagagaagaaacgccagggagcattttgcttggggattccttggtgtctgttttgtcgcagcttcccgcaagaaagaacccttttcatcacttgagtaaccattgccccctccccacaaaggaaaataaacaggaaaatttccctctggggtggctctcgagcatcagctgtagctgctgtagcaaaagatcaaacccaaatacttgcaccttgtggtcattggcatcaaaggctgcaggttttctttccacctaattttaatatgcttgtgagccttgggaggcttaattaaaactgcaggggagccaaagtaagcacacaaaggaactgttttgatgcttcaaaaacccaagcaaacagaatctggattattcaattaggtatgcttatgggatttgtcctgggtgttttgattgctcaaagcctgctggggaagtcagttatgaggtttagacctgaaaggaaccatagttaatgccccccaaatttcacttttcatcttcttagttaggcttcccgttaccagtgcattgttgtgagctgtgcatgaacttttctttttttttgagacggagtctcactctgtcacccaggctggggtgcagtggcgtgatctcggctcactgcaacctccgcctcccaggttcaagtgattctcccacctcagcctccccagtagctgggagtacaggtgcatgccaccacacctcgctaatttttgtatattttggtagggacagggctttgccatgttggccaggctggtctcaaactcctgatctcaggtgatccgtccaccttggcctcccaaagtaatccccaaagggattacaggcatgagccactgcacctgccctgtgtgtggatttttattccaacttctgtttcctcagctgcttcttctacagatgccagataacatggcagggccagctcagtttcccatcttaattttctgcctcgcttggcggggatgttcttggattcccttcctattttccctgatggttttggctatgcaggatagcctggcagttctgagcacaggatctctaagctagaccgcttctgtctgcttggccccagacatatcacctaatctctttatgcctcttaataccatctgcaaaatgaaattcaagatcacagggtttcctctgttaattcagtttcttttttttctttttaaattcatgttaaagtgcttagcacaatgcctggctcaggatgagtgttgagtaaatgacagcagtgatcgtgattacactaggacgtaggtaggtgcctatcagtcaggtgtagccagtggttatgggaagactgggagggtgcacacctaggccttcccaagggcatgggggtagacccagcttcagtgctgcactcaagcccagtctaaggcagcctcaaaggccacgtgacagatactcacacaagctgaagttggtggagtgtctgtccacgggactggcttacccagagtacatttcaagtgacaaggactcttgcagtgagcttggctgcagctaatttgtcattacatcatgaaactctccctctgaaaatggaactcagagtccaattcacagaggaatttattgccaagatcacagccacagcaagacctggaggcaggcagctctgtctcttggggctgagtcagtctgggctgatggtgagtaccatgcaggcccctcctagaatgtatgcttgtagctaaccagctccaaataaactcatatgcaaaggcctaggaggaaaactacccaaaagaaaaggtttacctgatgctaacttaagaatccaaatgaaaatacttagtgtcagttgctaacagtttatgaagtggtgttacctgtgctgggccttaacttcttttccagatgtttctaccccaacaaagcagcctgtataggatttctagtatgtacgggtaggctgtgtagaaaacagcttccctttcattgtctctagtgaatccattaggtaagtgtctgcctgtgacagagcagccactgagaatacagggatgtagagaacgtgtacctcacactaggaggctgtcagtctagtgacgaagtgagtacacataggcatggcattgagctgatacagatcgcaaggcacagtggcaggaacacgctctgcagggtctgcagccttgattccaatggtggcttttacctccggtcagcagtgtgaccttaggaagattatttgacatttctgaacaaaccatcctcatctaccaaatgaaggataacgctcttgtggtaaggccaccatatgtattaaatgaagggaaggccagtgaccagcacagtgcctgacaaatggtcatcatacaacaaatggtggctctagaactgttaccatcatagaggaacacgggagggagcagaccattctacctggagaagctcaggcagtgttctttcagctgtgtcttgaaggaggaagaggaattctaaaggccagaacagtggtggaggggcactgccagctgagtgaagacgggaaaagacaaagaaaaaaaacaacgttgaggatttgaagaaattcatacagttcggtgtggctgaagtgcaggctgctggtgactaagggccaggagctgggtcctgaatgaaggggcaagaccaggagtggactcagataccattctggagagttcgatttgccaactttagcaagaatgtgccaaaaatcccagctactgttactaagtgctaaggatgctactaagctaagctatatatatatgtaaaacattggatgtccagcaaacaccctacaaagatgacactctgttttacaaatgagtaaactcaggcttatggaaattaagttacttaatcattaaactcaccctattaaattatggtggatttgggcagctgcctccctgaaggacatgttgtctcagttgatatttcatgtaaattctgttgtcttgtttttcggattcataatcactcattgtttttctaccttggtacagcaagcaaataaactctccaccattgtcagacttgaatgagtttagtcaacttcccctgctgggcagttgattagatagaaggagaagtggctcactattatagtgtaattttctgatacaaagattcatttttacttggtgtcagtccatttgcattgctgtaaaggaatacctgaggctgggtagtttataaagaaaagaggtattttggctcacagttgtgcactctgaacaagaagcatggtaccagcatctgctcctggtgagggcctcagaaagcttccagtaatggttgaaggcaaagcgggagctggtatatcacatgcaagggagagaacaaggggtaggggaagcatcacactcctttaagcaacgagatctcctgcaaactccttaccatggagagggcaccaagccattagtgagggatctgcccccatggtccaaacacctcccatgagaccccaccttcaacgtgggggatcacatctcaacatgagatatggtggaggcaaacatccaaactatatcactccccaaataaatcaagcattatattaaaaactgcacactatattttaatttttcatgatagatattaggcttgagttgcaggtaatatgagacctttggtggaggttaagcctaaggatttcataaaattttgaatgttaccataaacaagattcaaactaactttagatgaatcatcctcagtcaaaagatgggaaagtaggtgttagcatcagccttagaaatggggtatgtcattcatcaagtacccagagtcctataatctgaattcctgctgtcactcccacccttcaaagtacccaactcacattgatttgggatgagttctaaacaggtgtttcctctgtgttgcaaatggtttgaactggagccttgcatacctctggcatgttcatccagacccagctgatgctcatgagcatgtatgctcatctgacggccagtccttgctgattcccacgttggtcagcactggacacagaacagatgttggggattatagggaaggattcgggaggccatgggcctgagtgtctgcggaagtcattcattgtggagacgcagacaggccctgcagagtcttcagtgagaagtttgattaaataagcctcaatgggcctgcgtatcaggacgcaaaacaaatgttttccaggtatcccttaattgaaagaaaaataataaatcatcatcttcaagtcaggctaaatgaggaagggaaataatcccaatcccacaagttttcatctgacttctaatctaggagttcattagtgggatcatggcacgtaagcatccgagtagaatcctctgattaattaattccatgaggaatcatcggaagacagtttgcagagcagagggaggctgactgcccccgtgggaaaactcttttaaggttgggcccaattttccccaatatgacacaggactctttcttcctggtctgttctggttgtcctggagtttctttgtcaagctgctccactgatggtattgtctacacctcagctacctgtccaagacactctcagaggtctgaggcgtggaactctgtgggctatgaaagggttttactttttgctgaaccacccacctacagccctccgcttattgaagcagcagaaagctcaccagaggtggcttcttgtttccttcagtgtttccaagttactctgtagacttagtgaacctaagctttgcactcctcatagctgtgtatgagtctttttctgcgataagcatagaaatgtttcatctcaggagaaagcaagttggtaataaggaaaacaaagcaactgacaatagttgattaatattttttaaagaagaggggataaaggacacatacaactgtatgtcattgacattaaatgccatacaaaaacgcaagtaaaactataagggaaaacaaaatgtacccttgtagtaaatattctgtgaaccaaaatctcaagtgcagtcatagaagtcattcactcaacttttgtggcattttattttttttgctttgtctttctattctttctttctttctttttttttttttttttgaacagcccaatgtaactccattggttgtgtttggaaaaatgaaagaaaaggctaattattgtcctttgcttttcttgctctgaaaacagcttccattctccacaattaatggagaaatataagaagacagttctatataagcaaaagaaatacctcggggcctttaacaattaaaaggaacaaagacaggcgggagcggtggctcacacctgtaatcccagcactttgggaggctgaggctggcggatcacgaggtcaggaaatcaagaccatcctggttaacacggtgaaaccctgtctctactaaaaatacaaaaaattagccaggcatggtggcaggcgcctgtagtcctagctacttgggaggctgaggcaggagaatggcatgaacccgggaggcggagcttgtagtgagccgagatggcaacactgcactccagcctgggggacagagcgagactccgtctcaaaaaaaaaaaaaaaaaaaaaaagaccaaagacataggaaaggaggtctagatgatttttatgaagagtatatatcaaatattatttatatattaatccagctttaagatgggaaaatgctataaacgtgggaagttctccatagaagaatcagtcaaaagtattcctgtttgctcatgtctaagaattctgaaactagggaaactgtattgaaaagataaattgaaatatattggaacgggaaatgtagctaaagtgtttccattagggtacaatgagaaaaactggatctgttttatgtaaattttcaacagtgacctggttaaaaaaaaaaaaaaagttgaagtacattaattaaatttacagagccagaaaaggtgaagacccaggaggttaaacatagaaaatacagatggactgaaagagatgagaggaaacggacagacttttacagcatgatattcagcttggaaatatgcgggagaatacgacagggaataccagccaaaagtcagatagctagtttaaagaaaaagttaataaaacgttgaagtctgaaaaactgtacagaccaaagccaggaaattacaaagttatggatcccgcagtaactgtaaattaaccccattgcacatatgtagtatttcacattaccgtctgtggtgttaactttcatgcctaaacatgcatgtgtgtgtgtgtttcacctgaattatggttgtaaagggaacaaaggtgctaacaggacacggaatggatcgccagctcctttcatgggtctcccaggagcctctaggcccaagctgctcatccaccatggaatagagcaagcagggagacatgctttgattcaaagagtgttctccagaggggctaggaagagacacctgtttcttgacaattattaaggaagtcgtgagtgtcgtgggtagatggaaggatgtctgcaacacgttccagagacaatgcattggatttccatcatcccttctcctttcctttttttttttttgaaatgaagtctcactctatcccccaggctggagtgcaaaagcttgatcttggcttactgcaacctctgcctgcctggttcaagcgattctcttgcctcagcctccctagtagctgggattgcaggcacgcaccaccacgcccggctaattgttgtatttttagtagagatggggtttcgccatgttggccaagctggtcttgaactcctgacctcaggtgatccatccgccttggcctcccaaagtgctgggattataggcatgagccaccacgccaggccttctcctttcctttgattgcctcatgggaactactctctctttcaccagcgtgctccttttacccccattttttgcctccataccacagtttgtcctctacatacccctttgtcttggagggctcgttccaggtgctaagaggcagtgctttccttttagagcttccaatctatggatctggttatttgtttgcccgttttggttgatttttgtaaacattttttagtcaacttacatggtgtgctttccaacacatctctcacttcaggcacaggaccaggacggaggagtccgcagcctccctgaatcattgctcaggcctctcttctggttcatgtgtctgcttctagcgtcttccaccttttctcatcacagcaatgcggtggtttgccactcttcttcctgactttcgccatattggggatgtttgtgccaatgtggagactcctctgttaccatgtcttcatactcttttgacttccctggctcctgggaggtccatgtccacaattcattcccatcccttggcagggctggccctccacaacctggaatctgtgtcatcctcaagatcttagcatccgattccccgactcacagccatccctggttcggctgcctcctgccaccatccccactgaaactgctctgaactttcactgccattgccaacctctctgccttgcagttgacgtccactcctaccagttctcccaggcttcgcctttcttcttccagtggggctccaaaaccacttgtgtaggtgggacatttcttcttgtccttaactcccctgcccttcttggttctgggtttctgccctgtcgtccccaccatctgcttgactccgtgcactcaggctgctccacgtttggcgaaacgtgaaaggatgtggatcctgccctcagtcctcgggagcgtgaagggctgtggctcctgccctcagtcctcgagtggcgctggcagttgggctctcctttgctgacttcccgtgcctgtcacagcagcttccaggggctggactcctctgctcttcatgccgaacttgactccgccttctgctcaccacagagagtgaggccccttcccggtggctcttcagcgtcctcctcgccaccctggaagcctcttcccagagtcctctgctgatgctgatgcctcccatctccgagttaagacctggccttggccttcagagctgccgctttcaactccattcctgaagctgttcctctcctcaccccagggcctccctgcaccactttccctcttgaggttttacatttcaagaccttctccctcctgcccgcttcctgctgccttcccgtcctctgggcaggccccaccggcctttcctccacactgactcatgcatattaccgcccccggttcccctccctcactgtcctcccagaatttccttcaccttcacagcacaggtcccactgacgaggacttcatggagggctggctgttcttcttcctccacctcctagcatagctgtcacccaggttctggtcacaagcctttgcccaccgtgtgctcctttcctctgtgatcacatgcatctccatgggttcacccctcagcaggtgcaggcggccctccccacagaggactagcctggcctctgagagaggctgagagcttgggctctagggccttgttggatgctggctctgccacgatcctggccaagctccgtgacccatcgtgcctgagtgacctcacctgtgagaggagaatcaacagcaacgtgggttgtcaggagggtgagctgagctgattcacagagagggctgggcacgtgccatggtgtgcggtagcagagtccacgtggctctttcctcactgtcacagccgcccttctccggccacatggatccatctttgtggagcactccacacccacaattcctcagcctctctccagatcgagaactttctgactcctccaggaagggagatccacggagcctcagagccgctagttccacctcccccgagtactgctcctgcttccctgggggacacttccccctcccatctggctcttgcttgacttgtcccctccactacttcaggggcctcctcctatgcctcccagatcctgtctgcccttcagttgctctcatagctgctgccttggtgactgttccctgtttgaaacgatcccatggctttctgttgtgtcctgaaggaaatctgagctcctcagttcagcagccctctttcctcacaggcttccctcccctccatgcatggcctaaacccaagcacactgttctcctgcaggaagcacctctgtaggaggcagcgtgtctggccgtcttctggctgcaatgctcttcttacctgcgctgaaatggatcctcaatgaaccccacacaggcgtctcttccagaacccgtgtgactctgctctgccctagaagtatctcctcacccgtcccatcctgaccaattgctgcttgaggacaaccactgtccctcttgttccccatatagtcctggcagcagcacacactgaatccaactgtggtgacttcatgcctgtgtccattctttaaaccagcatctcaggcctcacaccaagcaccagggcagagagtggaatgtatcaaaattgtggcaaattttgcaccaagagacaaaagtccaggaattaaataagtggcctattcaaatattaacatgccatttgcttcatatctttttgaaaataaataaaatgctgaccacattatatgagtctccttcgttgtcctcccagtctcactccccttgagatagaaatgctctcgttactttactgttgactgttttcatgcatgtattctgcgtgcataaacctatagaaaatattaacaatacacagtgctaatcatgcagggttttgaaactttaaatagattgtattatatgtactcttcctcaacactgggtttaaaaaaaaacaactgtttttgaagtttatcatagtgatataattgtagcacattccttttaatgctgttttccattatataaatttgccaaattttttttattctcccattgataaacatttgagtttcctttttttccctacagttgccagaaatgccatagtgaacactcctgaacatatctatttgtggacatgaatgaatttcccaagagggcataatctggaatgaaatgcacattgcaaatttctcagtctgtggcttttctctaactttttttatggtgtcttttagtacaaaagttttccattgttaatgtaggcaagcttatcgattttctttttttttgagatgaagtctcgctcttgtaccctaggctggagtgcagtggcatgatcttggctcactgccacatctgcctcccgggctcaagcgattctcctgcctcaacctctcgagtagctgggattacaggtgcgtaccaccacacccagctaattttttgtgttttaagtacagatggggtttcaccatgttggccaggctggtctcaaatccctgtcctcgggtgatccacgcacctcggcctcccgaagtgctgggattacaggcgtgagccaccgtgcccagccaacttatcgattttctttcatggtttctgctgtttgtatgttctctaaaaactaatcaaggtcataaagatgttctcctatgttttcttctaaaaatgttgaatgcttttcactgtgagctctgtgctctacctggaagtaacatctgcctgtggtacaaagtaggtcctgatgttttccatttggacgagtagtattgcctttttgccagaactccctcccctgtccatggacagggcatttgctagatttcaagcattgtccagtgaggtttttcatgtccccgctgagagtcttgggcattgcacagaagggaggggtctgagctggagcccttgtgctgctctgtgtgctccattagaggaacgagagcatgcgcctccagggtttgaacctagggagcatctgagatggtccagagtgggccatctggagaggcatcctctctccagagattctcagaacaataataatacctccaggatagttcagccgttgcaagcttgaaatccctggagaactgctatgctgtcaactggaggcttcctctcctcactcaaattacttcccttttataaaaatgattctagtcatgcacgatgtaacaacgtttcagtcaacagcagaccacacatatgaccaggatggtcccctaagatgataatgccatatttgtactgtaccttttatatgttcagatgcatagatacttagcattgtgttacagttgcctacaaaattcagtacaggaacatgctgtacagcttgtagtctacaagcaatgggctataaaagatagcctaggtgtctagtgtgcaatcccatctaggtttgtgtcagtacactccaggatgctcccacaacaacgcactcacctaactatgcatttcccaaaatgtgtctctattgttaagcaatatgcatctgtattttgtaacctgtcgatctctgcctgtatgatttgaaaacgaatgttattttcgcttcatagatcccaactttaatgggacttgtactactaaggaatagtgaggaaccgtgaaatccaatcaaacctggctgcctgtgtagactcccagccttctattcatggataagctgcatgttgcttattaactgagcaccaagatgtagcagctttgctttattgcgtaatgatgcatgactgcttgctcagttagcacaactgctgtgtgctggaggaatagagaaatcctgtggaaacagtccagttattacgtttattgttttaaactgttacattttaagcaaaatagaaaaagacaagggtcagaaatatagtaaaataattaatttatgtatggtaaagtcagactaggattactgggctaaaaattgaagctggactatacaaatttaaaggcttgcagttgattaaaatgaaagttatttaaatgctagcaaatcatgatatagaaaatattagtaaatgatgaagtattcagtaaagccattgtctgttaggcatataggcctgtaagagctgggcgggtggctcacgcccataatcccagcactttgggaggctgaggtgggcggatcacctgaggtcaggagtttgagaccagccaggccaacatggtgaaaccccgtctctactaaaaatacaaaacatagccagatgtggtggcatatgcctgtaatcccagctacttgggaagccgaggcaggagaatcacttgaagccgggaggcagaagttgcagtgagccgagactgcaccactgcactccagcctgggcaacattcgtctcaaaaaaaaagaaaagaatacaggcctgtagaaggattgcttaagcccaggagttctgtagtgtgtcataccagtagggaatctgcactaatttggcatcaatatggtgacctcctgggagcaggggaccaccaggttgcctaaggagtgatgaacaagcccaggtcagaaacaggtcaggtcaaaactactgtgctgatcagtagtggactcacaacggtgaatagccactgccctccagcctgggcagcataatgtgagtgtatttatcgctaataaaaaaattatttaaaaaatatgtatctctgacaccatgggacaggcactgactcttgaattggagagacctggattcaaatcctgaggtagtctcttactgtatgaccttggactgtccattcaactcctgaactttatttcctttatctgtaaaatgggaataattagtatctcccctacaagggtttttgaaataatgtatataggcatacccaggaaagaagggtttgatagaagagaggggagcctgaaaccaagacctgcctctcacttatgcctgaggccagtgtgtcattgatgaaaacaggaaatactagggacggggtgggaggaagtgagggttggttttaggcaaaacatatacatatttatgatttgggataaccttgttggaagtcggaatgattgcagggtgtgctggtgaatctgcctgtgcccccagcagtgtgtatgtatgtgtgtgaatcgttagcctgcaatgtgcacctcattctgtcaaatgcgtggctacttattgatgaggtctgggggagtgtgctttcttcatctttgtgtctctcagaagtaaccaaataagttctcaaaaactgctggcagaaggaaggcacgttaatggtggatgtaacattattcatttcatgaaagaaagaaatcaacattaaaattagaaagcattgttttaatttctgaattgggtacttggaatggacattcttcacaattttcactgggttatcataaaatctttattaattcaagtcttttctcccccaagaacatttttctattaaaaaataacaaccaccaccatgaactttggtgtggaggggcagtgaaaagagtaatagtgagagggagagagagaaagaagaatccctgtgggggtgcaacaagctgctgctaaatttcagttgcagttgtcagagttaaagaaaacattggagaaaatgtctcatcaaggggtccccggatttttctgctccgggaaggctgcctgagggatggatcgcggccagctggcaggggctcagacgcctggtaccgtgctgcagccactgagctcattggctccacctaagtcattttacagtcagagctgtttcaagatcagcacacggcactgtacagatgtttggggtcggggaggagtagaatttgtggaaggaagaagtatatgcttagttttaaaggtttcattctaggacctctcagggttctggtgaaatggatcatgtgagagtgggagcacagctgaccaggctaggcaggacagccctgtgaggcagtcttgattttacagaggaggaaaatgaggcacggagaggttaattaaccttttgagtgtcgcagtctaaggctcagaggcacagttccatcccaggtctgtctgaatcccgagtcctcactcccgattcaccaccttactccactgctgagaccatccctgtgagtccggccactcagtgagttaaggaggccaatggccatgtccccacggggacatctctctcctcctgagagtctctctcatacatctcaaatctgagatacagattgagaaacaccccaggaaatccactgcatggaaggcaaaacaaccttgagccacagcagtgaccacaagcaagagaagcctggctatgagcacagtcatgatgtagttcaaggttggggaattcaaggcctccatgtccatcccaacatcttcagctcctcctcacgtcgccagtggatgtcctctgcaagctgatataaattattttcaaacccagatatacattcctgacttaattccactctcctcaaactcgcccacggaatgcctctaacagaggggagcgagggcacaccctgggaggcccgagtatgtatcctgtggcattacatctcaaaaatgatatttactcaaagatgctagttttaggtaaaaataaattattcaaatgtattgtgaaaatgttattggttttttgtttgtttgttttgtttttttgagacagagtcttactctgttgcccaggctggagggcagtggcacgatcttggctcactgcaatctctgcctcctgggttggagcaattctcctgcctcagcctcccaagtagctgggattacagccatgcaccaccacgcctggccagtttttgtatttttagtagagacggggtttcgccatgcttgccaggctggtcttgaacttctggcctcaggtgatccacccacctcggcctcctagagtgctgggattacaggcgtgagccaccgcccccggccatgttattggttttaatatgaaaggatctgttttccaaatctttgggtgagattgaagatccaggaggatatatcttgttgatcatatggcttgacataagtacccacgcagtactctgatttaggatccaggggtcttccaggtcgaattagcattttcaggggtattctgaatgcccaaaggagtgactgacagggacttttcggtaaaatgaaatatctcatattcagggtatgttcgtgcatgtactctttctgttatgtgatttccattgtctacatcttcattaattctaagtaggaaaatagaggctggggaccatgtccttcctggcatcactcttgtcaggccctgtgggtgactgcttgcctttagcactggtgaggcccgctgtggggtgggagaagtctttaccgtcatcagtgacaatgactagagtcttcagtgtatgattcctgccatctgggagtctccataaaagcctcaaggccaagagggtctccaggacttccagctcagaagtcccctttcattcagtgataaggagaagataaagataaacatgtggcctgggcagtttcactctgtgtgatggaggcagcttcactccttccccatccctgtggaagcagctgaggctctggagcacaacttgggctgagaatcaccctcttcttcctggggccgtgactcaagcagacaccgtggtcagccttttgatgtgcagctacgtggacaacacttttcctgagcaatcatcccctcttttctcatctgtttgggcacagaattattggtgaacatccttcatcatcaaagagcgacatctgagtgcgtcttcagtggtgttctctggagataagagcagataagagaacatcatgcttgccactgcctgatgaggggacgttcacctgcacctattaattaaaatagaagacacccaatgggcattgggcaccaggggctgatgtttgtattggaatataaaaaagagacttagacttagctttctcttggcaccagcatcactattaacacttactgtctgtcaccaatcagcaacctattcccagtataatctgggacttctatagcacagctcaacccttccacctctctgagaggagtggtggggtagcccttctcctgacagcaggagcagatcgtactccctgggacccagttccccctcaaaactcattcaggaatcatcacacatcatcgctggccacatctaggatgtctgaataattgtggttataatcgatagtgtaaaaaatcattagttataggtaacatgtatggcatttaccatgtgccaagcaccttttatagtactttacacttagtaattcacttaagcctcacagtagccctacaaggtatattttcctcattttacagaggacaaaactgagccacagtagttaagtaacgagtcaatggcagagctgggattggagccccggcagcctgctcatgcttgctatggactgaatgtgtcttgcttcaaatcccagagttgcagccctaacctccaatgtgatggctgcatcatggggccttgagcagataactagggttagctgtggtcaggagggtggagctcttgtgttgggattagtgcccttctaagggacagcagagagcttgatcacactctctattcatacacaaaaaggagcacatagtgagatgggaggtctctgcaagccaggaagaggtgcttgccagaacccaagcatgctggctccctgatcacagacttccaacctccaggactgcaagcagatacatatctgtggtttaagtcacccggtctatggtgttttgttgtggcagcccaaggggacgcagatgatgcttttcaagactgtgcagcccctcctggaagcttcagctccttggccttgcaagaaacacttgctggtcactgtctttggtcctttcagaggcccttcctcagcggtgcctccaccaggctcctgacttcatccccctctgtgggaggaggggtgagcaaagtaccttctccctctgctgtgggaagcatgagtaactcgcagatggtgtcagagggcgtgtgttcaggtagtgcagccagcagtgagtgaatgaaatgaaatggtgtctgtctgttccaaggctgggctctgcaggggcaggagaacagctttagtctctgcatccctgcaccttccacctgcagatgccagcgggccattgcaggtgggaggggacccatctcagggctcctcattcagatggtgacaaggtgaggtggccgtccaccctatctttatcagtatctgtcctaaatactgcgcgttgacattgacgctaatagtctgaattatcaggggtttggcaatcgttaggcatccaatttttctctcctggacgggcatacctttgctatgtcagcacagtgcctctcttggctttctatgtaaccacaggaagattgcaatctagaaatagtgattgttaaaattgcctataagtacacaatataaacaatatgccagagacacacaggcccccagcataattcctggaagctgcagtctcacctctgccagagaagagccccagcaaggattgaggctgggcatccaggtgcctctgcagcccttcccgtggctccagctggacaattgcccctgagacacagaagatagagactgcacgtgtgtcttcagtgaacgttgctttatttatgttgttgttaaaagtgaaagagagtacaaactgccttttttttctgagacagggtctcgctctgtcacccaggctggagtgcagtggcaagatcatagttcactgccgcctccgcctcccagaatcaagcaattctcctgcctcagccccccagatagctgagactataggcacacaccaccacgcctggctaatttttgtacttttagtagggacagggtttcaccatgttggccaggctgatctcgaactcttgacctcaggtgatccacctgcctctgcctcccaaagtgcagggattacaggtgtgagccaccgctcccagcccagactgcttatttttaaaccacacagtactcgttttaaacctgtcccatttttaccttggaaataaaagtcgcgtatctcaggggcgatatactgtttctctgcctggtttcccacgtcacgacctgtggagaatggcctaggaaccacctgtctttacatccagataacagcttcaggaagatacagcagagtaggacaggggtcgttctgggtgatgtaaagtagctatttggttagaccaacattttggtctctaaaattgggtcctaaggagaaaaataggaaattaaaatgatcactacctgaaaaagaaaaatcaggtaataatttgagggagtcaagggcctcacctttctctcaaataagtaggcaaagaacagtaacagcactccccctcctcacaccctgtttaggaaaattgggaaatgtcttcttctcactgcctgcctgtttatttaacaatgaacaagagtttaaatgttaccaccaattcaaaccaaacacaccccattctctatgtcctgaatggagagggagtctagagttcttgtttgcttcagggtttcctttctggagctttatttatttattttttattttgtttaactagtcaagggcaagggcagtagtgagaagtggggaaagagaagaaggggcagttggatctgtacctgactgtgaataaacagtggaggtaactcgctgcctccagaccagcctcctctgtagagcttgtaaccttgggccatcctgcaaatcagtggagagcagttgcttcggtcctgaatagctcacagggtggtgggaaggtttgccagagttgtcccacctcatgcacactccctttcccccatgagccactggagtggaaacagacaccataccaagtgctgctgaggatgtggagcaaccggaatgcgcctgcacttgctttattcagacagccactttggagatctctttggctgtgtctaataaagctaatcacactcttcctgtatgatagagcaaccccactcccaggtgttgacccaaaagaactggaaacatatgtccacacgcaaaaaaagacttgtagaagcttgtaaatagcagccttattcttaataataggcccaaactggaaataacccaaacatccatcaacaagagaccggataaacaaattgtgatctattcgtgcaatggaatacgattccaaaactaaaaagaatgaattacagatatgtgcaacagcatggatccatctcagagacatcatgttgagtgaaagaagccagattcaacagaactgtactctgtcatttcattcatatgaagtttgagaacaggcaaaacttagctatagtgatagcaggcagggcaggaactgcctattgagggtggagattgaatgaaaaaggcacgggagggctttctgggataatggaaatgttctatattttgttttgggtggtaggtagacaggtgtagacagttgtgttaatggctgaagatctgtgcattttagcatatttaaattataacccccaggaagcattgcctcatcttcctgggggatgtatatgcttgttaagagcatactgggggtgcttttgagaaccccttaccatgttattatgttaatgaaccaccactaatttttgtggtttcaaaatagcaaggttcattgataaaactcccttgtgccttggtgacaaaaaacactgataccgcccactgtcaaagtaagtgtgtttgttatttttgtttttaatgacactaaatttgtaggaatgatatttttaggtggttgctcaatctcacccgccatcagttgcaggtgacagggatgttaagttggcagatttttgtgctagaagctgtgggtttacatctcctttgtgcaggtgtcctagacataccagtggcttgttatttaaacatcgggatcgggtgtgtgggtggtttttaagttatagtagggatgcaggtgctgtgggatcgcttcattgtttaacaattcctttgcattcacacagggcttctgaaatgagtgctagtagaatcatcttcagaggatgtcccaatacgttgaactgagatgccttcctgtttgctgtggaattaagcttaaaattgacaccaagctctaggcatttcgtacagggagagagtgggcatgaatgatttcgggaaatgaagaactagatttcagcctggaatttgcttcctccctcctgtggcaaattagcgtgggctcactaagcacttcatctggccatggtattttctttttcttcttttttttttttgctcccagatagggtcactctgtcacctaaactggagtgcagtggcacaatcatagctcacttcaaccttgaactcttgagcccaagcgatccccccaccttagcctcccaaatttctgggactacaagcgcactaccacacccagctatttttattttttgtagaaacagggtctcacgatgtcctggctgatctcaaactcctgacctcaaaccgtccttcacctcagcatcccaaagcgctggaatgacacgcgtgagccaccacgcctagccagttttcttttctgttgcattgcagagttagggccaatttcattcatcctgcactgatatttgccttcccagcagatgatgggtgagctcagcacacctgcacctcagccaagcctttagaggggagcacagctctttattgtgtcagcgccacacagccaccctgagcaaataggtttggaatgtacattgccatccttcctaaaaaggttcatagtaaaaagagaaggagatttaccttttgacatgcacgctcatgaaaaccaaggttttcagaaagccaaacctcaaaaacaatacaaagaagctcccttgacgtttgaatggaaagaaattttaggaggcaacactgaggggcaaggagggctgagaagagaaggtggcaatggcaactgcaagggttcttccaaatccgattgtcctgacaggttttgttttattttgttgttgtgttgtcgatgctgggtgggaatggattggaaaaattgtcccctcctgtgtttcttttcgtcttttaactttacaagtgctcctcattttcttttacttacaatttgaagttggcactggtgttgctgggccaaccagcatcttgaggactcaactctctggctgcaggtgctgtggggaaggggcagacttaaattttcttctgtaaaatggggacgggggggattaaataaaatgctttatgggaagttctggcacagagtgacgcacgaagaaatttgagcttccttctcctcacaggtgaactgttgctgctccacctttattacatcttttcaaatccacgccacattggggaacacaaactgaccttatgtagccctggttactccagcctttttaaaaaaaaaaaaaaaaaaaaaaaagcaagggaaataggcaagacggccaaataggaacagctccagtctgtagctcccagggagatcaaggcagacagcgagtgatttctgcatttccagctgaggaacctggttcatctcactgggactggttagatagtgggtgcagcccacggagggcaagccgaagcagggtggggcgttgcctcacccgggaagcacaggggattgaggaactccctcccctagccgagggaagccgtgagggactgtgctgtaaggaaccatgcattccgtcccagatactatgcttttcccatggtcttcgcaaactgcagaccaggagattccctccggtgcctacatcaccagggccctgggtttcaagcacaaaactgcatggctgtttcagcagacaccgagctagctgcaggagtttttttttttcataccccagtggcacctggaatgccagcaagacagaaccgttcacttccctggaaagggggctgaagccagggagccaagtagtctagctcagtggatcccaccccgacggagcccaacaagctaagatccactggcttgaaattcttgctgacagcacagctgtctgaagttgacctgggacactcgagcttggttaggggaggtgcgtccaccattactaaggcttgagtaggtggttttcccctcacagtgtaaacaaagccaccaggaagtttgaactgggtggagcccactgcagctctgcaaagccacagtagccagactgcctctctagattccccctctctgggcagggcatctctgaaagaaaggcagcagccccagtcagggtcttatagataaaactcccatctccctgggacagagcacctgggggaaggggcagctgtgagcacagcttcagcagacttaaacgttcttgcctgccggctctgaacagagcagcggacctcccagcagagcactagagctctgctaagggacagactgcctcctcaagtggattcctgacccctatgcctcctgactgggagacaccacctctcaacaggggttgacagacacctcatacaagagagctctgactggcatctggcgggtgcccctctgggatgaagcttctggaggaaggaacaggcagcaattcttgctgttttgcagcctctgctgttgatacccagacaaacacctccagcaaactccagcagacctgcagcagagggacctgactgttagaaggaaaactaacaaacagaaaggaatttcatcaacatcaacaaaaaggatgtccactcaaaaaccccatctgaaggtcaccaacatcaaagaccaaaggtagataaatccacaaagatgaggaaaaaacagcacaaaaaggctgaaaatttcaaaaacgagaatgcctcttctcctccaaaggatcaccattcctcaccagcaagggaacaaaattggatagagaatgagtttgacgaatggacagaagtaggtttcagaaggtgggtaataacaaactcctctgagctaaaggagcatgttctaatccaatgcaaggaagctaagaaccttgaaaaaaggttataggaattggtaactggaataaccagtttggagaacaacataaagcaggaaagatccaaaattgacacccaaacatcacaataaaagattacattaaaagatctagagaagcaagagcaaacaaattcaaatactaggagaagacaagaaataagtaagatcagagcagaactgaaggaaatggagacatgaaaaacccttcaaaaaaatcagttaatccaggagctggttttttgaaaagataaacaaaataaatagactgctagccagactattaaagaagaaaagagagaagaatcaaatagacacaatgaaaaatgatcaaggggatatcaccactgatcccatagaaatacaaactaccgtcagagaatactataaacacctctatgcaaataaactagaaaatctagaagaaatggataaattcctggacacatacaccctcccaagactaaactgggaagaagtcaaatccctgaataggccaataacaagttctgaaattgaggcaatagttaatagcctaccacccaaaaaatgcccaggaccagacggattcacagctgaattccaccagaggtacacagaggagctggtaccattccttctggaactattccaaacaatagaaaaagagggacgcctccctaaatcattttatgaggccagcatcatcctgataccaaaacctggcagagacacaacaaaacaaaaaatttcaggccaatatccctgatgaacatcagtgtgaaaatcctcagtaaaatactggcaaaccgaatccagcagcgcatcaaaaaacttatctattaccatcaagtcagcttcatccctggatgcaaggctggttcaacatacgcaaatcaatgaacataatccatcacataactagaaccaatgacaaaaactacatgagtatctcactagatgcagaaaaggccttcaataaaattcaacacctcttcttgctaaaaactctcaataaactaggtattgatggaacgtatctcaataagagctatttatgacagtcccacagccaatatcatactgaatgggcaaaagctggaagcattccctttgaaaacaggcacaagacaaggatgccctctctcaccactcctatttgacgtagtattggaagttctggccagggcaatcaggcaagagaaagaaataaagggtattcaaataggaagagaagaagtcagattgtctctgtttgcacatgacatgattgtatatttagaaaaccccatcatctcagcccaaaatctccttaagctgataagcaacttcagcaaagtctcaggatacaaaatcaatgtgcaaaaatcacaagcattcctatacacccataacagacaaacagagaaccaaatcataagcgaacttccattcacaattgctacaaagagaataaaatacctgggaatacaacttacaagggacgtgaaggacctcttcaagaagaactacaaaccactgctcaaggaaaaaagagaggacacaaacaaatggaaaaacattccatgctcatggataggaagaatcaatatcatgaaaatggccatactgccaaagtaatttatagattcaatgctctccccatcaagctaccattgactttcttcacagaattagaaaaaaactactttaaatttcatatggaatcaaaaaagagcccatatagccaagacaatcctaagcaaaaagaacaaagctggaggcatcacactacctgacttcaaactatattacaaggctacagtaaccaaaacagcatggtactgataccaaaacagatgtgtagactgatggaacagaacagaggcctcagaaataattccacacatctacaactgtctggtctttgacaaacctgacaaaagcaagtaatgtggaaaggagtccctatttaataaatggtgttgggaaaactggctagccatatgcagaaaactgaaactggaccccttcctcacaccttatacaaaaaattaacttaagatggattaaagacttaaacataagacctaaaatcataaaaaccctagaagaaaacctaggcaatgccattcaagcatagacatgggtaaagactttatgactaaaacaccaaaagcaatggcaacaaaagccaaaattgacaaatggatctaattaaactaaagagcatcagcaaaagaaactatcatcagagtgaacaggcgacctacagaatgggagagaatgtttgcaatctatccatctgacaaaggaccaatatccagtatctacaaggaacttaaacaaatttacaaggaaaaaacaaccccatcaaaaagtggctgaaggatatgaacaaacatttctcaaaagaagacatttatgcggccaacaaacgtatgaaacaaagtttctcatcatcactggtcattagagaaatgcaagtcaaaaccaccatgagataccatttgacgccagttagaattgtgattattaaaaagtcaggaaacaaaagatgctggagaggatgtggagaaataggaacgcttttacactgttggtgggagtgtaaatgagttcagccattgtgaaagacagtgtggtgattcctcagggatctagaaccagaaataccatgtgacccagcaattccattcctgggtatatacccaaaggattataaatcattctactataaagacacatgtacacgcttgtttattgcagcactcttcacaatagcaaagacttggaaccaacccaaatgcccatcaatgatagactggataaagaaaatgtggcacatataaaccatggaatactatgcagccataaaaaaggatgagttcatgtcctttgcagggacatggttgaagctggaaaccatcattctcaggaatgatggttagttagcaaactaacacaggaatagaaaaccaaacactgcatgttctcactcatgagtgagagttgaacaatgagaacacatggacacagggaggggaacatcacacaccaggacctgttgtggggtggggggctaggggaaggatagcattaggagaaatacctaatgctaggtatttctaatgtaggtgatgggttgatgggtgcagcaaaccaccatggcacgtgtatacctatataacaaacctgcatatgttctgcacatgtatcccagaacttaaggtataatttaaaaaaaaaaaaattaaccttttctagtttgtcaccacattcgtggacagctagtcctggggcactggggtgcatatgattagtggcatggctgaagctaatgcattcacaaatcctgatccgcaggtgcatgggtgtcccttgttaatgcgcctagtctgacccagggcagtgctgcacagctcattggctttacagtcagacaaacctccaatcctgtgtctggctctcaccagcttgtgtcctaatgaatcaataattctacccacctgacgctcactttcctgtaatttactgcagtgagttcctaggcatatggcatgtaaatggtcagtagatcaccttagaaggatttcagactctgggtctcagtccatctgtgaaaattaggatggtaggaacctctctgagatacacctttaaaattagttatgtgtgtcacattcacagctcctagttttgaagaccagcaacagaacaatactttcaagtcttcatataacctttattaatttaggacaggcttcatattttcaacaagagaattcaaagttcattttccttttttccctcagcaactaaagttctgagtttcataatctgtttcttattgatacataatattttacatatttacagggtacatttgagttacaatctattttaaatgatacattatgtaaagtcactgtgttcttaaataaatacacatagtgaatgatcctgcatgtatccccacaagtacagcttgaacaagtccatcttccaggggccaagcaccacctcaggcatctgtagcatgagcaaaacccaaggtcccctctggagaccctgtttaccctgcaggcaggacaacaggagctggaaggagcaggctgatccaatccctttcttgtggttttcttggttggggagagagagttgagttttgccaaaatacatgtgttctgtagaagaaacaggaaatggagatacacaaagagatatgacaatacaaatcaccagttgggccacccagatcctggtttccatataccgttccatgcattgttcctgagcatgtaagcatgcccacacttgaaggaggcactctcaagtccatcggggcctgggacaccccactgtttttgaagtcctggaatgtttttgtaaaggtaaggaaataccaaaacgagactacaaaaatgatggtatctactgatatgtattgacaaatgtgtaataaagatgtgtacgtgtgggtgtacctcatctaggggtgacaccttcaagtttaattttgaagcttgggccagtggtgcttcctttcccacaaccaccatgatagatcctctatgagatgttatcacagaacccatgtttctcagtggcagtagaatacgacatctctgtcaacaaatataattctacattactttaattgcttgcatggaaatccgttgtatgtaagtgccatggtacatttaatagatcttgtcctgggacatctacttctggtttctttgatagactagcactcttgtgaatatcattgtacttgcttctttgcatgttttcttccttccttaggatgaattctgagagatgtaattgatggggcaaaatgtactcacacatttttaagggttgtaaactttttggtcaaaagctggtactcttggttgtttgaaaaggaaagcaagtcctcccattccagggttggattttgactcttttcctgtaaacttcactgctttttggtttaattgtcataaaatgccaagcaccaccaacagggctatgggaaggggcccagaggcaggagggctgtggttaggcatggctttggccagatggggaagctgggtgcttgggatcagggtaagcgggtggggatgctgtgagtatagacgctaggcagggaagccctgcagggcagagggagcggcagggctgcagtgcatttggccgtccagctggagcagaggatggaaaccgaagagtgggttgactcttggatgccaggcttgagtcaggtgaatcctgccctcattttactgtataaagggagctactccaggcctccaggagtcttagaccctcccagtccctgtgggggtcccacaggtggttaattgtgcctcaggccctctgctctccctccctctgtaagtctcactctcctttgcagtgagctctagcgaaacttctattccagtaggaccaaatgtttgaggcctccagaaaagaaatccggtgaacacggagggtttgtcacactaacttgagtccctttctcaggtggcccacccttgtaggccagcctcccaattcctagccagctccaggctccgggcttttgctcattcaaaaccaaaattgaaggcatctgccctgctcaggcccccatctctgttcagagtaaactcctccctccctctgcttttgccctaagttctcttttcaactcacctaacatctaacttggccctgcagctctgatccccaaaaccctctctacctgttccctcccaagctatccctgaccagcatgccaggaacaaggaagtcttgaaagctgcactccttgctgctctcccctgtcctttatccttccacttggaatctctgtccttctacccatctctagctactgaaatcgtgttcatgtttccaggcacatctcatactctgtcgtctttaagaagtcttcccagaaaccccatcgtttatattcgtgatatataccatattccactgtgtaatgtagattgcaccagagagtatttaatctcctgaaggcaaggactataacctattcatcttcctttcctgggtggggagaaccaccatgccttgtaccaagtagcgatgacatgggtcctggctccatgaatgaacgggcattgagagaaaaggagctgatgatgagtgaatggaggagcctagtgaggcaacgtttactcctcagtgaagcagtgttggtgactccaacagctctctttaggaaggatttaagacaacatcctgttcggaaggggcttgaagcactttataaaagagaggcaagggcacacgtcaaactagaagaatgaaagtaagaagagagaaggctgcagagaggagcaagccccatccgtccccctgatggtcctgccagtgcatgggttacctctcattgcatttagtgcggtctgttgtttttgtattgtgaaatattatccttgattacattatgttgctctgtttttgaaagagaaagtattcaagcaagtgtcacttctatttcttgcaggcaactatggtcctgagctccgcacacttctggttgggattatttctggttcctactgcctgtttgattgaagatgtggcatggagagcgtaagtttaacagtgaagcggggaccctaagtctggctcatctgtccctggaattgtctttctcatgagtcctgctacagggtatgagaatgacaggaattcggaagaaatgggtctcctgccacctgccagaaatgaaaaaaaaatttttttagtttaacttgtgcttcatcttgatatgaaaatatagacaaccataacaatagaaaaatcagctgggcatggcagcgcatagctctagtctcagctacttaggaggccaaggtgggaagatcactcgagcccaggtgtttgaggctgtagtgagctatggtcgtgccactatactccagcctgggccaacagagcaagaccctgtctttaaataaaaagaaacaaaaagaaaagaaaaaatacagacacaaaggagccctgagagaaactatgaagatcaataggaatgttgccttatataaaggcagagtttctgagtacacacccattccatcaaattgagaaagtataactcaaaactcatctctctttatatcataaactcagtgctaagtggtcacggatatggcctggcttcacttcccatgcttagagggaagctatgtataggtaagtcatttaaaattacaagaatgaagtactcttcatttttccaaacaactcatagtaggaatactttcagtaaaattcttctagaggattagttcacaggtctgtgagaaaaccagtcatgaagatggcattatcatgtaggttaaataggaaatcattcatattaaattttgcttttatgttttaacatatattgttttcaagataccttgttacaatataaaagaagcgactaagttccaaggtcatgtaaattttaattttatccatgagcaaaaggagggctgctccaagtaaaataggactgatttttgttttgggtcgacccaatttctcctacaaataggtgccaacttctctgaaaattgagactccgagctcggctttactttgggcaaaacacaattattttggggctctgagatagagaagtgagactttaatccaaaccttccagggaaagacatcagatttcatttttagccctccgttcctcccacactcagaatttttcttgcctgacagttatggaagtcttttgaaaaagtcctcattttggcattatcttgacaaccgatgatacctcatgcaaatctagatagagggggaaagaatattataacatggattttctttttttttcctgttcactaagttttttaactgttaaaaaattaaataattctcatttcttaaattctttgatttaccattacttccattttatttggtaaaaccatattctgcaaataacagaatcagaatcctcagaaatgaaaagattacagccagaaaaaaatattttcttaatctaatagatgtaccataagaacatagtagttttggccaggcgcagtggctcacgcctgtaatctcaacactttgggaggccgaggtgggtggatcacaaggtcaagcagtcaagaccatcctggccaacattgagaaactccgtctctactataaatacaaaaattagctgggcgtggtggcgggcacctgtagtcccagctacttgggaggctgaggcaggagaatcgcttgaacctgggaggcagaggttgcagtgagctgagatcgtgccactgcactccagcctgggcgacagagcgagactccgtctcaaaaaaaaaaaaaaaaagaaaagaaaagaaaaagaaaaagaaaagaaagaaaatattagttctgttatttgctctttcagccaataggcccaattgtgacacaatctagtcccttgctgaatttgttcaaaatctttgttttgcaaagataagtcagttttagataaataggccacatcagctggccttttctatttatagtgattgaaaactagtaacatgattataaattagtttattttaattcagctatctcaaattagtgtcattaaaacaattctattgagactgtatatttgcagaagactttagcaatagtctcttccatctgaaagagaatgtttatagattacaaagtgtctgtgcttctttgtccattttctggctcttttccagtgcgttctgagtaatcattccctgtcatcacaaagcaaattatctattccctcaaacaggacttgtttttggtttcccctggcactataaaattagcaccatttacattttaacaaggataaatcaaatgacactactcccagcttcaccacatggaaagagtaaaagtcacttcctttccaaggagcttgccaactgggtcagagcataaacccgggctctgcagtggaggtgcccgcagggcaagcaaggaaggctaagggtcgtcactctgcagcaggagcactcggccacccagcacctggcaccacgggcccagaactcagcttttccggggagccaacagcatctcagctctgggctgagccagaaaggcccctgctgaattccagaggtgctttctaaaatggatttttgtcttgttttatttaggggagcagggaaaatagcatatattggctgtgagctggaatatttgtccgaagcacatatatgctcaatttgtaatatctatttaatatctaaactaccctcacccctctcctcaaaaacaagacatttttcagtttattggtgcattttccctttgatcgtgaggcccatattatgtctcatattatgctccaaacccgaagtatttgtttttgaggcaagtaaattcggaggcttctcacaaaaagagaatgcctattgtgaatcagttacctctgagaagctacagtgcttcactgagatttctctttctgaactgcagctttagaaaacgctgttggcttcttcttcccatgcactgaacaaaaatattaatcctgcttgtcccgaaccacccatccttggatttgagttgtcaagtatctactgaggcacgatatctgtgatgcaccttggggttcccagaaagggtgtgtatttgagagtgggcacaggggcagctgaagaccctaccctgtgatggcagcatgtggtgatgccgggagagcttccacaggggtgctgcgggcctctcatcttgccttgggcccatcttaaggatgttttattttgttctgaactttggtggttatcactctcttttgaaagggcttttagaccaggcacagtggctcacacctgtaatcccagcactttgggaggccgaggtgggcggatcatctggggtcaggagttcaagatcagcccggccaacatggtgaaaccctgtctctacaaaaatacaaaaattagttgggcatgatggcgagtgcctgtaatcccagctactcaggaggctgaggtgggagaatggcttgaacccaggaggcagaggttgcagtgagccgagatcgcaccaattgcactccagcctgggcgacagagtgagactccatctcaaagaaaaaaaggcttttaaattccagattaaggcaggcctgccttttcaagtatatttctgtgagcactgaagaaagtgagttgctccatctttctacattttccccatttctttgcccagtttctcgcttccatttcaggacctgagctgttaagagtaagaaaagagaaccagaatgaggtaattcaatcactttttccatgaagtctgtcagctttctggatgaagatccattattagactatcttaagtcagatttggcacgccataaaatgcctacgctattatcctgctaaccaaaattttcatatgggacaaaactaagctaccttttattaaaataattgattgattatatgtgatacctggctaatgagtaattttgttagatgcatgaagtttaaattgcccagaactattttaatatccctgcgcttatattcatccaaaatgtttactgatgacagcatgcttaggtaagctgccacatacccactttcatctaggtgaaatttgttagtattgctttataaaaataatacaagctcaaggccactgaacacagaggaacccatttgcttttatctagctgtatctcctgtattttactgtacatcaacaatacagtccccgattccagaatgacttcatttccttattataatcccagataggcagttaaatggaaagaagaggtaatgagcaatttctatacacaaatgggccttgatttcttttaactttctaactaaactaatttcttttgcagcacgttacatttacacttccatccaggtttagaattatatgtttccttttgacttgctgttcttgcatacaaaagaagagtccagggaaagagtttcagaaaaaaaaaaaaaaaaggatggaaagttcaagatccttaaacagtctatttcttttaaaagtctctgagaacctggagacacccttaggtatatctgaagacccacagacaactttcacactcttgagtcagtagccagcaccccaactctgtcccttctgtggtcatccagcctctcgatgtggggttagatgaagcaagccctggaccactgggcaataagccatttacagataagggacttactctgtcaaagctatgactcagaacacgccaaacgccagctcctggtaagacctaagtgacatgccagtggctaatgcttaacaactgactttataacctataaatattaattttagaccactcacatgtagcctttagacaggggagattttagaatcagtttttctaattcaggcgttattagataaaggtgcttgggaacagggttttaaattgccagcctccctttactcaggtgctgttaaatgcatgcagaaagagaagttgaatcatccccagcattgcaattcagtgttttccaatagcaacaaagttcccaggctagctcacaggggctaaactagtggaaatagtatcaaattgctgagtaactcttgaatatgggcgcagtttcatcccctgagagcacgcacaatgcctgggagcactgacatgctcagaccattgccctctgaggccatgttgtgattgagtaaaaaccagcagcttccacagtgggttggattctgacctaagctgtaggttcccagtggccaaccttcctattccagcctcccacttaggaaccccctttcctcccagcctgggaaataacaatggggtctgttctacccctgtgcaggggaaaggggagagggagagagagggagggtgatggtggagagagggatcctggaagaaccagcgatgctgctcatccttcaggagtagccaggctgttctaggacccatgcaagcccatggctcagggcaggcggggcaggcactcggtggctttgttgtcagtctaaccccagaagcccaggagataaaagaccacttttggggccccacatgttacataataatgaacggggtacattttaacatcgtttttgactctcctttccagcaaactgttagatatttgctcatttcttgtttaaattaaaattccacaggctctgctttgaactgcagtattttatcaatcctgagtctcaggacactgtttgatggaattaagtaaggtattatgtgttaaagcctgtgtggctttcccttgtttactttgggggaaaggatgacaggggcatatacagtgtctcagtgctaatactccattatagattaactcggagtgtcgggagatggctcacattatcttaacaggctttctttccttgaaggtggagggtgggtgaggtggtacaggattctgcaggaagagcccacatcttcagaatgttcccatgacaccgttttcatttctgggcaaaggtgctcagtttttgttctcattctgtctttgggtcctggtacatagcaggatcctcacatgtatttatatttaaattaaaccgatgcaaagcttttcagtctggtgtgttactaatttttgagccttttccctttgcagtttttttctcttatataacctatatctggttaaatgtcttttcacctagactgtttccaactagtagctagattgtttccaactggtagctcacttttagcttagtttagttttcattttataaagactctgagattggccaattatttgagcattgtgaggtattcatcttagtgtcctcagtaaaagggtagagggaactcttcctaccattcaagaagagtgagctgtccaggctgcgggttatttcataagttgtattaatgtcactgaggcctgcgtgtgtggactccaatggtgagttgttgccagaggaagatgggaaacctgcactctggatttgtgttgactccacgtttcaagcctctggttttgcatccagaccatgcactctagcatcctaagccccgtggctgctgtggcagtggctcttttcacgctaaagagggagggaggaaacttgctaacccctgggctctctgactgcagttggggtccttggaccagggaaccagtgcctgttcactaaggtgagggtttaaagtgtcttcttggttttcagttcctgacaagaaatgctgtagaggtagaccctgggtcttcgtgaaccccacccagtctttgagtgactgggctgctcggccgacttccggttctttgcggggtgggggtgactcttgacatgcatgatccgggtctggtctgcagcactcaggatacttccgggctgtggagatggaacctgggtcatgcatggagactgtgaaagctccaccacttcccgagcctcggcctccaccaaagggcatttggctgtggcctgagaggggagcggcctgtctttcccagctgtgtcaagtctctatgccatgttcgttttgtcttttcctcataacacagagccaagcacacctgcaaaaagacattgctggaggaggtgcaggagctggaaaccaagtctcgagtcctgggaaaagcggtgctgcgggatagcaatggaaagaggtggggaactccgtcccagtccgcacagaacacaggtgctcccggcccttttcccttattccttcctgtatttctttttctcatcttggttttcgatgggagcacagtatgctcaggcttaagaattttggttattctcagatttaaatcacactctcagtgactacatgaaacctaaatctctggaagtctccaggtaagactgggggttttattgggtttagaagtgagcaaaacaactcatgtgcagaaaatcgatgttgtggcagtattatcttaaggtggaagagtccagagttagcagtattaccacagaggagttaaagctaggcctttgaatttcaaacccaagtactgtacccaaggatgagtatctacagtgtgaaggtttgcatgtgaaataatgcatgttgttattcatgtaaacctgttacattccacttcagcatatctaaatgggggagtagtttttaatgctaacattttctgctgggagtgaaaggaatcgtgtgaactcctggaacagacactgccgcttgctctcctaattcctcctgaacatgagcctgcccttccccacaaggaacagctgggtctgtgtgcagtttttgtttcatcacacaagatgttaaaatgttgttagagtgcactctgttaaaatctatgtaccatcaagggaaatttctttgggcctgagaacaatttgcagggtactagaaagccattgctctattaaggacatggaatatctataatattctgagtacagctctcctataaatgcttagaaggaaatcagtaaccaactgctaatgaaacaaacatcaagaaatcaaatacttatagaggtccccactttgtgttttgctttatattgtgtttatttgtaccatcttttaaagcaatgaagacaaaataatttttttgttaaagaaagagaatgcaaacattttgagaggctttcaaaatacaatttcaaacagattttagaaaagggatgatggcatagagttgaagttgtggttttgtatttatttatgagttattttttagtaagtttattaagcattcattttatagcagctatgctagccactgtaaaaaatcatcagtcaacaagacaaaaagcactgtcttccataagcttaagtttgtgaatacatggggatgggggctgattttaccgcagatgtacatataaccactacgcgtggttgaggcttgttcagggctgttctatccatcagacagctgaggcataaggctcaggacctgttagagtttcagggacctaccgtgctctttgagacctgaaaaaaaacatattcataagctccaaaaattagggagcaggaaacattgcataatgaaattaataaatgtttaaaaccctataaaatgcatatcactcttaaccgttaagtttagtaaggacaataagtttattatacttagaaacaacttacaggctcccttatatatcaagtatacacaatgattgctgagggggcataagtaatttctaagtaaaatgagaatttcagagcaaaactctcaaactcctctcaaacattttacaggacgacatcacatataatgtggtgtgagaatgtgctttagagtgtttgttctgatgtggggaggggtcatctggcttgagcaatcaagaaaggcttcatgttggagatggatgaacaacaggcttttgaggatgggagggtcttgaatggacagaactgctgagagtctgatttgggcagagggagtggcacatgccaaggctcaggtccaacactgtgtgcagggaccaaccacccagtttggagggccacatgcattttgcagagatacagaacctgcgtttgaattctggctttgctacctaccggtgaggccttgtgcaggatatttcatatgatcagattgtctcttcatctgtcatagaagaaggctaatattttctttgggggattaaggttcgtgaaatatgtacaacgcagcatattgcctgacccatctcaggtgtgtaaaaggtcagctgctcatcttcactttggcaggagagtcatgagctgtcggccttgaattgtattgaaggaagtcgtgggctgtcagccttgaaagagtgtgtgagcccatttttgcttgttgttgataaatgaatgttatttttaaaattcacttatcctgttcaaaattcatttttaaatgttcaaatggatatcagaaaataagagcttaaatgcggtttcctaccgtctacatttgaaagtcttattttctggttccttgtaaatttcactttgtagttcatatgatggggtgtgtgtgtgtgtttctgtgcacgtgtgcgcgcacacatgcacgggtgggcctgcatactcccgtttggttgcaccattttccttttcttctagtcccagcatcttgcttcactttggaattcctagccagaacacagtttgggggctctgccgctcatcctcctcagtgaccccctcccatttgtttttctcactcctaattactcacagattttctgggtggtccatctgcaaactggataatggtggcgtgctgctctctgcacagagtctatgctgtcctgcttggcctcctaagctgcctcacaattgttctcttacaacctttgttttcttctttcacacctgcttagattcctgaggggtggagggtagagactaagaagtctgtcttcagctctgtcctcccttctaaagatcttatagacccccacctctttgaggggtcctgagtgtttttgtctcttctcacccctccctgttccttctttcctaccctcatctgatctttcagctgatttgtgtatctctctagctgttaaccgcacaggaaactctgtcaatatttgctggctgactgactggcaataccaaagtctagtgaggtggtagtgaggaaaggacggtgacttcagtgccagatgagctgacacactggtgcctgtgtgtcagctcgtgtgtcggatgtgcacaaagtggccacagagagatgctgacagtcaccgggcctccagggagggggcagtttatctcattgcttgagagtacagctaacatagactcacacatggagaggcatctgtgatgtaagattagcaaatcttacccttgcaaagatgcacaggccaggagcccatcctccctgaaacccactccctctcctgccttcctgtgccagccaagccagggcacccccaggggtcctcagcatccctaaccccaggggcttactcagctcagtcctgacagcattgcttagggccccttaaaggacattctgccaggtcataaaacccaggtccaagtcactggcaaatattctagcagtttttcttaggaatgtaaccacaggaagtagaacaaaaaaaatctgtatgcattaatctttttagaaaaccctcttgtaccaaatttacaattacaattttgaaatggtagccagggattctaagtttctctctgtgccttttattcattcaataaaatattttcatccaacattttattgaacttgtctaagcctcatacttttatactattttgataaagttaaattttcatgaacatgcttctgcactttctcattagtagatcttgtcttccaaaatcaacctgtggaattgatactttaataagcctgttctcatgaagaagcagataatgagaaagggtgagatcagggaattagatatccagaaagcacagtgaagaaagtgctttagggagtgaataaaatgtttgtcttgattttagtttgttcttcttgaaggagtgtttttcacgatgtggtgtttgtgcgccttatagacactggacacgtgtgactgttggggttgatcagaataccttttcccaaactgtcttcccagtaatccctacctggggaagcaggaacccccccgcaccgcacatgaaatagtctaccctgcatgtcgttattttgagtgtctaaacaatgaggagctaaatggaagaaaattctttgttttttaatgtcttggtaatatctttcctttctttattcctgaagtgtaagccatgcaaatttctttcctggtgaaagaaaatctatctgtggccactcacttttacagatacaatataaaccgatgacggcgtgtaagatgacagacttttgttccttaattttttttggaatgagataagtggttgccctgtaatattttaggtacaatggcaagcaagaaaaaaaagggggaatatatttgttgaaaacatctagtttttgagttatgcatagcctgaataaacaaggagagcttgttctatttctagatcacctttcactctgttcatcccagttggtgggagtggggtggggtggggtgagcccagggctgatattctccattgtcaagggtaaacagacccggttgctgcccctgcctttgccaggaaggcagtggattatcttccccttaagtgctttccctgggtgtagcttacgctgtgactttggtgaaggtagctgtgtggctggtcttaaaccttctggcgagccgtcgcctcgtctcccttcggttttgtgttctgtgaacatctgtgcgtggccctgtgacccggggtaatctggacggcccatcaccgccagggaattcaggagggaaacctgactcttgctctgcggcttccatttcatccaggctgcctctaaacaggcagggccctggtcacagccttggacaggtggcctgggatcctaatggagctctctctgccgaaaaataggaacagagcctgaaccacagcagcaagatttcagacaaaccaaagattgttcctccactccaggcagtgctctcgagtgctcctttgaaaaccagtcgtattaaaaaaatgaaacaacacaaactcccgaatgcattctgagtgagtactcaactcaaaaatacctgtcatgctttgatctttaacggaaatcctttgatctttaaaacagtgttgaaaaaactgtttagtatcatcacacctctaagtcaaaatcagtcccactgccaggctgagcatgtcgctgagccagcctgaggcaggagggatgcaggccttttgcaccggactccaacaatgactgcgtcacttcaggaaatcggttttttcacagtactggccgttggcagtgcacatgtggtgcatctcccttttgcttttgtcccacctctcccacactttcctcctaaaatacctattattggctttttttccagccaaaaggataggaaattagggcatcctttcagcaaacctctccaggccaggtggcaaatgtctgcttccagcacctggttgagatttattttccttccagctgcattttttttcctcagctctgtcatgaagcagagaagcgagtgcagacggcggagacagatgacctgagctgggctctagcttagctgtgtggccttggctgggttattaacttctctgaacttcagttttctcatcatacattcgctttgaggtttaaataaataatgcagattaaatctatagcctatgtagatgttcaggaagcgtcccctaactgaaaagctgcataacaagtacatttcactggccgtgtttaccatctaacatgtaagcctggggaagatgtgaatgcagcaggctctccgagttgcatcgtcggggtgtgccccctagtctgaggtaaaagggagaaatctaacagaatcccagggacatgggagtggtgtggacgaatggccgtagtgaatgttggatgggggtgtggtggggactgtagtgagttctgaatcttggtggtctcctcaagacagcctttggattacagcttcaaggagctcctctttgtgaagaggacagtgtacccagtccaggctgtcccttctgccccaggatctctcgccagcttacccctgtccatctgagctgcagtctgtctgtaacgtctatgccggtccttgccactcctccccagaaccagcccttccttcggagtctcctgctccatcgggatgaatttttcccacactgcagactcgctctcagtgtccacactgtcccctcatgtcctgcgcatccctgggtgccaggtctcggcgtcttcccagcatctgcacagtcatcccccctggtcccttggggtggtgcctgtccctcttcacccaccatcccacagctgaagacatcctttgtgaagcacagcctcatcatgccaccttctgccctcagcccaccacctgctgagccagtgcagaccagaaccacagtgatttccgcctctgcttctcttctcacgtgtgcgaccctcagcttccacctcccctgtcctccccacgctgtgcccttctgtggttggtgctacccttggctcttcttgattgactggttttatacgatggtgttgcactgtgtcccaagcactgggccacacgtgggctactcaggggcagcaggacaggccttgtcctgggaacaaatgccgtccacctcaggacacactctctgatgtcaccaacttccctgctgtgctgatggcagcctgagcttcccttaaaacactcattttaaaagttttattttcgaccggttgcggtggctcacgcctgtaatcccagcactttgggaggccaaggcgggcaggtcacgaggtcaggagatggagaccatccatcctggctaacacagtgaaatcccgtctctactaaaaatacaaaaaaaaaaattagccgggtgtggtggcgggcacctgtagtcccagctactcaggaggctgaggcaggagaatggcgtgaacccgagaggcggagcttgcggtgagccgagatcgcgccactgcactccagcctgggggacagagtgagactccatctcgaaaaaaaaaaaagaagttttattttcattattcaaatattcaagcatacatagtagtagggagatgagcacaataagctcttatgaaatcattgcccaggtccaatcattatcaagattcggccagaactgcttcatctcaccccttctgctcagagtctttctttcctgaaacataaagcaaatcccaggcatcacgacagtccacctatgctttaggaggcatctctaaatattccacgagactttataacatctgtgatacacagcatgcttgtttatgttattaaatgtagaactccagtccccatgatcacatctaacaagttaataataattccttggtatcagtcaaacaacccgtccataaaaagactctctggatgcctcagccctgccttttaggattgattgatttgtgttaggatctgggcaaggttcacacatagcatttggtttctgtgttcctcaagttcctctgaatctggagaactttctcttgtttttttgttttgttttgttttgtttttaagatacagagtcccattatgttgcccaagctgggcttgacttctgggctcactccatcttcctgcctcagcctcccaagtagctgggattacagggatgtgccgccatgctgagacctgtcttcctggtttttaatgccatggacttattcattatgctccactttatttttttatcataacactgatccccacatgcagcaaatgaaagtttcctcatgtgcagaaaaggcgatgaggcctcagagagatggagtcacgtctgctcagtgtcacccaactaaagagaggcaaacctgcatcttcttacttcaggcctctttccaccaagccaagatgtggagagccacccaaatgcttgcatttgcaattacatctttattagagagactggaaagccacggagcccccagagagaccaggaggggtgcttaccttctagcatggtctgatgaaaagggtcacagtctgctgtctggtgaagctgcgtgcaaaatccaaggaagctagagaattgtagttgcatgttgttgtcttttagatccctacatgtaggaagaacttggaccaagcagagaaatcataccctccccccaagaaatgctgaagccaaaccagcggacaaattcagagcaaataaagggaaaagagtgtgtgaaagcggctcattttgtttgtttgtttgtttgttttttgagacagaatcttgctctatcgcccaggctggagtgcagtggtgcgacctcagctcgctgcaacctctgcctcccaggttcaagcaattctctgcctcagcctcctgagtagctgggattacaggcacccgccaccatgcccagctaatttttgtatttttagtagagacggggtttcaccatcttggccaggctggtcttgaactcctgaccttgtgatccacccccacccccaccccccttccctgccctcggcctcctaaagtgctaggattacaggcatgaaccaccgtgcccagccgcagctcacattttgatatggctcaggaaagagaagccttgctaaagaagccaatttccacccacagtcaccttcgtggagcctagtatggtctatgaaaaaattaattgaatgcgtttaatcttgtagagcaaagaaccttgggcaaagcctaatgccggcaaacattttagttgagacaatggggagagttcttaggagaacagctggagagccaacgacgctcccaggcaaggccagttaaagctctcgccttgctgacaaatactcgcgacaggtgaggaaatgcattagtggaacaaagggagtgaatgtggcaggaaattaccgaaaggctgcccgcatgacccagccgggcttctggtgactgtttgcatcctgggcacaggaaggagaggaggaggaaaataaactcttcaggaagtgaaacacctcattagcatttagttaatgcctaagctgcctgtgtcaactaaaaataattgattctctgttattttaggaatgttgaattccaagagcctgttgttgttgttgttgttgttattgttcttatggaccgatgtttaataattagaaaatttttaaattaaataccagatgtcatttattattaagcatcttgttcacctttaaaacggtgctgtggctgtatcagaaatctaatcaggagcttagctacttgcccagtgctgcgatgaagaagtgcagcatctttagaaaatgcctggagagaaaatgggaagaagtgtcctcttgatggagggaggtaagtgtggagagaccatcagtgttagcggtttgctagtaacacggcctcaggctgtatttccaggatgacttgagtacatttccttttttgaattatgacttaaattagttccatgtcaactttctctatttgccaacaagactttttttcaagaaccatttttactgatgaatttattctcagttccaaacaaaactagtgtggacagctagctcactgtatccctttttaagtagtgatgaaatattttaatctttttggggaggatagttttatttaacccacttgagcagcaatagaaacatttaaaggtagatttgccaaaaaaaaattgccattgtataggtcacataatttgaatagtgatattatacattccaggcggggattagttcttcaggaggttctgggatctctttgctaatcgcttttctcctgcgttatcagtgagttgtttgcttttcccttcggcttcccgttttgcctacctccaactgtgactgatctctgagagtaagacattccagcctgaaaacaaacaggcaggtacacccatcctaaaattgagttacaatttagatgttatctgggaataaccggattctactgttcatttctcaatgagcctctccctaaattcttacaaaggcgtagagaagaagtgtagactcccaggccccccagcattcagggttaaagtgactttgtagtgcatctgagagaactgctggatccctgggacgtcctggactgttacaggcaaaaagaagactcaggagaggccgggcgcggtggctcacgcctgtaatcccagcattttgggaggctgaggcgggcggatcacgaggtcaggaattcgagaccatcctggcaaacacgttaaaacccgtctctactaaaaatacaaaaaattagccgggcttggtggcgggcgcctgtagtcccagctacttgagaggctgaggcaggagaatgacgtgaacccgggaggcggagcttggagtgagccgagatcgcgccactgcactccagcctgggcgacagagcgagactacggctcaaaaaaaaaagcctcaggagaaatgctggatgttttttattcatatttgatggctgcttttgcacactacagcacagagcatgtcctcccaggcccctgacgtggtctctgtcactagactagtgactagtctctgtcactagtggtctctgtcaccatttatgtatacactagttctgtaaagccagcacttggaaagccagtcaaggtccagttaggtcacgggtgaatgacatcattggccttgtggttgagaggaacttggagaatatgtaaaagttatcaccaagagatggtcattgtagcaggaatcactgcatttagcaatagatttattggatttttggaaacatttctctattaacaggaacagaaaaaaaaattattcttgggtttaaaaaaacctggcatggatctcatgctggtgtatctaagagtaaattcttctgtagaccaggacacgtgaatgactgtcacagagcctggattgttagtgattcagtgagtcccagttaagtcttccttttctaatagggcagtgataatatgattattcagtgtttattctctttctctggcaattaggattggctcaaggccccttaggtggtggtaattgggacttcacagttactaatgagtaaacatgttggcctcatagcaaatagaaccagtgattggcctaatgtggggcgagtcatttatgtatccacgcaacagacatttattaaaaacggaggaagtgccaggccagactccggcctagaatgagagagggaattcctattgctttagagctcgcctggtagtgggagacagtgagtggtggctcctgggaggaaaatgaaccagaggacataacggggagtgaatggctgggctggagcagtcagggaagcctcctaagatgacactgtcggggaagaaaaaagtcatgtcttttcctcatccattacaaggctcatggctgacactcctgtaacaacagtcagagtaatcagagaaaagcgtaacagacttatttgtcaaagttttttgtgacatgggagccttcagaaatgaagatccaaagacccagggaaaaccgtatgtatttttatgccaatgaagaacggacagtcatgcaaaaatgtgattggaagaaaagggggtaatttatcaagcatggggaattcagcaagacctgtctgttgtgactctgggcctctttgtgcagccttccttcccgctgggtgtggggcaggaccactgtggaacgcaggtcttacggcctcctctcagggaaggaaggtcagtgagcaccttcatgactgtgcttcccactgaaaggtagggaggatcagagcaaccctcttgcttctgaggccttctcagtctccttcagttcacagtgctcagggtcatattttctgagccatgacaacatttaaactgagacctaaacaggcagtcaaccaagaggagatctggggaaggaacgttccaggcaccagaatttgataagaaggcctgtagggggagtgggagggatgctcggtgtgaccagtgcctgggaaatgcatgacaaagtcatctaagagatctaagaggcagcaggagccagatcacacaggcctttgtgagcagggtcctagggcattggattgtagccaccaggaaacatttccatgggaggagtttaagcaagggacatacatgacacaaatttttagaatgtgtgattaccatactacttaaaagccatagaatcccattctcaaagttaaaaattgagtaaaatctctagccaggcacggtggcatgcacctgtattcccagctactcaagaggctgaggcaggaggatcacctgagtccaggagtttgaggctgcagtgagccgtgattacagcgtgtgaacagacactgcactccagcctgggcaacatagcaagacctggtttctaaaaataaagaaaaagttaagtgaaacctcaatactgtatataaaaatacacaaaatatttattagtatgaatttatgatatgtgttcaaattaagacatttattgttctaaagtcaattggcgttagcaatgagttgatttttcaaaacgacaaaaattagaagtgagtgttatggaagacagtttgctttatatcatctctatatctagtttacttttgttttgttttgggttgtgttgagaaaagccttgagggataaagattagttgccaagtttgtgttttcatactttgccttgtgacctcagactttctcatttttgttcttgattatatttaactgttgcttaagtatacaagtcatacaaagaaggaaccaacagtttgtgtacacactgtctctgaaatcaaaatagcatcatgtgataattgatctcttgttatgtgactgacataatataacagtcacatgttccacacagacaggaacatggatcaggtaatgcactttgtgagaataggctagttgccagtattattttatgtgaatggacacgtaagaatgcttgtttgaaaaatagcaatatgtaattacaattactaattactaatcagtgacctatttgtaaaatcaaaaataagaacttttatttaatctgagatcctgacagaagcaagttaacttgaaaatatctctggatttcaatatattaagattttatatgtattatatgaaacaattcgtatgttcttatactaattaaatattttttaaaaatattcaatgtataaaaaatgcaatttaaaaacgagtggctgaaagaatagtaaacagcactgtaatcctaaaagcttgtgttaactttacatttcaatttagtcacaaaatacagatggatacattcctgaaaaaatgtgaagtctttagtaagaatagacatttttgagagagtaaggcacatttaattatttaatattatacatttagtttaggaacataaaatgaataatttaaaattttaatgattttaaaggtataatttaagagttgtacatgtgctcactgaatttactgataaatacaacttttcattactagtggaatcaaaaatttttagttctcccatatctatttttttggccagttcatcagaaatactcaaagattttagatgggagaaattttagattcttaagctatttctagaatgatggtggttttgtttctcaaagcattgatctgttgcccagaccttttgcccttcttgctctgtctcacctattcagaaagcacttgctctttaaaaaagaactgaggacaggaactggctgaatacacttttgtcatatggaactttgggcttattgtctaagctatcatcttttcaccatcctcacaaatctgttgaaaactgaagactcgcctgtgacaaattccttttgcatgttcccaatttatgcacagtgcttttcacatgacgcagaagattgcagacacgaaagcactcaaaagcaaagagacaccggggctgggtggggcacaagcttgctgccatgttgccggacaaattggttgtattctgtgatcaaacatctaaagatattctgtacactggagcatttgagacacagtgacatttcaaagtgaaatccaagtgagcttttttatttgataacccagagaaatgcagtggccacacatttctgctccattttggcctctgcttcttggacccataaactatgtgattgcaatgcagccagctggagataacatttctgctgtggcgtcaaggtttttcactttagtttctttggtatttggaaatgaaaatacacctatgccctcaaaaacaatttattaatctttgtaactgtactgttttgcaaaaaatgtctacaaagtgcaccatttgattccagataaataaatttctttatatggatcttcaggcaattcttccattaggcatagcagacatcctcatctatgtgcctcagattctctgttctttttgttccatataggatgtctttttcttcctttttatgtaatattctcaaaggatataaccacatcattccatcaagtttacttcatggtttgtgtcaatgcattattcttgcatttgcttctttctggaacacagcagtttataccatgtttaggttttatgttttctgacttttgttcttttgtagctctgttggagtgagtccaacttatgacatcattagcaatgttttgtaggctctgggatgcaccttctgtgtgtctgctttgattttctgtgctgccttcatgatagtgtccacagaaaataattttacattcctaaaactgatatatattcagcaacatttttcatttacttacaccatgaagaacaacaacaaaagaaaatgaagtaacaacagcaagtgaaaaatcagataatagagctagcagtaaagtctgtaatttgttctcccaaaactttgttcacccaactgagaggagcacagaacataatgcacctggttttgtcttctacaaaccattaaccattgacattctaatccttaaaaaaaaattgcacataatacctgctgagcaagtagcattataagtttttaaaaatgcctgtgagtaggcatatcctgttgtagagaattatgttctaaaagtacatttcctttatagaaccttggtgagttttctccctaatcttcaggggtcaacttggataaaactagggtttctgagaactttccaggcatggttcctttcttgtagttgtgaacttaaaggtgtaaatattgtcatcctttatggagatgtgaatccaggcaaaagcatgtatcaaacccttgcgatttgccagaggtcaagctgagcattgaagaaacagagaaacagtaaggtaatgatgacaaatagtagacagagaatgggaacacaatgtgaaaaacattttaataaagtgatgagtgacattccagagtgcccaaggaaaattagaattcccaagcaggtagtgaagcaggggacgagaatgacacagctgatataaaaagttatctggagcctgggtgcagtggctcacacctatcatccaagcactttgggaggccgaggcaggagaaagacttgaggccaggagttcaagaccagcctaggcaacataacgagacccccgtcactacaaaagttttaaaaaaaattagccaggtgtggtggtgcgtgcatgtggtcccagctacttaagaggctgaggcatggggatcgtttgagcccaggagttccaggctgcagtgagctgtgatcgcaccactgcactccagcctgggtgacagagcaagaaaccgtctcaaaaaaaaaaagttatccaggagtaatgaaaagtttggtgtgatgggagctgagagtccagaaaggtgctaagagggtaggttggagctgggcccagtggctcatgcctgtaattccagcactttgggagatgaaggcaggtggatcgcttgaggtcaggagttcgagaccagcctggccaacgtggtgaaaccccacctctactaaaaatacaaaaattagccaagtgtggtggtgcacacctgtaatcccagctacttgggaggctaaggcacgagaatcgcttgatcccgggaggtagaggttgcagtaaaccaagattgtgtcctctagccttgccgacagagtgagactttgtctcaaaaaaaaaaaacaaacaaaaacaacaaacaaaaacgaaacaaaacaaaaaaacaaagaggttaggttggataagtaagtgaaggccaaatcataagacctgtgatgaagttggggctgtattctgtaagccacgaagagtcatcaaaagcctcacttgtgagaactagttattgaatgagatcctgtgagtagagaatttatcaagatctcggcagcatgaccacgcagaaacaaacagaaacaaaggaatgtgtcaccaggattcctctctcatgcagggctgtgttaggacacacatacttcatttgagattgtttggaaagtcacctctcacccccactctagaacaacttacattagagaaacgttttcttacagtggcctcacacacacccttttgaggagaaatgaaaagctgtagtttaacaaccgccttacacgtaagaacgaaggaaccaaatgtgcaaatttagaatgacattgcattgggctgaccataaagtaccctccatccccagggcactgctaatgcggagaacgtggtttgtcatacaagacctactgggtagctgtttatttagtagaaatagtgtatgctggttacaagaatggaaaagagaatagaactaaaattactattatcaactacatccaaaaagcacacaaaaaaataaccactaggtgtatatctcaaggtcagaaggccaaaattaaatagccaagttctttctttcttcttcatatcctttcagttcattctctctgctgtcaccccacgcatatactcatggttccttaaagtctttccttgggccagtggttcttaaagaactcttatgtcagtagaagatgctttcagttgccgataccagagacctcacttcaaactgatcttcaggattagagaagcacctagcttgtttaatttgaacgtcccgctggggggcagtcatggtcgatcaatccccagccagaatgtcatcagagacccaccagtctctttccatcttttcactttgcccccagtgctttatactgagtcgggcccatggcccctgtggaaataacagggaggtgacccaaagtaatggggactatgggcatccttgttcaccagtggagagggtgtgtttgcccttgacaaccaattgaccgaagttactgttcaccatgctggaaccaccctgagccaatccctacagtccaggaaataccatggtgggttggtttagacttggattaccaaaacctgtccatgtaggaagattggggtgggggtatcactgtgactatccatgctcttcagcagtgagggaagaaatggatgttggagagaatattcacatgtctccttcaggcctctgagaatttcatgaaagccacgtgctatatccctgtgtgttaattttgcattcagtttttggaggattcactaacccactgaggactgtcattctttttttttctcttcagcttcattgaggtataattgacaaataaaaattgtatgtattcaaggtgtacaacagatggtttgatagacgtatagattgggagatgattgccacaatcaagctaaatacatatccatcacttcacagttacccttgtgtgtgtggtgagaacactgaagatctactctcagcacatttcaagtatacaatacattattattaactataatcatcatgctatacattagctctccagaacttactcatcttaaaactgaaaggttatacctttggctaacttcttactatttttctcacttcttgaccccgggtaaccacccttcttctctttgtttgtgagtttgactttttatggatttcacatacaagtcagatcatgcagtgtttgtctttctgtgcctggcttatttcacctaatgtgaagtcttccaggttcgtccatgttgtcaccaatggcaagatttcctgttttatggctgaatagtattccattgtgtatatgtaccacattttctttattcattcctctgttgatggacacgtaggttgattccatatcttggttattgtaaataatgctgcagtgaacatggcagtgcggatgtctcttcaacatactgatgttgtcccctctggatgtatatacccgggactaggattgctgagtcatatgcttattctctatttttgaattttttgaggaacctccatactgttttccataatggctacaccattttacatttccaccaatactgtaaagaataaggaccattctttaccttagaaaaataacattgcttcccagaggcagaagtgcaccttattcctagatttcagcactctctgtactgtttatccattcaggaggaactacagtgatcaaacactggagataaatagtggttttaagcttttatttcataatttttacagatgatctagagataggccaagtaataatatgtaaataattaattttaaacattcagctcattctttaaaaaactcatagcccaaatgtttgttggttgtttttttccactgggaaaggacggggaaatgtagtttcccactcctgcgccctgtatgttgttatattttaccatgtctttcatagcagcctcccatcattggttgccgtaaatcttttcactgactgtgaggtaccaagagtaaggtaatttagccaaattagtcaggacagcctcactttgtggagcccaggtgaggcttttcaataagagctgttcttccaactggaaaatgccaacaagcaacaatgcagccagtcatcttattttgaagttttaaaagaaagggtttgccagaaatactgggaaggtttagcagctgttccacctggaagatggcaaggttcttgacctgtgaaggaccatttggcattgtctgtccatgtgctgatcagttttaagtaaaccctgcactgaagcaatgaagaaagacactggcaaagtcagcatgctgttgcctcactccccgtcaccactgtgaagcctcctcttttaacataaggcccagagaggatccaagatgttgccaagaccacctgtagccaccagccatgcaggggtggggtcatgtttcttaacccacagcaacacaggtgataggcctggttcttgatctggacagccttcgcataacaccagataactgaatgctaattttcctttccatttaccttaaatcttaacagtaacacaactaacaataaaaaaggcaccatgggatgtgtcctgcttgttccacaaagaactttttcccaggtgtggcctcccttgaaaaatggctgcacccttggatttcttcgtgtggctgatttgcagatccattagttacattcacctttggctaaaggctatgggatagttgatttactttggatgatgcagtatttttcaagagaagttttcatatatttagcccaactgcttcgccacaagaaacaaagtcgtaagtatctatacaggtttacagaaaatgaaattttagctccagctacaaagcggctcagccagttcatggagacttgtcacaggttggtgactgagaagggtccacctgaaacacttgcatgtccaggtccagctgagcatgcatgccagcctcagccgctggggtccctgtctggtcctgcagcatcacgtggctcagatggcatcttcgctgtgagtgcgaagacgctgggcaccagcacctgcacaggcagatggtgaaaggcccccaactctctggtaatgaggatggcagccatatgctttctcatgcatccagctcagcctccaacctacaataccataatgatgacatgtgggaaagtctaggtcccatgccacatcccagttaaaatgcatgcactggaaaagggaggggaactcagctgcacacacattactttttttctatggccttttctgcatctacccaggacttaattgctaatactgcctccctccatgtgggatgaagtgggagaaggatcacaggaaaatacttccacccgtttgctgtggcagggctagattccaaagtgcccaggactgctaattcattcacccctttgtgacagcttatttacccacaccccaccttatttccaaaaggactccaagtagctcaagaaaggaataaagagctatagttaaaaaataatttctcaaagtcctctgcctgtctccatgggctgggctgaactttgagtgactcacccaccgtctgaagtccaagaaacaaataccctaggctgagatctggagattgttctatttgcaattcttatggagggagttattatattctccactgattgggcagtgtgttttcccagagagacagcatgaagcaggcacctgcatccactttattcttttcctctttgtgagtcttgcacgggccgtcagcctgtttgtgaactctggcaggacatggaggtcagcctgtgccaagcaccttgaaccctcattatctttaattagtgtttaggaggttaatcggtggtgaagctcatctttctttaattacttcaacaattcagtcagggggtccctgcagccagctttgaattattctgtttgtttggatgcttatttgaatttgtaaagttggatgtttattgtccagacctagaccctgtgtgcattgaagaaagtgttagggaaagaggagagacgagtatggggaaggttatttttattgcaattaatttgcagctgaatgagcccagaaagtttgcagttttaaaagtgcatcacagtcatatcagagatatcaatgattcaaactggatccaaatcttcctaagctccaattagcacatttattttatttttcatacaaggataagttcacattcaaataattagttgattaaaaaatattattaggtctctactccatgtcttgacatcttaggtgctttgtccagtcacatttaattttcagtattgtacatgataaagctaccaactttgggaaattatattccagcccaaagccttgcttcagaaactctccttaatgcctggctgacatttccttttctttttttctagcaccttatgctcattctctcctctatttattttcagtgaccaccagacactttaaagttgatctatatttacctttttataaggatccttcccaccctccatttctttccttcctcctcacttccacctacttgttccttcaacgtggccattgttctcatgcttcccggaagggtgaactttggctaaagtcatgatttccactcaacaggacagtaactctcagccacattgtgcctctgtctgcaaagtatccactgttctttggcaaagttaggatgtagccttggtaatcctttggccctggagattgtgtttttaacaaagcacctcccttagagcgggttttagaaagtcagcaggccagcgcctcccttccccttccaggaagaagcagaatctcagacatggtttcagggaggtgctcccaggagcctctggcaggagaaaggccttgtggccttgccatttccatctttgtctttgcgtttatacgttggcccagcctacattgactctttcatcgcttcacttcttcagtccttcaacaaatagtttttgagcatccactgtgcaccaggcactgttttgggtgccaagcatgtaactgtaaaaaaaaaaaaaaaaaaaaaagcaaaattcctgccctcatagaacttacattctaatgaggaacacagacagtacacacaaactatgtcgtgaaaagtgtggcatggaaaaccaagctagatgtgggtgcagacagtgatgaggggagggtttctgggaagctggtctgggaagtctggtctgagtgaactgagggagagagacttgtccacgggaagaacatcccaggccaagggaaagcatatgcaaaggccctgaggtgggaaaccagagtgatccaggaacttgcaaggatggccatgtggccagctggggcagagggagggagggaagcacagtaggaaatagcgttgagaggaagccagggtccttgcgtttattgtatgattctgagtaggtaagcagcatggtcctgtttgtggatatagaattttaacagaactttctgcttataaagctgcatctttgtgattaacttagagcttcactgctatagtatgttttctccatttcccaaatgcccctatttgtaaatgcacagagcctagactattcttcacttgcttggtgacacccaggccttttcaacccgtggcacggcattttgcttggggtctctccaggtcagccaggtgccctgctaatttatctgttcctagcagccccgtgactccaacctgaccttttcataggcttgccgacaggaccacggagctcagccttgcaagtcgtggaatgaggtgatggtttccatatgtgctggggctgtcattcaaattctttgcctgctcagctaatgaggtcagaacggctctgcctgaggtggacagcctctccctcgggtagtgtgcctgcaggagatacaggaggaagtctccccacccgctttaaaggaagcttggcgagatagcattgcttagcactgttcacaaaaggataactgcagaaaaacatgaaataaaagggaatagaagggaagagacagactgacttttttaatttaaactttttatttggagataattgtggcttcataggcagttgtaaaaaataatagaaagctcgcatataccctttactcagtttccttaaatggtaacatcttacaaaactgtagtacagtatcacaaccaggaaactgacactgacacagtcaacacaaaacatacccatcaccacaaggaccacttcctccctaccctttccatcccgccattgtgcttttataggtacccctactttctattcattccttaactcctggcaaccattaactgttctccatttctatgattttgtcgtttcaagaatggcatatacatggaatcttataacgtgtaaccttttgttagtgacattttctttcagcataattctctggagtttcatccaggttgttgcatgtgtccatagtttcctcctgtttactgctgagtaatattccacccaatgcatgtaccacgcgttgcttgaccattcatccgttgaaggagatctggatttccagtttttgctcttatacataaaactcttacaaacatttgtttactggcttttatgtcaatattaggtcttaatttttctgggataaatgtccaggagtgcaatagctgggtttatagtagatgcatatttagttttacttttaggttttttttttttttttcaataacaaccatgtatttagctcatgattctgtgggttgacagtttgggctgcacattagtggagggttacctgatttgtgtgtgtgtgagacataattcaaacacataaacttcaccattttaaagtgtataattcagtggtttttagtattttcacaaggttgtggtatgtttggtttttaaacaaactgccaagctgtttttcagagtgggcataccattttacattttcatcatgatgcatgagtgatctagtttttctatatccttgccagcattcagtgctgtcctttttttttttttttttttaattttagccatagggattgctgcttagtgatctctctttgtggttttagtctgtgttttcctaatggttaatgatgtgaacatcttttcatgtgtttatttgccaactatagtcactctggtgaaacgtcttttcatggcctttgaccattttctaatgggattctttgttttgttttatattgagttttgagagttatttatatgttctagatgttagttctttgtgagacatgtggcttacaaatattttctcccattctgtaccatgttctttcagcctcctaatagggcctttcatagaagaaaagttaattttagtgaagtccaaatatcaatttttctttgtgaattatgcttttggtgtcaagtctaagagaactctgcttagccctagatttcaaagatactctcctatttttttcctaaaagttgtatagttttttttttgtttgtttttttaattatactttaagttttagggtacatgtgcacattgtgcaggttagttacatatgtatacatgtgccatgctggtgcgctgcacccactaactcgtcatctagcattaggtatatctcccaatgctatccctccccccttcccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtcccacattttcttaatccagtctatcattgttggacatttgggttggttccaagtctttgctattgtgaataatgcctcaataaacatacgtgtgcatgtgtctttatagcagcatgatttatagtcatttgggtatatacccagtaatgggatggctgggtcaaatggtatttctagttctagatccctgaggaatcgccacactgctatgacaaacccacagccaatatcatactgaatgggcaaaaactggaagcattccctttgaaaactggcacaagacagggttgccctctctcaccactcctattcaacatagtgttggaagttctggccagggcaattaggcaggagaaggaaataaagggtattcaattaggaaaagaggaagtcaaattgtctctgtttgcaaaagttgtatagttttatattttactttcaagtatgtatgctgagttaatttttgtgtaaggtatgagatttagatcaaagttctttttttctgtgcatatatagttgttccagcaccatttgtcaaaaaggctttcttccactgaattgcttttgcacctttgtcaaaaatcagatgggtatgtttatgtgagcctgttttttgtttctgtcttctagtctatttatctgtttatttctttatgaatgccacactgtcttgattattgtaattatatcataagtcttgaaatcagatacactgatttcttccatttcattcttcttttccaaaattttaacaattgttcttttacctttccgtatatactttttggaatggtctcatctgtaacgacaaaaaatggttgagattttgacaggaattgctttaaatctgtatatcaatttggagaattaacgtctttactatgctgtgttttccaatccatgaaaatggtaagtctctccatttgtttagattttctttgatttctttcatcagcattgtgtagcttttagcacacaagttttgtaaatgttttgctctgtttgcgcctcagtatttcatatatttttgaacgatcccaaattgcattgtattttaaattttagcatctgtgtgttcattgataatacatagaaatacaactgatttttgtatgttgatcttacatcatgtactttgatgaactgacttattagtactaggagttttatatctatacataaatatatatatatacatatttatgtgtgcatatatatgtatttcttgggattttccagacaattatgtcatctgcaaatagctacaattttattacttcctttctggtccctgtattttttatttccttttcttgtgttattgcactagctagaacttctagcacagtgttgaataaaagtggtgaaaatggtcatccttgccttgttcccaatatttgggagaaatcattcaactttttatcataaagtgtggtgctagctgcaggtgtttttgtagatgctctttgtcaagttgggggagttcttttcttaatttgctaagagattttttgtttgtttttaactcatgaatgggtgttgaattttgtaaaatgctttatctgcatgaaccaatatgagtgtgttttttttctctttagcctgttaacatggtagattacattgatttctgaatattgaaccatccttgtatctctgtaatctccacttgattgtgttgtgtaattcttgttatatgttgatgaattgcacttactaatgtcaggtttttttgcatctatgtttgtaaggtacattggactggggctttctttttttgtaatgtctttgtatggactggtatagtataatagtagcttcataaataaattgggaagtgtcttttccttttctgttttctggaagagattatgtagaactggtggtaagtcttctttaaacttttggtaaaattctccagtgaggccatataaattcaatttccttaatatttagagagctattaaaattatttcaaattgtgtgaattttggtagtctttgtttttcaaggaattggtccatttcatctggtttgtcaaacacatgtgtagaattgtttctggtatcctacaattatctttttgatatttgcaaggtttgagtaatatctcacttaattcctaatattggtaatgtgtgtcttctcttttttttttctttgtaagtattgctagaagtttgttaattttattgttcttttcaaataagaagctcaataaagagcttttttattgtttctctgtttttaacctatcagtttttattcttaatgatttccttccttctgcttgctttgggtttattttgctcttcttttctagtttcttcatgtgagaacttggaattctttaattttttttaatatatagattaactgctatgaatttccctcacagcactgttttaaccgtgtaccacaaattgtaatgtattttctttttcatttaattcagtaattttttatttgtcttaaggctttttcttaatcctttattatttggaagtgtgttattaatttccaagtgtttgaagatttttctgttatcttttttatttatttctagtttgattccattgtgtttgtagcatgtattgtgtataacttttaagtgtgttgaagtttgttttgtggcccagaatattctatttcttgttatatattccatgtgcacatggaaagaatgtgcattctgttgttattaggtagagtgtggcatgaatatatcctgttggttgatggcgtttggcagttctttaaattttattgatgattttccatttgtactatccattgttgaatgagggatattgaaaaattcaactataattgtgaattagtctatttcttctttcagttctatcagttttagcttcacatattttgcagctctgttacttggtgcatagacattcaggattgctatgtattctgaatggattgatccttttgtcattgcataatgtccttcattttctccagtaagttactttgctctaaagaccactttatctaatattaatatagttacttaggttttattttgattaatgtttgcatgatgtatcttttccatcattttctatctgcctatatcattatatttgaagctagcttctaaaaggcagtatgtaattggctcatgtttttaaattcaccatgtcattctgtatcttttaattggcatatttataccatttatatttaatttattgctgatatgttggggcatatgtctgccattttacctttttgagccatcacacctagctctacatacatttaaaaccatatcagaccatgtataattttcactttaactcatcaaacataatttggagaaatcaagagcaaaagaaaagcttcttgtatttactcatattttgcttactatattctttcttttttatgttccaagatttcttcttttatcatttcctttttgtttatagaactttcttattattattttttattttttgagatggagtcttactctgttgcccaggctagagtgtggcggtgtgatctcagctcactgcaacctccgcactctggcgttcaagcaattctcctgcctcagcctcctaagtagctggtattacaggtgtgcaccaccatgcctggctaatttttttttgagacggagtctcactctgttgcccaggctggagtgcagtggcacaatctcagctcaccgcaacctctacctcctgggttcaagcatttcttctgcctcagcctcccaagtagctgggattataggcacctgccaacacacctggctaatttttgtatttttagtagagacaaggtttcaccacattagccaggctggtctcgaactcctgacctcagatgatcctcccacctcggcctcccaaaatgctgggattacaggcgtgagccaccatgcccagcccatctttgtatttttagtagagacagggtttcaccatgttggccagactgttcttgaactcctgacctcaagtgatcctcttgccttggcctcccaaagtgctgtgattacaggtgtgagccaccgtgcccccaccttataggactttctttagctattcctgtaagatcgttctggtggtgacaaattttcttagttttccttccattcaagagatttctttttcattcctgaaagatattttcactgggttgacagttctgttctttcagcacctgaaaaatgttgtgccagttgctctggcctcagtggtttctgatgagaaatccactgtcaacctacgtggttttcctctattggtgtcatttctctttggctgcctttggaatctttgtcgttggtttttggcagtgtaattaaaatctgtcttgttgtggatttctttgagtttatcctctttagaattgctctgtaagtttatattgttcatcaaaattgggacattttcagccactatttctgagtgctcttttagccctgccgtatttctcctctttttctgagactctgaagacgtgaatgttagatcttctattatattcttacaggctcccaaggctctgttaatttttatagtctattttgtctctattactcagactgggtaatttctactgttctatttttcagttcactaacgatttcctctgtcccctgcattctgctgttgagcccatccactgaggtttttatttcagttgttatatttttccgttctgaaatttcctatttgttcttttaagtcttatatttcttggctgcggctttctattttttttcttttaagtgtgttcataattacttattgaaacatttttaccatggctactttaaaatctttgtcagacaattccactgtttctgacgtcttggtgttagcatctattgatcatttttatttttctccctgtttgagatcttcctggtttatggtaaaataagtgattttcaaatgaaacctggacattttggctattatgctatggactctggatttcatggcagcctggctcctgccgggtagaggtaatccagattcactaatggcctctgtttatgtcttcagggtagggatgggagctcctgctctccaggtgcaggggtcctgattctccataagaccttttctgacatcacccagtgaagagggaaaaggatgccttcacatttcactgggttggggatggaagtctagtcatccgaagtgatctctgctgacatcccagaagggaggggtccttattggctggcagggatgaaagtcaaggatccctgcttggtcttctttttcacctccccataagggtgttggagagcctcataacagtctcctaagggaagaagtctaagagcaccactaggtctttgctggcatgggttgggggtgagggggccacctttttctctggggtatctggctgcagatgagtacttcaggcctgaaagttttctgtcttgctaggctgcccctttcctgttcctttgtctggagagaaaaggcatttgctaggtaggcttctttgttcatgcctgtggacattcagaatcgtcctctgcctctactgggaaaaccttgtctgggacagaggaaatcaagcactgtgctgctacaagcctctcttctctccagtgcccagtttttattattagaggaaagttgggtccagggaggactggaggaatctgttgtttatttttggaacggaatttgtattagggttagttaaccttgaaccctatggtgtcttcagccagaatgtcccccaaactgtcccatgtaacctgaattcttaaaaaattacaatgtttcatctctataaatccacaaacactgctcacaatatcttctggaatttggagtgagcttttctctccggaagagaatagggacaatgtccatattctggcattttaaaagaataatacagaggaatttaccttggccactattggaaaacctactgtgtcctgagctcaatgctgggcgttatggatagacacgagacaaatggtgaaggattgagttgtggagacacaacataagaagagagtcgcaccacaaatcagttaatacaaagcacacatgcaattttacatattgaaccgtgtcctctgttttcagcccaggataggtactgtgaaaaacataacaaaaagtgtaagacttggttccggctgaatgaaccctctagttgaacacacagatggtgtgctggtgttttccagggatcactaggcacagtgctgcttctcagtctaccagctctccatgggtttctacaagctgagtccaaagttgcatctcagctttgacctctctctggtcccctgtcttctgaacacctcagaggcgctcacaggccccacatctgaaactggattcattgctgttcctgctgaacctttttctcctcctgtgtttgcatctggatggtcagcaaagggccatccattgttcaggacccagcttcagtgctgattctctctgccctgctccaagttcttcactcctccacgtcacctctcctgagcctagcacaatctctgtaagggcatcatcaccttatagcatggtaagtgtctgcacggcgaggtcaccttaaagactgtgagttcatgagggcagaggctgtgtcttgggtaactttgtttccaacattgggtctcacacacagtaggcgcagtacaaatgctgaattaatgggaggtcaagaggtcatgtttttaaaaagaagatgcatatggattggcagaaaggggaaaggagaatcatctactaccatctaacagaatggaatttctggagggctcgtagttccgtggtatataaaataaatataactcttattgaagttttaggctggaaaaccgattttgtttttgttttattcttgtgattttccttcattacataagtgtctttaactaaggtaaagttttagataaaacaaaggcctaggtaggtctggaatacacttgagccccgaaggttttcatttcctaatgataatgagtaaaataagttgccaattgtggctatgaaatatcattctctaataaaacaggttagaatgttaacagcctggtggattggtagatgtttggccttccctgaaggacagggaactggggaccagctttttttcttgagggcctgtcacatctgtgttttgcagactgcccagtagctaatttaaaaataagtttctaaaattacctacttgtttttggctttgttgtagtgtcagctgtgattccggtcagttgtaactattgacaagatctaaaattcagatttggagttatttgctgtgtactccacactcccgctctttggcagttatgcatgtgtgatttttgcaggaatagctttctaacagaaatgtggacacaagagtttatttttctccatcataactcagctctccacttcttcctgagactgatcattttttgaggcaggagcataacaccttctctaggatttgtcagcttctaaaaagagccttttgtaaggacttgtatgagcttgggtttcaccatcattactggggaggcactaagactgcacatatctctgggtgaagtaatgtctacacaacacctttcatagcaatagttcccagctagcatacctgcttctgccagtacagagccaaaaaaaaaaaaaaaaaaaaattaagtactttaatgccaataccccccaccatgggaaaaataaactgtaaaaatggcatcattaccaacagctcatgtgataggagggaactgaccttgatttggcacccaatccacctttttttaattcaattttctttctcaaaaaaatgtgataaaatgcacatagcataacatttactattttatagtttgccatacatggcagttggtagagtcacagtgttgtataaccattaccactacctagttccagaatattttcatctccccaaaagggaaccccatatgtgtgacgcagtccttcccacttcctttcccccacctccctgccctacagcccctggcaaacacgagcctgttttcagtctttacatatttgcctattttggacatttcatataatcatgtaatacacagcctttgaggttgggcttctttcacttagcataatattttcagtctttatccctgaagtatgtatccatctgtaccatatttctttatatggctgaataattctccattgtatgcatagaccacatttgcttacacatttgtcagttggtggacatttgggtcatttctacttttggcttttgtgaataacgcagctagggatattgtactggtatctgtctgagtccattttccattcatttgggtatattcttaggaatggaattggtgagtgatgagataattctgtgtctaacttaccaaggaacagtggctgcaccattttacatctcaccaagtaatgtgcaagagttccagtttctccatatcctctccaacacttattttctgagttattttggttttggggtttttttaatagccatcctagtatgtgtgaagtgctatctcatggtagttttgatttgcatttccctaatgactaatgatactgattatcttcatgtgctttttggctattgtgtattttctttgaataagggtctattgaagtcctttgcccattttttaatcaagttgtttgtttttttgcttttgagttgtaggtgttctttatatattctggatactagacctttatcagatatgatttgcaaatattttctcccattttgtagttgtcttttcatttccttgataatgacctttgatgcacaaaagtttttaatttccatgaagtcccatttatctgtcttttattttgttacttgcatttggccattgccaaagccaaggtcataaagatttgcccctgtattttcctctaagatttatattgttctagctcttatatttatgctttttattaatattaattaacaaactgtaatttataagcctctggggtacaaagttatgttttgatacagctatacaatgtgaaatgattaaatcaagctaattaacattgtcatcacctcaccaacttatcattttttgtgatgagacatttgaaatttactcttagttattctgaagtatataacacattattattgactatagttaccctgttgtgcaatagatcttaaaacttactccttttgatgagttcatgtccttcatagcaacatggatgaagctggaaaccatcattctgagaaaactatcacaaggacagaaaaccaaacaccacatgttctcactcataggtgggaactgaacagtgagaacacttggacacggtgggggaacatcacacaccagggcctgtcgtggggtggggggatgggggagggatagcatcaggaaaaatacctaatgtaaatgacaagttaatgggtgcagcaaaccaacacggcacatgtatacatatgtaacaaacctgcaggctgtgcacatgtaccctagaacttaaagtattaaaaaaaaaaaaaaaactcactccttttgtctaattgaaattttgtaccctttgaccaacagctcgtcattccctcactcctccactctcaaccccagcctctggtaaccatcattgtactttctacttctatgagttcaactttttaagattccatatataaatgagatcatgcagcacttgtcttactgtgcccggtttatttcatttagcatagtgtcctcttggtttatccatgttatagcaaacgataggatgtcctttttaaggctgaatagtattccactgtgtgtgtgtgtgtgtgtgtgtgtgtgtgtgtgtgtgtgtgtgtatgtaccacagtttcttcatccactcattcattgatggacacctaggttgatttcctatcatggctattatgaataatgctggagtgaacagaggagtgcagatatcccttcagcatactgatttccactcctttggattatatacccagaagtgagattgctggatcatatgatagttctatttttaattttttggaggaacttccactgttttccatagtagctatactaatttgtattcccatcaacagtgtacaggggttcctttttctctgcattctcaccaatacttgttagctttctttttttttttttaataataaccattctaacagatgtgaggtaatatctcattgtgattttaactggcctttctctgatggttagttgtttgatcattcttcatatacctgttggtcatatgtatatcgtcttttaagaaatgtctattcaggtcctttgttctttttttttaattgagctatgctttcttgatattgtttgtgttccttgtgtattttggatattaacctcttatcagatgtatagcttgcaaatattttctctcactctttaggttgtctcttcactctgttgattgtttcctttgctgtgcagaagctctattgtttgatgtcatcccatttgtctatttttgcttttgctgcctgtgctttcagagttatattcaaaaaattactgtccagaccagtgtcatagacctttcccctatcttcctccagcagttttagtttcaacttgtatatataagtctttaattcattttgagttgtttttgtatatggtgtgagataagggtcaagtttcattcttctgcatgtgaatatccagtttgccaccaccatttattaaagatgctgctttttcttcattgtgtgttattagcacctttgttgaaaatcagttgaccataaatgtatgggtttatttctggcagtctagcctgttccgttggtcaatgcatctgtttttatgccagtaccatgccattttatttgcaatagctttataacatattttgaacacagggagtgtgatgccttcagcctttttcttagtgctcaagattgttttggctattgagggtcttttgtggttccatataatcttaaggattatctttttctctttctgtgaaaaatgacattgccattttgatagggattgcattgaatctgtagatcactttgtgtagtatgattattttaacaatagtgttgttttacagttcatgagcatagcatcccatttacttgtattttctgcaattatttcatcagtgttttgtagttttctctatatagtcttttaccccttgattaaatttacacttaagtattttgtgttgttgttgtgcttgtaaatggaattgctttcttaatttcatttttggatagttcattattaatatataaaaacactactcatttctgtatgttgatcttgtatcctgcaaccttactaaatttactagttctaaacagttttttggtggagtctttaggattttctatacatagcattatgtgtaccaacaaacagagataattttgcttttttctttcctatcaggataccttatattaccctcttgcctaatggctctggctgggactttcagttctatgttgaaaagaattggcaagagtgggcatccttgtcttgtttctaaccttagaggaaaagctttcaacttctcaccattgagtatgatgttagctatgggtttgtcatatatcctttattgtgttgagatatattccctctataactaatctgttgagttttatcatgaagaggtgttgattggcttttctgcatctattgagatgatcatatggtttttatatttcattttgttaatgtagtgtttatagatttgtgtatattgaaccatccttgtatcccaggcacaaatcccacatgaccatggtgaatgattctttcaatgtgttgttaagttcagtttgctaatattttgttgaggatttttgtatatatagtcatcagggatattagcctgtaatttttttttcttgtgattccttgtctggctttggtatcagggtaatgctgactttgtaaaatgggtttggaagtatcccttccacttcagtattttggaaaagtttgagaattggtattagttctttaagtgtttggtagaattcagaagagcagccatcaggtcttggccttttctttgatgggagattttttactagagatccaatctccttccttgttattggtcagttgtgataggttgtaagtgtctaggaacttaacatttcttctagattatccaatttgttgccatatgattgtttgtagtaatatctaatgaccctttacgtttctgtggtatctgttatagtgtctcaactttcaattctcactttatttgcgtctctcctttttttcctagtcagtctagctaggagtttgtagatcttatctttggaaaaaaacaacttttagtttcactgatatttttccattgtttttgtagtctctgtttcatttatttctgctctgatcttttttgtttccttccttctgccaactttaggcttagtttgttcttccttttgtagttcctcaaagtgtaacattaggttgtttatttcttctcttttgatatagacatttatttctataagttcccttcttaagattgcttttgctgcaacccataaatttagatatgctgtgtttccattttcatttgtttcaaatatatttgtatctttgatccattttaagttaatttttgtatgtggtgggaagggcccaattccattgtttggcatgtagaaatctagttgtcccagcaccatttgctggagagattattcttttattattgaatggtcttcacatccatgtcaaaaattaagtgaccattgatgtatgggtttatttctggactctcaattatattctcttgatttgtaagtctatgtcagtaccatgctatttttattactgtagtttagtaataagttttgaaataggtatgtgtgagttctatgactttgttcttttttcaacattattttggttattttgggtcccttataattccatgtgaatcttaagatcagcttttctatctttgcaaacaaacaaacaaaaaaaaccattgggattttgataggagttacactgaatctgtaaaacactttgactagtattgctatcttaacagtatcatctttcaatctgtgaacacagggtatttttcaatttatttgggatgtctttaatgttttcagaagtgttttatagtttttttatgtatgagtgtggcacctctttggttaaaattattcccgagtattttattccttttgattataaattggattgttttcttaattttcttatcagattgtacattgctattatatttgtatactactgatttttattggttcacctggtatcctgcaactttactgagtttattaactcccgtaatttgaatatgtgtgtttgtgtatattcttcatcatataagatcatgtcatgtacaaatagagatagttttacttctttctttcatatttggatgtattttatttctttttcttgccaaactgctttggttagaacttcagtaagtttgttgaatagaagtgctgaaagttggcatccttgtcttcttcttgaacatggaaagatggctttcagtcttttaccattaagtatgatgttaactttgggtttttttaaattaatgctcttttcatgataaggaatttcccttatatctttagcattttccacaataaaaatatcatgaaagagtactgaattttgtcaggtgctttttctgcatcaattgaaatgatcatgtgatattttttcctacattctattaatgcggtatattatattgcttgatttttatatgttgaaccacccttgcattccagggataaatctcatttggtcatagtatataattttttaaatatactaaacttagtttgctagtattttgttaatttagtattcatatactgaatttagtttgctagaatttagtattttaaagagattctctctttaaaaaaaaaaaaggaaaacatagatctaaattgctttttctgtgccaatctgtactcctcttttcttctcattatttcagaattaaccaaagtaaatattttgttgtgttttgttcaccttttttactttgtttttgtgaacagatagcttccaaaccatatatagatgatataatattgtaaatggtaaatgttatcctttcttacccatttcaatcttgagcttttccaacattattgttcatgagaaattttagttacaactattcacaatggtctcctttcctccaaagaagagaagggtaaattggaaaaataatgttccttgacatttcaacattggagtgcatggagaaatcagtgcttcctacacctccagtagagtgtttttataagctctggttcctgttttatgacctctaaagctttgtcatatcctttgctgttttaaaagtttcagaaaaggttgttcctaaggatagcaagactctgcaaagaatagttctgtgatcttgttctgtagacatggtgttttccagtagttggttcagtgaaataacagattatttatagaaaccaggtggagtcaatatgatggactgagctaactcagaaaagatccttccaaacacacatacatgttaggtgaaatataaacaaaggcaggctctcaaaacataactaagctcaaaagaacgagaaataaatccagataccaaaaacagaggcatcaaagccagcagggttagaggaggtgaagccaaggaggctgcatgggagtatcagaccatgcaaagggctcagaggcagaggtttcatgggttaatgcagggagagaacagcttagtcccatgtgagatataacagaaccctatgcataaagttgcaaattttgtagggatgccattttagtgaaacagaaactagaaaaatttttctccttagattgacagagaagcaatgagtcatcctgtgtgcccagggaaatagatgaaagaaagaattacccactagaaactggaagcccatgcttatatgagaggtccaatttcaggcttcccaatgctacatgctaatatattaatatacaaattgatgtaacccacagggccctagcagaggcaaaagaaaactcattctgaagaactagagcacacacaggaaatgaaccacaatgaagtagagagtccttctgtactaaggataggaaaattagcttcccactagctggaattgcaaggaaagtctgaaagattctataaaatagtgatgaaagaagatacagatatcaaaaagcaagagaagggtagtatgtaagaacaggtggatttggaagaaaaataaaacatatagacatgaaaagtccagtgatttaaattaaaacatattagaaaattttaaagtagtttagataaagctgaagggagaaggggaatgaaaaacatgggagagattgagggatgtggaagatagaatcagatcaatatggagatactgtagatagaagctccaggagaaggtaaaatagagaacggaggggaggcaggaatctcagtgttttctgtaagtgaagatccacaaacattcaagctgttgtagctttccagacctgagcagctgaacaggatataaaaacaaacctataaccagtcatactaaatattgtcatgaaactacagcccatcaaagacaaagggaattattgtaaaagcaaccagaaggaaaagacagattccctgcaaaaaatggcaaactgagtagccttcagtgctgaagacaagaagagatggaaaaatcagagttgtgtgttctgaagtgtttgcattattgaagaagggggttaaattattttctaacttttgaccttgtcaaatatgaaggctagaaatgtaagggtgaccactgaaataaataataaagtattcctctaaaccaaaaaataaaagcaaaaaacatgataaacaggaagcataaaataaatgacaccatttatgcgtatttttaaatataattggatattaattacccatacatatctatgaagcaacagtatgaaatatagactggaaagctgtttcttttttatggaagggagaagaatggcgagtataaggaatttatatttaagactttattattttattaaaatctgaagtaatcatagttaggcctggtcctgacatttgcaggacttggtataagagtaccagtggagaccttgaaccacacataaatatgtgaaagttacaaatcaagctagcaaagaattctgtcccttcatgatgacaccttcataaagcctggtgcgcttcctgattcctggcttatttgaaggccttagccagagtaaggcagcgtgggaaagagctcactccctggacaccctctccatgcttcagaaccccagctctgccctgcactgagggcatctgcgcacgtgtggtgtggtgaacatcccagcccacacatccaggttctgttcacatccccatgcaaaaagcaccccttggccacccccacagacctggggtgtgcacattggctatatggtctacttttagggggatggagctcaggatggagtcaagttagccttggatggaggcctgggtggtcattgagcagggacttctagggtcccaaataactgaggtggtggatggcaggcctgggccatgggagggtgtacctccttggctgtggacccctcacagtgtgtggaggaagggctgcggcacagagtgggtccctctgaagcaagaagtcacatttttaaataatatctcattataggctgagcacagtggctcatgcctgtaatgccagcactttcggaggctgaagtgggcggatcacctgaggtcaggagttcaagaccagtctggccaacacggcaaaaccccatcgctactaaaaatacaaaaattagccaggcctggtggcaagtgcctgtaatcccagctactcaggaggctgaggcaggagaatcgcttgaacctagtaggcagaggctgcagtgagccgagattgcgccactgcactccagcctgggcaacaagcaagactctgtctcaaaaacaaaaagaaaaaaattaattataaaaaaagaagacagagaaaagcattcaccactctaggcggcatctaggcggcgtctgccagcacaggagccctgccagcaaagccccatctgacctttgtcaagttatttgacacagctgagtctgttttctcacctgcctggtgagaggccaacatgtataatttcaatgatccctcccatttctgaggatctgtgacattctcataagccccatcatgaggaggagcttctgggatggccagggtggttcaggaggcatgtccctgtggtccaggggcatgggggcagagcctagtcctgcatggtctccagcttctgagaaaataatgtgtcagttgcccattatgtccccatgtggggcctggctggtgaggctaccctggggccaggcagggtgaggggccccctctgcacacagtgccctttattttgtgcaggagtcatggccagtgctgggcacgtgttggacagggaggacaggcccttctttatacctgccacattctgaaaccaggcagcacagggagctgtggacagtcggtgatggcagctacacagagggacaggtgccacgggctcactcctcctgtgtttgcacaaccatgccttccagggcaattgctcagccagacccggtgagattaatttggcccatggaagaaagaggagacgggagggaggaccagtgtgaaaggatggagaaagtatttttcttcctcagccatgagacgttttgccaagcttagctagctgaggctcacccttaattgggaatgaattaaacattgttatttcaaccaaggcactcagaaatgccctctcctggaaattcaaaatgaacttcagctcaaagaactgtgaagaagagccagggccccactcctctttcgatggccctgagggagctaggtgggtctgcagtcatgggaggggcctcctcaggctccaggctcactgatcgatcgggggcagggtacatgggattcaagcacctgcagcttcttctacaactccgtatcccctcacgttcccacaaacgtaaggggggtctgtatttgtctgcctgggctgccgcaataaagtgccataggctgtgtggcttaaacagcagaaattgagtttgtcacagtctggaggctggaagtccatactcgagctacttacagattggtttctcatgcgagcactctccttggcttacaggtggctgtgtgctctgtggtcttccctccgtgtatgcctgtgtcctcatctcctcttcttattaggacagcagccatgctggattagggcccaccctgatgacctcatttcaccttaattaccactttaaaggccctgtttccaaatacagtcccattctgaggtactaggggtaaagacttcaacatgtgaatttagaggggacaccattcagcccataatctattatgcctctaggtcactggcaaactcctgtaatgacaagcgaaatgagagcctgatagtaaaaatcaaagcactttgacctgcctgggcagttttcaagcagtccctttgggcttatagaaataaacagactgggcatggtggctcacacctgtaatcctagcactttgggaggccgaggcaggaggatcacttgaagccaggagtttgagaccagcttgggcagcaaagcaaggccctgtctctgcaaaaaatgtttaaaattagccaggtgtggtgatgcacacctggggtcccagctactcaggaggctgaggtgggagagttgcttgagcccaggagttcgaggctgcagtgagctatgattgtgccactgcactccagtctggacgacagtgagaccccatctttttaaaaaaataaaatagtatagaaatagccaagctccagaacagttccacatgtcttcacagcagtggcaaccttgaagggaataggttcaggaaaggcagggactgctccttagccgtctgttttagaagaaaactcgccttgatgttcattggggttcaaaataatcaagttctgcagaacgaagctgggctgtggctggggtcctgaggcctccgcggggctctcaccccgtgcaggcagggggctgcaggcaggagtgaggcgcggagatgtttacccggaaacaggcctctccttggagaagtgtcctgaaaagcccacggtcccgcgggtatggaccgggcacatgcacacttcagcgagcaggaagcgctggctaagggagggactggaaacggcgttttccacaacagggagccagcattgaggcgcccagatggcatctgctggaaatcacgggccgctggtgaagcaccacgccttacccgacgtggggaggtgatcccccacctcatcccacccccttctgtctgtctccttgtgcaacccgagtgttcaggtgacaagagactgacgcgcttgctttatccgcaggctgaacgagcgcgaccgcctgatcaagaggctgggccggaagacgcccccgacgctgttccggggcagctccctgcagcagggcgtcccgcgtgagtaccgcgggtgggggctgatggaggagtgggtgtcggtgcggggcgggggttgatgaggagttgggggagcgggcgctgatggggggccgggtgagtgctgacggggggtgggggcggggcgtgcgtttggaagtggaactgcaaaatgtgtatttggccccaggaacgtgcagcttgagtgtaggcaattccctgggaccacaaaatccgtaaacttaaaatcctggtgtggttatgatccttccgtcagcctcccaagaggagttttttaaggttgaagcagtatgacctttaaactgttgcccctaaagatagcaatatgaactgttttgtgtagtgttgccatattgattgaaacaatgaccatcattggggaaaaacatcatgcttctcccaggaaggctgccccacgtctaagcctggcgtccccctgccacccccgcccccacctccagattccagaggagagtgggaggctgtgaaacatcccctctccactgcccccgactttggagctcagggggagctcatgggcttgtttttagcaatccagtcatcagatcccagctgaggcagatccaggccaccttccccagggccaaggccaacccagccctgcctctctgtgtcctgcggccttccccagccccctctccacccccatcacgtgcacacgccagcttttcctcccatacttactccctgcctccctttcccttccggaggagtttagagggaaacgactggtagaaagagatgagttgggccggacgcggtggctcacgcctgtaatcctagaactttcggaggctgaggtgagtggatcacttgaggtcaggggttggagaccagcctgaccgacatggtgaaacctcgtctctactaaaaatacaaaattagctgggcgtgacggcacatgcctgtaatcccagctacttgggaggctgaggcaggagaatcacttgaacctaggaagcggaggttgcagcgagccgaggtcatgccattgcactccagcctgggcaacaagagcgaaacttggtctcaaaaaaaaaaaagaaagaaagaaagaaagagacagatttatgaacgtgaagaatcattgttcacacagtacaggcagtgaaggatctgtgttctgttgagctctgcctgtcaacaggtatttgcagactttctcaatggagagagaaggagggagacagagtatcattgcttttcagtaatctaccccctgtcctcactttcccatgtggaatatcgtatgggaagaaggggactgacatgcttctgtcctttaatgctccactgccctgggaggtgggtaatgccaccccaaggacacaaagcagaggctcaggtcagaaagtgggtggcccagcattgctcagtggcatgccatgaggtctggattgcagcctcagactctggcccaaaagagaggtaagtcaagaagtttgatgggacaggagtgctaactgtagggcagccctctggagatgggctgcctgggttcctgtccctgctcccctgctttttcgtgaccttgggcatgttacttaatgtctgcttctgcatctgtaaagttgggtaatatgagaacttactggatgccagaggttcagtgtaggtcctgccacccacagctgcacagaaagccaatcactgaaacaacaattatagccaaggaagaaggctttatctggtgctatagccaaggaggtggcagattagtcttaaatccatatccttgactgactaaaattaggggtttatatagcagggaagaaatgttaacaatgtgtaagaaaacaggaatcagtaggggtaaggaagcaatcaagatgaatgaggggcttagcatctcgttgtctggatgagatcattgggtgagtttcagatctttgctacttttcgagaggcctgtgggtccctacctaaggaaggaactcagataaaacaaatacaaatgtcaagctttaagaccagaagggtcatttctatgttaaaaaaacaaaaaaacaaaaacaaaactgtctatgggactattgggttggtttcaattaggaggattaaatgagatcataaagataaagtgtctatataggcaatatagggtccaataaatgttgggtattattattctgccattagctgaataattttgggaaacttaatttctctaaatttttattttctcctgtggagaaaaaagaattttaatgatatacatcttacacagtcctgtgagtcttcatgacagcatgtgtaaagcaccttctgtatgccagacacagagaaaacacatacaggttcccagaactctacagggtctgttctgttgagccgtgttgcctctctgatgaatgtttcaaaataaccatagacagaatatacacgatatatatgttgtgatcaaagaccgaatgagaatttttatgggagagtcataaatgtcttaaagacaactactaaatgcttttcttaagtcaatattttgaaggccaaaaaaaaatctactgaataaatataagaaataagaaggcttctgaaatcacaccacattttttaaacattcagtgactagtaccagaacctgatggataacttaggacgtttctgtcactaacagccagagaagatcgtcgggtggtcagagctggtcctggggtgcaggatgggcatatagcaggtctcagcctttgatgttccgcctgggtctgtccaggaaactagcaggaaaaactctaatcttggtagtattttagttcctgtgagccaccaacatacaatatttgtaatcagcatttcctacacagtctgatttcctctttgtccccatggtcttctcatttctatggctattaggaatctttccagacaggaaactgctattttcattaagatgctatcagagcacagattcaaaggaatgctacttaaggggagttttattccaaaataatgaaaaaaaaagacataattttatggatttcaccaaatgttctacccggagaagacaaaacaactaagaaatccgtctttcctcccacctcctttcacctacacgattctgttctccattctggctgtggctgtttaagaaagcagatgctttaggaagccagccagggaaagttcagttagttgggtccatgagagctccctccaggcccccatcaggacttttctggctgttaggacttcctgaaacatgagtgaaagtagggagtgcaaagagctggaggcttcctccgagctccccgtttggatgcaaatgacagttaaaggttcattaggcagagctggggagcaggtctgtatcttcatccggtgggacagaggctgggcaggcaggactggttgaggggtgatggtgtctggttttccagtaaaactcctcccatgacagctctaactcccgccaggcctggtttctaagaggaaaatgtttaatctgaaattttatctgaacatgggaggactccctctcccaagataaacctatcaggccattctcctttcactcttgaattgtagagtccactttcattctcggttaaggttaagaaagtcttagcgtacaacacgctggaaatgtggtggtaggtgcagccaatgggaactagggaggatggtgggagacatttagcacagacctcacgttgctctacttaccctgggaggtttacaacaggaggggcaactcttctctgcctgtctcttcaaagggaaacctcgaaacccttcccatcccagaggggccaaatcatcccgctgcaatcccatgggaggcccttgtggccatggcactaatgcacacagaagaagtgacagagttatgagctgaagaaacccccggagttgggtttccagtagacacaggcatgttatggaaaacaagataaataaaagaaaaggcttttgcaccttccatttgaacagggagtagactattccaaaggctaagatacctttcccgaaaggacactccctaatttatttttatgtctccatgagttccccccaaccaggagaaaaaagcaggccaaaagaggtataataggtagttaattattctttttggatggactgttgacaccgaccctttcttttctgacgtggatgcagaggcctccgtgttggtgcagtgtgaactagcactgacagagggagagaatcctgcagcctgggtgtgacgggccatgaacatgtcctggagcccatagagaggactggaggttgagagaacttgggccttgcctggtccaggccatttaatttacagaaaagtacatcaagacccagggagcttaaagagcccaaagtcacatggacaagtagcagcaagcaaggactagaaccaccctttgtttcctggccaccaccctgaccccatgctgcagccacttggggccaccagaatctaagatgaaaacaagcgagtggagaaagacatcttcagggtggagagctcagtagtcctcagcttcccaccggaagagtttataaaagagtatgtcccattctttggggtgactgttctttactcagaaccacttctgtaggactgaggagcagccccgggagtggtgcagcagctgtggagccagtgacgaccctgccattgcagctgctgttctgccaggccccctcaggatgacttcagatgtggactagaaacgttccttgttaaagaactggagaatggaaattgtccaagttgaccacagtacatagccttgttactggagcagacgaagcagtgttatttgctagattttgctttgaaacatcccaaggaaagacgtctcctcttggactgcagtaaaaatgcttcataaagggcagcttgtacaggattggggatgagagtgtgtgtgccacacggtgccagagggaggcaggaggctggggcagctcctccaaagctgggcaacggaggtttccttgtccctgctgctaatctctgattaagcaacttggtgaaaatccaaaagctcttaggagaacaggagtggtggcatttgctcttcggtgcttggaagcagatcatgtgaaaactctaaagccctgagaatcaaagcacagccacctacctggtcaggaagttcaagtgcactaggtgtgggcccaaggctggcacaagcatatccgcccccaagggagctcccctccaggctgatgctgccttcaggctcagacacccacctgctcctgtacccagctgtctgagggctcacaatggtctgggagctgcttcactgtggctaccatgtggtgggaatttttggtttgtaggttttgttttgctagaaatggaggtgagcaagtagacaaaagccccctgtggaagattcctctctgttctgttctcttctgttctgttcaccctggctcagcttgtatcaccttctctcccgcccactgtctcttcctcctgtggcctcactggtctgggccctcctccctgctgctcagcccatgtcctcagtcaactctcaggccacctctgcagacaagcccttgcctcccccgataacccccctgagcctttgggattctcaggcagtggccagaaggcatgctctctggaagagccaggaagccagcccaggaccgggactctcagttatgggaacacacagagtaagaaaacagcctgagtgtcttcttttaaagtctcctcctcttctccatcccacgaggactcttctgtcttgttactgtatgtcttgatactctagaaatttcctttttaagccagatgcctcaggaaattaacaggcagtccaggaactgattcatgggcacccttttcgacttcttttctccttttaaagagtatgacagtgaactcacagctcccctgataagttgtacgcatgcatggatggaattcaagattgtcaggtttttttattgtgttgtcttttggccagaatgtctaattgagctgtgggacttttccagacccctgacacagaagggttagccaatggagagcaggccttataaatgtctttctgtgggaagggccagttggaagaaaagccccactctgggcttgtgaacactaaagctggttctcagctctagagtgtggaccctgggtttgcttcccaactctgccactcacgaggtctgtgaccttgggcaggtcacaaaaatctctgtgcctcagttttctcatctgtgaagtgggaggagtataatcccctatctcatagggtttctgggaggattaaatgagctttattttatagcacagtgtcttagacacatggcatttaatgagtcttggctattatttattttattaatagtatatgaactgattgtgtaagaatagtctttgtatggccacaggtccaatcaatcactaaattccttttgagtttattgtgtaacctttttctttacatggaaacaaccctactttgattacttattaccagtccagatcagtctgatttaaaaacagggctgggtgtggtggctcaggcctgtaatcccagcactttgggaggccaaggtggacagattgcttgaggtcaggagtttgagaccagcctggccaacatggtgaaaccccgtctctactaaaaatacaaaaaaaaatagctgggcgtggtggtgcatgcctgtagccctagctactcaagaggctgaagcaggagaattgcttgaaccctggaggcagaagttgcagtgagctgggatcgcgccactgcactccagcctaggcggcagagcaagactctgtctcaaataaataaacaggaaggctccaggtatcacgtgcattttgccagcttgcactattagtgttgtgtgtgtgtttccctggcatgtttacagcttcataaattagctggctgccctacagcatcaggcagacaggagtgttttttcttaattggcagtgggaaagtggagtcggggaccagtgacccactgtgtgtgattcccacactgagctcagccgcagccccctagaaataggaaacctaccctcagaggctttcccttcccagcatcagcagctagaaccatgggaccccagttagcctgcacacggccgccacggcccctctatggccacaggtttcttcatctcaagcctccacctatccaaggctaaggaggccagatgtcgcactcacccgcacgctgccaaaaaaaagcagcttattttaaacctagtgtgctcccccaattctcctgttaaccagtttctcctgtgtgcttcactttcagatgggtatgctttttctcaagaagaacacggagctgttagtcaggaagaagtcatccgtgcttatgacaccaccaaaaagaaatccaggaagaaataagacatgaattttcctgactgatcttaggaaagagattcagtttgttgcacccagtgttaacacatctttgtcagagaagactggcgtcagcagccaaaacaccaggaaacacatttctgtggccttagccaagcagtttgttagttacatattccctcgcaaacctggagtgcagaccacaggggaagctatctttgccctcccaactcgtctgcagtgcttagcctaacttttgtttatgtcgttatgaagcattcaactgtgctctgtgaggtgtgaaattaaaaacattatgtttcaccaatatttaaacatcagtactagttgtcctgggagaaagggaaaggagttttatgttgcgtgagaggcccatcctgtgtaattggagcagggcacacttgcttcctgttgagttaactcagaggttaagtccaacgggccacatgcagacttcactgtaggcaggttgctctcctgctttgattcctgttttgtgtgtaaaattggcataaacttcttgattgcagtgaaatcacaaaattctctatcggggtggtcaacctgagaacatttatttgaacctcttagccacatttccagcagggcaaaccaactgatgccctggaagagtcttccgcaccctctccaggtgcactcggcccagtcctgccgccgtgtccaggcgcccctcacccccacacctgctgcatggctggccacaccactcagtgcatggcggccgatgggcagccaacccaaacccgcgcctttccttgttccactgcagactcagatacagatgcgaaaaattccttcttccaccgcccttctcgttctgtaaagaaagaaaagaaacatagcctttctgcatatattctaaacgtctctctgcctctgtctgacatggggccaccccacaggtcagagtggtggtagaaccccttcaggactcccagccgtggtcaggctctgaatactcccttcccaacatccagactgctgggcctttggcatccacttacattagaacccacgtttgtttcagagcacattttggactttcactgttgggaaatgaatgaatttataacatgcctgcacagcgaaggaacacacctgtcgctcttagctctagagtcagaggatgagtaaacccagatgcaagagtataggacattgagtggggagaacaagacgaccacagaagtcctcagaaggagaaggaaggacacggagacactgagaggaggacacagaggaatcgccaccagatctttgcagtagaaactctgaaataagccttgagacccagacaattgtcatgatcagcccagtgtgtatgagagcttaaacaagaccttcacacacagttctaattgaaaagaattccaaacatttcagggaaacacctttttaaaaaatatactgacatggtttcctttctgtatcccatcagtgttagacacaggtacctatcagaatacggcatatcctgaattatctaagacaaggaagtgaagagcggaatcactgactttcccaactgcagagtcccacacttaaatctcaacagaacctagatgtcttcaggcatgaatgtgagcacctggagcccttactaaacaacctgcctggagccctgttctctgctctggttgccaaaccagatttttggatggcctaaatacttgtgggcaactgttactggtgaaaaatgggagtggagagcatgttttggattttcactgtggggaaatgaatgaatttatcacatgactgtgcagcgaaggagcacacctgtcactcttagctctagagtcggaggatgagtcaaccctgtaggaatgattgtgctaaattaggaaataacactttagtgcactttgcttcctaacccttttttgtcagaaatctacaacctactgggcatggaaatgatttaaaatatgatctgcattgactaagaaaactcatcctcacttatgaggtgaccaggatgcagagagggcctgaggggcagcagaacaatgcaattcacaggtgaggctccaaaaagggccatttctttctccccaaggtgcatagaacatttttaaatatcagagtacccagcaagacggaaggactgtcatgcaggaactctaacacaaaatgtgcctatgactaacacgacaaaccaaggtgtatggtttctttgcacacccagaaaggtgatggccaagatacagaggagaaacgaaaactggaattgaatgtgcattaggcatcttaactattcatattttgtttcatttgggaactaagcctatttgg

SEQ ID NO: 15474 - DNA, 196714 bp, Human
ttcttgctctgtcctcacagggtggaaggagcaaggtagctctctggggcttctttaataagggcactaatttgatttatgagggcctcactcatctcttgataccatcagataccatcaccttgggagttaggatttcaacgtatgaatttgaggaggatgcaaacattccgaccaaagtcccactgtgttatttaacctaacgacaaggtcagctttgcctaagagttgtactcatgtagtaggagaagtctaggatcagggactggccagggtttggaatagatacacatgatataattattctattgtgaattcattcccttttttctactcacctattcttggtgcctcaccctccctgctttcctgaattacatgatcctatgaagctcctcttcaactgtatctttaagtccagagaagagagtgctggtgagcaccatttcacccttaccaggaaaaattactcctatatgaccaaacatccagggtttcattctgggtagcctgtggaaaatgtgaaaagttcaagctgtgagaacaaatagcccaggcagagccaggggctggcagctctcattgccgaatcaggatttttggataccagctggatatttcccaacctgtatttttttcaataaggggtgctgaagaaatgctcagcaatttctcagctgcacaacaatatgttcctgaactaagaaaccactatgtaattttgtttaaaagcccaggtctcttgtaactgtactttgaagctctcattggaggataagaaggaattgccccttagaaaagacacagttttgttagcctggattgctataaaatggagatgagccaatgggatagaagataaggggcacagagcaagaaaagacataccattacccaggaggaaatcaggggaaataggaggacaagactgagagggtgttcattttgtgttttcggactcatctagctaaaggtagagagaaaatgcaggacttgatatctcagaacagcaggtgaaacacagcttaaaatgggagacatttaaaatggcttctccctggaaaggaaggagaaatcagaagacgctcaaaattgacacgggagggtgtgtgcaatgcccaggtcaaaccgagacctgtggtgtcctgtaggtcagagaaagagcatatcttctatatgtctgaagtaaagcttaatcagatatgagttcaaatggcaataattttaacttgcagcttagacatactgtttgagccttattctgttctgcatatattattatcagagtagaagttagagagcaaactaaatgtgatattaatttaacatttatgtgttatagaacacatagtgatccaatttcatactacgtatacttctccctgatatctgtatctgagtaccattcaccttctggaccactgagcttatctcacctccgtagataggtttatgtgtagctcaatgacatttttggattatgcactctgtgactgagtgatacactttcacaagcaagaaatccaaaagccttgaaaaatggaaagtatgtatgtgtgtgtatgtctgtgtgggcatgtgcatttgtgtttgtatagctcatttgacaacaaaacctgacctgaactgacatgaggccgtttagagcctttattctacactatgtgactcttcatatgttttgctttagaaatattaacatatttgattttagggagcttccctaggctctggcagaaaccccaaggatttcagacaaggcaagtatagacataggttgattttctgtaaagtctaggagacaattttaggaagaaaagtattacaaatatctgcaatttaaatatttaaaaatatttattgtaaatacaaacttgtaaaggcattatataaaaataagtaatgaacacaaatctttgtacccacttggttcaaaatctccattaccatctttggtttgatttttttctctcttcctttttttgtcctgttctttttctaggatgaatcctccatgttcttccagtttggcccatcaattgaacagcaagcttccgtaatgctcaacatcatggaagaatatgactggtacatcttttctatcgtcaccacctatttccctggctaccaggactttgtaaacaagatccgcagcaccattgagaatagctttgtgggctgggagctagaggaggtcctcctactggacatgtccctggacgatggagattctaagatccagaatcagctcaagaaacttcaaagccccatcattcttctttactgtaccaaggaagaagccacctacatctttgaagtggccaactcagtagggctgactggctatggctacacgtggatcgtgcccagtctggtggcaggggatacagacacagtgcctgcggagttccccactgggctcatctctgtatcatatgatgaatgggactatggcctccccgccagagtgagagatggaattgccataatcaccactgctgcttctgacatgctgtctgagcacagcttcatccctgagcccaaaagcagttgttacaacacccacgagaagagaatctaccagtccaatatgctaaataggtgagtgtggaacagagggcacattgatggtggagatgagaggggagcttcaaagactggggttggaagttcagaaactgcaggaagaacagttcaagacggtagcaggttgaagcctggccttgggcatggcaattggtcatgattgggggagtgttttggatccaaccttgccaaaacaactttcatttattgagcacttattatgtgttagatgttactctaagggttttgcatgtttggtttcatttgatcctcaaaataactctataagtcaggttttaacaattgtttctattttacaatacgaaagaataggcttggaggtgtaaattatacaatgtcatgttgcaagtgagtggtcagtttggagttgaacctaggcctctctgatctgtaagtactacttgatcgcaaagaaagatgcaggagacttagaaataagggaggaccagtccgcttacctttggaatgttgccgtattgtagtaagattgaagaacaggttatgcggatctgtagtcgtatgaaggatattctttctttaaagaaacaggcttggtttttgtctcttcctcctccagcctctgcctttaagggtgaggatgctgctatagaggtggcttttacagttactcttagtctggtttgtttggcaagccctcatcttgcataacccagccgtgactgcagtgcatcctccgtggggtattaaatgactctgtggggtagaagattctatactatactttcgtggttttattatttgtataaaacttctatgtaagtacattataaaaattcaaactaaatagaacataaagaagtgtgttttagaaataaaagtgatcttaaatccaactaattggagataatcattgtagaaataattcgtgaacatctttctagatatctctctatgcatgtacatttatatggacataaatacacaatgttacatatatggaaatataagtatacttgctgttcaatagcttgatttctttcattcaacaatgtgttggacatccctttgaaattatttttaattgtattaagatgtacagaaaggtattcagaaaaacttaatgcatactcaggtactcactatctagcttaataaataaaatattaaaaggtgtacttgggatgttaaaaaacatatagtggaggttgagtgggtaacttctagcagggagctggactgcagtctgtagagtacagcttcaattcagggttgaaactcaaaccaggttcacagtagttatatctgtgatccaatcttgatattcttccaccatcaactctctagaggttcctctttccatcatccctaggtattgccccttgcttggcacagattgtcttggtttttcttctacctctctggtttccttctattccagttccatctggggctccttagcacactcctgttttatgcatcccttaaatatgggcacttcttggggttctagaccctcttcctttctcatccattcccaaggatacaattaatgtctgtatattttccaaagtgacatctctggttgcaacctctcccttgagctctaaatttgtattcttagctgtggccagatatgtttctttggattccatgggcacttcgaactcacagtatccaaagctcaacttctatctcttctcccactagtctcccaccctctcctagccaaatctgcactgcctgtcaatgatgtattctattacaaagttacctaaaataaaaatttcctagatgcccttggttccacatccctgacacctcatagtcaatcgtactgtttgccccggattttagtctccccatacctctggaatgccgttcttgttttcatctctcctacaacatcccagtccattttttctcacatgcattactacagggcttcttacatgatcttcctcctccaagttctgctgcttttcaatttacattgcagccagggtgatcaaaattaaaaatgtgatttcatcattctcttgcttaatacctttcagaggcttttcattgctcctttaatgaggtccattctccttaatatggtttataaagacttcagcctcatgggccctgcctgtctttccaaaattctctcatgcttttctctgccttgcacgctaccttcctgcaacactgagcttagttcttcaaaaacaccatgctctctcttgcttccagctctttcctctctctgtcttaaacttactctccagcgtgccccttcccaccaaacacaggtgctgatgttcccttacctgcctcatgctcttcatttgtcagattcctcaggcttcagtcttggcattacttctgctgggaagtctttcctgagcttcagaataagattactgtattatttgccttcactacatcttgtacttttcagataaagccactcttcaaactgtggcaattgcatgctgtattatctcccttccctgtgagctctgtgagagtagtgactctcccatagcactcatttctctgaccccatttcctgcacagtgcatggcacacggaagtgaatgacgccctccaagactcagtgcacacctgctctgcaggagccttcccgttctgctctgttcttgcaagataataaagattcccttgaaaaatgtactgttgattcagttctgtagctttggttttcctcccactgcttttcgtgttaaattcaaatctgattcagattattttcccaaatgtttgctaattacaaccaaagctaacagtgaaggactactgagactaaaacatctgcccaacaacacgaagaaatcaagtgaatgttaccttaaagctcataaatatggcccaggaatgcctacttttaacttaaaacttctgctgggtaaacaatgatctgcagatattattatttcctgcttggcttatgttacattacaatgtaaatgtcatctctgaagcctggtttctaaccacatatctctgaaatcgcaattggttttaacctttgttgccatctctctgaggcctgagatgctcccgtgtggccacccaggaaggtggccctactcagtcctagaggcccacatccgtcttttccagtgtagcagtcctacagggagtaaggattattattcatcaattcctcaggcaccagtgtagagcagagagactgagagagagagggagtccagcttcacttgatttcccaaatgtacggcttaagaagtgtcttcagatttacctacctacttctccactaaagcatttcctctgcaaactgccccagttccctgcctttacttgggttctgcacctgcctgcccgctggacatctcttggatgtctcccttgtccatacacctccattcttcccttatctccattgtctttcttttccttcctctccatccaaatacatcttcttctggttcttgaatgtaatccctgcctgtcttgagaatattttagtatagtttcctatcaggatccagaaaggattggggttgactaacagggtttatagagttagccccaagtctgcagttttatcaccaggcacagcacgctcaaaagcagcagtggaatcaattaggcacattcagttcaagctcctcctacttaccctgctctgaaatcagactctccaccccttcagagctctggtctcactagggtcactcttttaaataacaaaccaagcagccacaccatttagccacagcaggaaatctttgcaaataaaattgctgcaaatggctggttgttttataaggatgacttttcctttggcctgctattctcctctcagcaactgcagtagggaggaaggctctctgggagatttctgggagtggcccagccccagcatgacactagggatgtagggttaggaaagtggcttctcctctcaccttctgaaaaggcagtagcattcataggcccctttccctgctagaagcattgtagggggaggtacaggtctcatgcacacctatccagattacagctttctttccacgtggggaaagttcctaagtctacacttaggggatggagagaagaggttatatgatatacctgaatcccaaagagagacatgtatttgaagtgattcacttgttagttaccaaaggaagaatatatttttatggcataaaatccttctcagggaggatccttaaatgcactatttcaattcactatcaaatgaacattacttatcaggtgttaatccaaattcctcactgataacttcttaactccttgaagcttggcctgttatagacttagtgattatctccagatagattctgggttgcctggaggaggcattttgccagggttgcaagaaaaatacttaagccaagttaaatttgaatttcagataaacaatgaataatttcgttagcacaagtcaatactaaatattgcatgggacatatttataccaaatgaatatttgttatttatctgaaattcagatttcatggggctcttgtagttttatttgctaaatctggcaaccctactttgaatacatataaaaattaattttctgttggaacttcatagcattcatttgtgccttattaataaatatagtacaatgccctatactatagcccaagacatgctaagagagttttattccaactgataactttatttgattgaaagggctggagaatttcttatgctatatattctctaagggaagaattttcttggttcctgagaaaagtctaaaaacgttttggtaccagatgatctgaaaatgtttagaaaatgattaggtaagttttccaaacccatcttcattcccctgagctgggaagaaattgtgagttattaggaggcacccgtctacatttttcatttgtcatttctccaaggagcagttagtggttattttccttctccatgtactctgtaatctctgatggtctgtttctgtcactcacgtgatggtacacctgccacatacctctgtgctctctttctgtcctgagagcccgctgcttctcttcatacagagctacttttggaacttgtagaaagaacggatgctatttgagatagatggatcttaatatagcaaacctcttatgaatcttgcctaattacttttccccagtgtctttagtttttctactcaacatttgtttcctccttccctaaattcttctttcttagtgaaagttgccatcttaaaaggctggatcgtcctggcccagcctttgagggatggggaagagtgactttgaataactgatgtgaaaaaaagtactttcttaggttcttaatgaaagagctgtgataagctcaatcttcctacaaccttgaggcaaattccccatctttggaaccaatgtatgagccagattgttctcatgggatcctcatttgactcttggcctggaaagtgctgaaaggttaaaaaaataaatgaggaattgagtcaattagtttttaggcattatgggcaagagctgcttggtcattacccatcttttatttgttattaaatgttcgatgagtgccagcacaggcagatttatggtaaggcaaacgcatgttataggttcacttcacttaatctaatttacagtgaaacaaccaaaaggttacatgaatgcatagtaataagcggtatagctggcacagtggcttttcatcttattaaagaagtgcaccagagtctaaggaaagctacatttttatgtatatgcacaaaaatgcacattttaatgcaaaatgtttagtaaaatgacacacacctgtatatagagggagggaatgactttatctgctcagtagtgtaaaaggatatataagttgggaaaaataatcgaagaacctaataacctaaaagatacattcaatgcttattgtagttcaggcataacaatgcatgtgttagctgtgtacagaacaatcattgaatgggaggacgattcaaactcttctgttttcctctagtctttcacattcctcatatcagacatatagatggtcatttcagtaaatgattgttgcttcttctccctgaagtcaaacttgtgaaaggcattttcaagtatttttaacactgagaccccctacagtattctttccttaatcactaattctgcggctgacttctaagatttaaaactcacccataatataggtggtgtttctcttctttgtctcttttttgttattcttcctctttctcctcccttttatttttctcttcgccttcctcctttttgcatttcgataaagttcaaaatggattcctatagtccattctgcattgctctaaaggaatactaaaggccgggtaatttataaagaagtttatttggctcacagttttgcaggctgtacaagaggcacggtgccagcatctgcttctggtcagggcctcaggaaacttccactcatggtggaaggtggaggggggccggcatgtcacatggtgagagagaaagcaggagagtgaggggaggaagtgccagtctcttcaaataaccagctctcacatgaattaatagagtgagaactcactcatgaccatgggcagggcattaagccattcatgagagatccatgtctgtgacacaaacacctcccactggctcaatctccagcattggggtcacatttcaacatgggatttgggggggacaaacatccaaactgtatcactcctttaaaaaattagtgtgatttggaggagagggcaggggatacagagggtgagtgagtggggaaagagttacatttaactgaggacagtgagtggggtggagaatgcacatctgtgcaggggaagaagatacagacggaatatggtctatgggaaggaataggatggtcttgaaggcagaagcaaacccgagaaggttaatggctctcagtggagaaagcagacaagcctcattctgaaaacagattctgcctcagaaaggacgtgggttggtgacaatggcatgggttaaaaagcgggtcataggtatatatttaaatcagccccagttgtcagccaggctgcgaaagttatgaactccatcgttagttgcctttttgagtacttactgcatccccagcgctgtgcagttacctaatttgatccctgcaaaaatcctgatgcaaatgtcctcgagagacattccctgatcactctgtttaaaagggcaacttgtattccccaccctcccaagcactctctgtccctttctcctgctttattttttgacatagcacatatctgatatactgtataaattatatttaaaaaattttttttgtctccctcctcccagcagaattcatgctcaatgagagcaaggtgttttttttaacctttgtattctcagcacagtgcctgataagtaggcaattgataaatatttgtcagattaaaaagcaggaatgaaaagacaggaatcattattctcattttatatgtttttaaggaacccgaggcccagggatccccagctcaggctgtgtgatgccagactgacctgatctgccttaggggtcctggatttcagcccctcactgtgcagcacattaaggaagctttaaagaaagctcagctttccttagcatcaaagcattagagctggaagagtctttagtgctcatctaatccaaccctttcaatgcatgtcttcttaatgaatagatggtaggatggaatttacatatgtgaaaacacagtctcagagcggtcactcctctgttggaggctgggcaggcacagaagccaggtgtcctgatggcaggagcggtgctctttgctagagcatgctacctctccactgcttggccatgtcctcagaagggcaggctggcaggcagccagggctttgctgttaacctttgccctggcctgccagcgtccccaaggctcttgctcccttggttcttacctagacaaggatgcaaattcacagttaatgggaattgaagctggtattatttaggaattgagtgggagtcgtttctccatctgctctctcttcccaccagaggataaaggctgcctgggtgggggtaaggatggggatgagttgccagaaagctggagtgctgtcatttctggttacagacatggactggaagcctgagtgagggctggaccacagctgtgcaaggtcaacttaactaacatgagcttcccgagagcagagatggttgtgtggcttttatatctacatgagatcttgcacaatttaaatagataatggtttgagtctttctcttcgtttcctctcaaatggtgctgtcagggatgcataggtggtcatgtcctggagaaaattctccaggatctgatgtggccgataaggatttggaagaagcagggcatttaggatgactactgagggatctgaacagcactgtagatagggcacgggagaagccaaggaagatatgtggcaggagctagcaagagaaccttccctcggctttcagaaatttttggtggcgcgtcctcttccgggaggacatggtggggttagctcgcccagactggcaccagtctccaagctgagctggctggtcacacatgaaggaactgctgctgacagattagggcttcccgctgctgaaatctgttccctcttgtccagcttccagcagcagcagccggccgggggctgcctacagcttccctcaatgcccaggccttttctttccctcattcattactgctccacaccccaccctctttctttctttattcttttctgtctctttctttattgggtgttttgttcattgatcttttgctgcccctctcttctttagccagctttcatttaaagcttttaaaacctttcttgcctttacctttctatgttcataaatgaccgcctgtggaattcttgcacgcacacactcatattcatgtgtgcatgtattcctcatccagacagcacctatttatgtatatttgcatttgtcaagtgaagagagaattaagaaaactggataaaacacttttatatgttacatttctctaatgctttctattgctgagactatttagatgattacatgagaaaggttgaatatgggatagaagttgggaggaattcttaaaaaatggcttgcctggaattagctctgatgaatatcaagtaaatatttccttccaatctgattccattgttaaagtcttgacggctgtaaggatggtcgctaaatatccctagcacatttattgtttgggcgaaggagggaaacttagtagtcaagtggttttataaattgttgatgagcctataaatgaatcttctttttctaaagttaagttctcccctgacaagcaacaggaatagccatggaaaccaccctgtgacaatatggtattcattgtaagtggtccttttcacaattttccaaaagagattatagatggggtccagatggaggtaggtgtcaaaatacatttagtgttagacaaaaaacccaattatcaaaaatttcgttgttcatcatcatggctaataatgatgatgattaaagtgaggattttcatacagataatcttcttgtatatcgtctcactaaatcattataacaaacatgtgaaggcttcttttattcactgcaaggattggctgcggacttcaacagagaaacctcacatacttgcttcctttttgttttctcagaggtatttccagacactcccattgactttcttcctcccctgcttgaaaaaaaatctttcaggcacttttgtttaggcaaaacagcacaatagagcattattatattacagttcactattacacagatcttaataatgtgtcaaatttccctcattattgactatagaggacaaggtgtgtgtgtgtatgtgtgtgcatattagagactatgactcaaaatagtggactccacaggctgcacggggtcattgtcctcacttctgtcacacgtgctcacatgtgttcacatggagacttggcttttttacctaaaggacaagaggtcacatattcaacaacctgatgtatctagaacataaccaacagtcatgaagaaagcagaaaagggctctgagctaaaatccctgacacaaaactcttgccctaaaatgactgctgtttcttgtcatacagagtgtcgctcaaagcacgtttactctaattttacacatacttctaagaagcttgtgggcagttgggttatctatggtgtggagtcccagtaacccagtttaaatgagatatgtgagcatagttaggtggtctgtccagagctgggatgacagctgcatgtcatcaggactcagatgcctgctagctttccactctttcatccactgggtatatccttcatccccatgcctaagatggctgctggaactccagtttcaagcagcagattgaagttagaaaggaaggaaggtaaatcatttccctgtttaggaaattcccctgaagttccacactttgcttatagtctgctggttggaaatcagtcaatggccacactagcaacaagcaaaattgggaaatatagcttagtttagtttttaacctgggcagtaatgtgcccagttaaaaatcaaagttctaagccgggcacagtggctcatgcctataatcccagcactttgggaggccgaggcaggcagattaccggaggtcagggggttgagaccagcctggccaacatggtgaaactccatctctactaaaaatacaaaaattaaccaggtgtggtggtgtacatctgtaatcctagctacttgagaggctggggtaagagaatcacttgaacctgggaggtggaggtttcagtgagccgagatcatgccactgtactccagcctcggcaacagggcgagactctgtctcaaaaacaaaaaaacaaagttctgttaactagtgagagagggccaaggccatatctttggtagacaactttgagatatttgtttatatgatttcctagataacaatagcttaggtataacagacatgatgatgaggatcagataggcaaaccaacagcattaataaataacagaatggaaaagagtggaagatattagaaaaacccagcagaaaaccttgaaaagcagagttgtataacaccatttggggagaaatgtcatctacgccccagaaagcatataccctgcataaaaatccctgtatagcaaaaaagcatagtcattgttaagtcatcaataagagcttaaattatatcgattatcttaggtataaaaagtcagagaactctgtaatgcctttctgaaattttccattaaaatgcttcctataatcaagaaaaagcctgtactttaaaatactaagcttcagcaatttagaaaatttatttttaaaaaagattattgagtgaatactatgtgccaagggctttatatagcataatttaagtttaaaagtattgtacagggatatgattgcctccaatttttagataaactgagattgcctgagtgaggtggctcacacctgtaatttcagcactttgggaggctgaggcaggtagatcacttgagaccagcttgggcaacatggcaaaaaccccgtctttataaaatacagaaatattaaattagccaggcatggtggcatgcacctgtagtcccagcaacctgggaagcttaggtgagaatcacttgggcccaggaagatagaggctgcagtgagccatgatcatgccactgcactccagcctgggtgaaagagcaagaccctgtctcaaaaaaataaaacgaaagcaacaacaaaaaaccccaaaccccctgagatccagaaagattaagacttttgcttactttgtgtttcaaactcaaatttttatgaattccaggcgtactttgccccaggttatccatctttctatgtcctttgctaaagaggttgagtgaattaggaatgactcacatgtatataaacatatcattaacctgtgggacagggtggtttggtaataaagagtttcctgtctgggcgcggtggctcacgcctgtaatcccagcactttgggaggccaaggtgggtggatcatgaggtcaggagttcaagaacagcctgggcaagatagtgaaaccctgtctctactaaaaatacaaaaaaattagccgggcgtggtggcggatgcctgtaatcccagctacttgggaggctgaggcagagaattgcttgaacccgggaggtggaggttgcagtgagctgagatcacaccactgcactcacagagtgagactccatcgcaataaaataaaataaaataaataaatagtttactttcttggattctctgctatttcttgccctaaagactagaccatgacacatctagaatcagcctgggagtggcatccaggacacacatggtaaagacttcccacactgaacctgctcatctcactctctgtcctgaagtgtgcccatctctacttgctggtcttgctctgatcttgctgatacctcccttttcctaatgggaaggaggattattttttcttatcctattcccaaatcctttaacccatagaggaaaaaacaacaacttgtagtctttgcatacctgaaaaatccttggaactgaagcgggtggagactttctggtctacaacctgccaaggttcagggagattacagatgcattgaaaatactgtcagggacatgcaatagaacaaaacaagaccttggcctctgccatgatttacaaatgtcctccagtaccactattcatttttgacaggtcagataaatttggatttgtttaagccttgtattcagctggagattggagaaaagttaaaaaaaaaaaaaaagaaaatgctattagaaatgaaagaaacgggacatgtggggcccacttttctgcacttcacaaaattacattcattcttaattcactgagtgacacatccagtaggaatgtggaccccctattctgtatgtactgaaccctgtgccggatgccgggaatacggacaatacatagcattcatctgattgtcttcacaaggagtggagtgtccacagatgcttttagtttgctgtttagacttatttttcttgaaatataaagtgaattgcctaaaagactagcagaatgagcttcaggaacgaagaatttcagaatgttagtgaaaaccatcacgaatttcctggtacctctgatccaaggccatggaggatcctttctgatagagactaagagagtggagttcaggagaaaggaaccattccaatatagctgattctagtttgattctctaatctcattgtctcagtttattggccacctgcaaactcaaaacttcatgaaagaatattctttaggaatagaccagagtccccttcccccacgtgcatacacccacactttgtgggctcactcactaagtttaaaaataggaaccatggtgttgccatgacgcccggtgctactcagcagcgttccttttccctttgatgtgattcctcttcatagcatgatttagtgagaatctggctcagagcggcctctagtggctcaatccttagggatgcgcttccttccccagcccagttccaaattcagcccagttccaaaattaaccaccttagccaagttggacacttgtgtgtttagaaccattctccatgcaatcagctattttttttcagaatctttctcatcagccacaagtattacaccggggagtacctactgagtgctcagaagtgtgcggaacagcccaggtattcaccatctctctggccaggagagaccagcattaccccaaacatttggtgaacagtagagagcagtggcagggaagctatgtggtagaggcagtaatgttgaataaagtaatcccagtaaaataggttggttaggatcatcagaagttagctttttttttccttttcttcttttttttttttttttttttttttttttgagacggagtttcactcttgttgcccaggctggagtgcaatggtgcaatctcagctcaccacaacctccgcctcctaggttcagcgattctcctgcctcagcctcccaagtagctgggtagcatgcaccaccatgcccgactaattttgtatttttagtagagacagggtttttccatgttggttaggctggtctcgaactcctgacctcaggtgatctgcctgtcttggcctcccaaagtgctgggattacaggcgtgagccaccacacctagccacatttttctttttcagatacaagagtcttctaaagtgtatcaactgatactgactcaacagcctcagggatgtattgatgtgctgacttcctcccgtgctgtcttcaccatgttttcatttttctgtgttttgagttccttgtgtcagtgcttctcagtcatgactgcatgttaaaatttcctgagaagctttaagaaactgtatacagaccccaaggccccacccagcacacattctgatgtagctgcactggaagagggtaagggcccgggaacagacgtgtattaaaagcatccaggttgattcctaagggcagccaggagttgtaaatcactgttctccagtctcctgtcattttttttttacctcggttatcagaatagggtaaaatgcaatgatagcattcacatgcatttgaacttggtgctcttgaaagaattccttcctttcattctttcctgactagtctgaaaattgtgatttccactggtgctatgaacttcaaaatttggaaagggtacaggatatgaacatttcatcatggtgatcctcttgcaggtggtcatgatttcctaatttggtttctgttcctgttgctggtacttcatgagtctattttatgcagagggatgagttttcatcagtaaaactggcaacatgagcatcaaaacaaatttgactttaaacagcatttcaattcctctgtacatagattataaacccaaaagaaacagaactttgaagtttcaaatttgatgtgtcggctggccttgatgagaaattgatgctttgctaaattttggagtacacaagtggttttaaaaatgaaagttattagcactagaaagtgatgttctttgtattactacactgttattatatttaatgaaatggctttctgaagtactgcagataaaaggaaaagcagtgtttagaataagacacagggtaagtgccaaggtaagaaaagaaatggtgggttgtctttatcttacagtgtttctcctggaggctgggagagtcctccttcaggggaaccagttgagatggaaagggtttgtaggtggatgtgtaatgtgtggcatttttgtggttctgaccgagcccaatcttggcaatgtctactgtggacaagcaaggccaaggtatagctttgaaactgtattaagaaagaacataatttttcagaattatgggtagggtaatgtaatctatctgattaaacacttggaaactttacgtttgtctaaaggaataagaagaagaggagaaagaaatgcttattactattgttaaagtgctttatgatttctgagaaaagaaccatggcagaacctccaggtacacttaacaagtaggagattattaggtaatttttatcattggcttcaatccctttcttccactcatccacctatctctctagcatttatcacaaaggtgcctggatgaacagacaccattttgtatcacgtccttaaggtcatcggacttgagttttgtggaatgagcaggaagaaatcaatctagagtgcctgttcgccaaacttcagatttcacatttaagatattatatgaactttcagccggacacagtggttcaagcctgtaatcccagcattttgggaggctgaggcaggcagatcacaaggtcaggagattgaggccatcctggctaacacagtgaaaccctgtctctactaaaaatacaaaaaattagccaggggtggtgtcaggtgcctgtagtcccagctactcaggaggctgaggcaggagaatggtgtgaacctgggaggtggagcttgcagtgagccgagatagcgccactgcactccagcctgggcaatagagagagactccatctcaaaaaaaagaaaaaaaaaagatattatatgagctttctggagtctcttccccataagtgtaatatgagggaagaactaataactattaagaagcatttattaattgccacataatgcatgttcctcttttgggcttgacaaggaatttattatattgtatgttgcatgttctttttcttcttctttttttttttttttttgagatggagtttctctcttgttgcccaagctggagtgcaatggtgcaatctctgctcattgtaacctctgcctcccaggtccaagctattctcctgcctcagcctcccaagtagctgggattataggcgctacaggcacgcaccaccacgcccggctaattttttgcatttttagtagaaatggggtttcaccatgttagccaggatggtcttgaactcctgacctcaggtgatccacccgccttggcctcccaaagtgctgggattacaggcatgattggcccggccatatattgcatgttctaatattgacctggcttctcaaggtttgattgcaaatatcttacgtaggcagctaaatccttgttttccatatgaacaatgactgatattgtaagtgagattatgtgtttagctggctttttttttatttgaaagtaaatagacgtttttctggatttcatatcaccgacacacaaagcaatactgagttctgcatttgaggttaaggatgggtgaaatgagatgtagctactacattgcatcctcaaacaatttaagacctgggaattttagtgggcaagagtctgtgtccattattaatgttccttgcacttgacaggggtttcctttccttggttgtcattgtttccatcttgcctgaagtgatgtcaacctcatttcatcctggctatttggtgttgtcttgagaaccagaaagggagaggaagaggcaccatagttaatctgcccagagtgcctgactgcactggctgccatactttaagggtgacctagaaatgccatatgctgtcctggaggagcagaggagctgagggtacatccaggagttcagtggccacctgtttattcccgccaccccccgccccccgcttttctatgggagatgatagttcatgtttctcagtgtcaaggaaactgagaaatgtttctttttctatttctattgcaaaggtaaaagtgagaagtgggaaaagcaagcaagcccagcattcaattcagccttggaaatcttgtgaatcccgtgtaaaggacacacatgctatgtctgtcagccctggcagtgacacgtgcttcagattgaggttatttttttccaaaaaaaaaaaatcctgtcttccattccttccgaaccctgggaaaggatcctacttctccacactcggttgtcccagctgtcgtatcagtcattctggttattggtaagcagcagggaaatatgtctataagaaattgacaggagacataaaggaacaggatatatctgatgagaaggagggatttcagaaataaataagattagggcgtgatcctgtaatgcccaggtgcttagtcccctgagcagagccctgttgggccagcatgcattgcattggcccattctgatactattgagattctgctgaaaaagcagcagcatcatgacaggagagcagtctgccttaacatagcagcattatgccatgagacaatgaaaaccctgcttttatgaatttaattcagggaaaaggaggttgactccttgtaggagtatatgcttaaaatttctcaaatacagtatgctttccttcacaaaggaatgagacccaaggcttgaccagacatcaatttcaaaggcatgacaaagaccccaacaagcatcttccaggaagctgatgtctagtcatcgcattggatgataaaaaacctatcaccttcatgtctgcacttttttagatggaaacattatcattgaagacttcaaagtgtctatagtagtctttctcaaatcaagttgggtatgagaaagaagttgtaaccatgttttattggctcaaataagatttctgtgtgctgcaaataataaagaattggatatctagagcagaaacctaatttcctcacaaatctctgatgacttattttatccactggatgtggtccacatttcttggcaagccataaaagacctttgaatatccggccttaaccttcataattgggcttatcttatttaactaccctctcctccaactccccaccttatgccaacatacactgcttgtgatctcacaacatcaaataacattactggccactctcttagtatggcagtcttttaccccttcatgcatttgcataggctgttccttgtgatgctcctctctttcaatttccctggaaggacataggtgtcctttaagatctgactcaagtgttgcctcctctctgaagccttctctgacgattccaggcagaattagtcattcctctctttgtgctcccatagccctttgttcatacctatggcatagcacatagatgtgcaaacagttcacattaaaaattcattatggtatccaccctaggattcatggcacagtagacacaaacattttctattgaatgaaaatgtgaatgaatccataaagaaataaaaggtggggtttgtgcacgtggagtacaaaacctgattattatttttaaagattaaatatgccatcttcatgtgtgaaaatgactctttggattcattggcagaagcagttaggctttgaactagttttcagcatttgctatgtgcacataaagcgttcccatggtctcgggctttataatcagtaacgtacttggaagggattcctcactgctctttattccttttatatctgcatcagtcagacgcccatcaccctgcacagtgcccctaagttaagtcatcctttcttgccacctgcagagtcactatcctcattagcttgtgcctagatttctataacaagctgctctatttcccatatcttgaatatcacaaaatcatctactatgaattttgtatttttcaagtatcatttcggtcattttactcatgtgattaagtacctatgggggcttcatttagcaaattgaaacttagaatggaaattatcatccctagatatcatcaacttgatctcaaattactttccgaaaggaactgttctctaggcagacccttctcttttccctccagactgtatggtatagtggcaagaagcaagagagcatggttcttttcccagctttgtcactaatttgctgtgttaccttaggcaggcaagtcattttaccttttcagactttgattggttttcttctctgtaaaataatgtcttacaagagatgcttacttggaaagaaagaatttagaagacgtgagccctacgttccttctgattccaaagttttttgattttttgattatatgaggtattgaacttctatgtttctttccaaccctgtgatcaatgaagaggcttgaagagattttaatccagaacgctggcctcatttataccacaatattatacagcagccaacaatgtctcagagggggagtgaagattaagagcctctacgcaagcctacctcttgcatggatgtatacaacaccaggagccatcctcttttagattggttttaggttttcatttagccaagcttttgattcacttgataaagagaaataaataggccagattttattttctttgattgaaaagatttattttatattctccttgcctcagtgaaccctaacctacccagttagtttaattacccaattctgggctgtctgagtccttgattctgctttcctcttctcaggcctacttggtagagcttttacttttggggaagtatagggtgtttatgacaatgaatagggtaaaggtcaaaaaaaaaaaaaacttgaaaccattttgggtcaacttcttttacctaataggttctgctaatggaattgttcagcatgcccaaggttgagttttcctgatatacccccataaaccttgtcctccactggttttctccaactcaggggaatggcatggttatccttcctgttgcacgtaccagaaattcacaagttattttttattctttcctggccctcactcctttcctttaatcatgtatcccaaatctgttcacttcttttcatgttctctagagtcctggttaaacttttaatatatgtgtgtgttcctctaactagactgttagctccacgttggcagggatgtgtctgtttcactcaccattgcagtttaatgcttagcactttaatgagctcagtgcaggcactcattatatacttgtcaaatgagtgaattaacttaagctaattgtgaaattaagcttgatttgtctatggacttgattttctctgggctcttggattacctattgaagattttgtttcagattctatttttagattctttatattttcaacaaacggtaaagtacctactttgcaaagagctatactcactgtgaaggataacacaatagaaaagacatgatccagctcacttaagaagttgagtttagtcaagaagtgaagtccccatacacaaaaatgttgagtaaacatgaaataatatgattacatgtctcacattggtatagtacaattcaaatgctatagtagagggatattgtctaggtcggctgaagttacagccttgatacatcttggaggggttggagtgacacttgacctggatttcaaagaacgtagaatacagaggcccgagggaaggaggagtttcttcaaatgggaataatagcatgaacaaagatttggacttgacactgaatgtttatgtgagggttatattggaatcaacttgacctgaatggaattgtgaacaagtcatgggagataaatgtggtgtttacaagtggaacagagttgttcttttgaaaggcaacaagctatcatcagaaaggtaccatattgggagttggcatggaaatatgtgatcttaattaagtcatttattttctccagctctgttttctcatccaaaaaaaaaaaaagtgtggtaatgaacatgcaatagtaaagggttgcattacattaaattttagctcttatatgctctcattctgtaaatgagttcaactaggcaccattagtgtatttttgttttaaatcctttctctatgaaacagcctagttagttcttgaatctctacccatggctgaatgagtgttactattaaccaataggtcatggagaaccctgaaaggtagattaatgtcatttaactttactctggaaggtaatcataaaaaacacttgatgaaatggttatgataaatggttattttaagaaaattaatctcattattactatatgagagaatggggaaagagtaaatcaagatggggaggcaagtcaggcctttttcaaattccccagatgtgaggtgatgagggccagaattttggtggccattgggattgcaagataattttgaaggacacttctttaggatccagtaatgtcctctgtagagctaatacaggggacaaaatggtcaaagctgggcttttggtttcttttgttttttgcttgtttgtttgtttgtttgagatggagtctcactctgtcaccaaggctggagtgcagtggtgcaatctcggctcactgcaagctccacctcccgagttcatgccattctcctgcctcagcctcccaagtagctgggactacaggtgcccaccaccacgcccagctaattttttttgtatttttagtggacacggggtttcaccgtgttagccatgatggtcttgatctcctgaccttatgatccacccgtctcagcctcccaaagtgctgggattacaggtgtgatggcttttggattttaagattgaagggatgatgatagattggtggaaactgagaagttggagtgggaacttgcttttcacagaagctgcatcaaattctgaactgagggctggacacattagtgaggatgtcttgtagtgcctacagctatgcagtctggaacgtggaattacagatttaaaatttatcagcatagagtggatacaactgtcagtggcccagctgagaaaagctgagttgtctcaggagaagagtatctagaaaaaagtgagctatggactgagccttgaacatcagctatagttccagggcaggaggagccacagtgttcagtgaaggacacaggcctggtggagacagggaaggaggattgtggtggtcagctgtataggtgcacgtgttattaaagccaaaagaaataaccattttaagaaaggaaaggggtttagtcatgtcaaatgtggtagagagggcaggcatttgtgggccaaccttaccttttatttccctttttttgtacacttaactaccattaatcagggattaattatttagttttttaattattctgctcagttgcctaatgtttgatcattttataaacagcataaggaagaaatttgagggaagggaaagattcaaaccattttccccctattacgaggtgtaggaaaaatttggtggggaagaaacttaacactcactatcgcctacaatgagatttggggcccttgacacatgattagatgccaggggtctctcaacatcctggcccgtatacttgttagctgaatgaccatggccaggttcctaacctgtctgggcttgcttcttcatctataaaaacggaggcaacactaaaggctttgtactgtatttgtgctcgttaaataagaatgtatacaaagtgcttagcagggggcctggaacaaagagtaccaaaacacagtcagcttgtttggttattagtatctaattttgcttgttttattgggctatccctgctcatattgacattaattattgataattgaataaaacattgtatttggaaagtgtaatcattaaaaattgtattttctttttctcattttttgaagacgaatggatttcttccattatagttttataagacataaatctatatgaaatctgagcaattccttgttcctgaattttccctgccaagggaccccagcctggggatggcacctttatgaggaacagtgaggaagtggcctggggatgcttcacgataggaggaaggaaattatctgagtctctcagtctgaagtgttttactgatgttggaatggggaatcatcctgaaattaaaaaaaaaaaaaaaaataggtgtatatttctcagagcaaagatacatgtgctgacaatttagattttttgcccagagatgctggcattttgtttctgggggcggttcttatgtttccaacagtgttcccactgcatgccatgttctctcctcctcacccttatcctcccacccccctccccatatggcttcctctttgtctcgcccaccctactcctggtttctttctgtctctctcttctcctgtagttatttcctttcggcagcaaaatgaatccttcacagaacagagtatgactttcctcaaacccattctccatctctttcagctatttcttttctggaagttctcgaatgagcaagatatctgggagacagtctttcctacatattctgttgcacttctccagtgattctctttcctctggtgattcatttggctccattctctgcctccatcttccccaagctttctccctaatgactcttccttccacccgcctccaagactgtctctccatgaacaggctacacccagcccaagacttaacctggccttgaaaatcttcatcatacaaaagctaagacagacagagagctacataaaaacgggagagacagaaggaagataggactctgagaatgagttcggacatgactaaagatgacccaaacagctgggtgcagctgtgggaatggcagtgcattatttgtgataaagagttatgattgatagtgcggtacacaaggacttatctacattaacctcctccccgccactcccatgctgggaataaatgttaagttattgttagcatattttgttttctttgtttaaagcacaggatagctagtgctaagtaagaaaaaaacagaaaaataaaacatccctcttagactttaactctgtctctgacttcatctctttctcagatggagacacaataccgtaagtgagaataccattgtattatgttgtgtgatttgtgtgagaagatacttgtgtatggagagagttttactgatgggtgctgagggaggtaagggtttcttttgaataatttaataaagaacagaaaataagtgaatattagttctgtgtgaagaagagtccagaggaaataaatgagtaagaaagtgattatcaaactggtaggttatttgggcattctgactagagttaaacaacttacaggtgactgttggtaatgctggcaatagcaaattatactccctctgtgcatccatccacccaccaatccttccatccatccatctaattttcactgagcattggctgtgtgtacagtcagtgatagatgctgtgggagatctatcaagtttacacctggttcctgccattaaggaatctttgatattgaagcacacacaaagagggtgtgaattgccatctcccctctttggcctttttctccatcctttctctcttccagtcttaaaaatcgtctctgaagccccaaactacagctctctgtgtatctccttaggtatcagattacctacaaaacaaatttcttatttttaaaacatatataaggaaaatattctgatgtgtagggagttgtgggcatcctttggtggctggatgatgaaatattaaagaactactaaacagtggttctctaaaactggttgaaaaaaatttctagccttcaatattctttttcttctccctaaaagtttattggttcccataccccaaagttagtcctacccaaccacaaccctgggaggactactcagtgcatgaatctgagtcgtgggctgctgaatgaaagcaaagtgattgcaatctgaggaggtcataaaatcgtgcattcattcattattcaaccaccatttcctgagtgccaaccatgttactggctttgtaaatacagaaataaaagaccaaggtttctgcccttgaggggcccacaatctccaacaatggaggtggctgggaaaacagccaaaataccacatgtgatcagttttacataagctttactcacaatgctacagtaagagctacagtgaaagggtcaatgatgcatgctatccatgcccaggagaaggggtgcatgcagaggtaggtttccatgactcacagtatctcctttattgacagatttacattttaccccacagagctattatccagagctgttaataagtaggaacatggtttgcataagtaggaacatggtttgcatttcctagcttttactcacagccttccctcttcccagcagtgatcacagcatcaggtcctcccaccttgagaaacaatgaccatctgagtctctatccctgtcaccatttcacaaactctgcagaaataatgggtaaaacattgtgcttttaacaggactaatcatcatcattgttgtaataacgggatttatatatttcttacaatttgcaggtcccctcagctgtaacaactagatttcccagagagttaaagaacaagctgtgtcacatctaatgagggaagagctagcatttggatcacccaatgctaaagccccaaatgaccaggtgtaaatcgttacaatctcaagtgctttttctatacagccttgataaaatgaacatcctttgtgaaattgtaaatcttcagatcaattcaagaactcatgggaaaccaccagaaaacatagactagacatgagaactgttgtctggaaccaaggctgtgttgtatagcaacaaaaacattaaactggaaatcagaagacttgcatggcagtccacaccctaccttgtcgtggcatatgtcacttagtttctttgtgtcttactctccttatttataaaatgaagggaatgggttagacaatccctagggttaagagtgaagaatttggagcctcttacctatattcaaatcctgagctctgccgctttctggttgctctagttctttccatttcttacacaacttgattaaattactagttatttaatcttgttgagcctcagtttcctcatctgaaaaaatggagataataactgttctgtgaaaggattgctccgataactaattagttaatagttttactcaggagtggaaaaccaaacggtatgttcttatttataagtgggagctaagctatgaggatgcaaaggcataagaatgacacaatggacttttgtggacttgcggaaagggtcggaggcgggtgagggataaaagactacacattgggtacagggtacattgctcaggtgatgggtgcaccaaaatctcagaaatcactactaaataacttatttatgtaaccaaataccatgtgttccccaaaaacctattgaaataaaaaagtaaatttaaaaaaatacatgaaattataaaaaagaagaaaaagttaatagaaatagtatgtggcttgagtaaatgttatatatttatatatatatttataatatataaatatatatatatatttctttcttttttttgacagagtctcgctcttttgtccaggctggagtgcagtggcatgatcttggctcactgtaacctccacctcctgagttcaagtgattcttctgcttcagcctctcaagtagctgggattacaggtggccgccaccatgcctggctaatttttgtatttttagtagagacaaggtttcaccatgttggccaggctggtctcaaactcctggcctcaggtgatctgcccgccttggcctcccaaagtgctgggattacaggcatgaaccaatgtgcccgacaatttttttttaattaaaaaaaaatattggccccttcacctctaggctattatgagtctttgaagctttgatatttctggaagtggagaaagaatatacaatttacaaagtagctagtttaaagaaaaatgctgaaatggctaagaggtatgactatttcagcaggaaactcaagaaaggatacagtggaataagaaattagcaatttcatggatgtaggtagaaattcatgggtagaaatctcagtagggaagcagagggaagtgatgtaatgctctggaccttccagaaataaagcagagcaggtgaagatctgcaagaaactccagtctggtgaaatctccaggagagtcattgtgaagttcattttgcagttaaccccatgcgctcacctctctgcccatccctgtgtcctgctctgatttctgggctccttcattctggcagcatcagaacttagggttcagtgaagttggggtttctcttcacaaaaccctgggccctcttccctggaaattgctccatttcttgttaagcagagggaaaatgaaaatattctagctgtctgtattctataatagttttgtgatgcttttccataaattggtataaacaaataaatacaagctataagaaggcagaagtgtaaagagtctgtgtatccgatctgcttggtttccctcattcttgatcaagtcctgtgtcttgctcatgctgtggcccaacctgtaactcctagctgctaatttagctgaagaatcggttgtttaaaacagggaccatatgccttagcttccccagctgtatgactaggagaacaccttgcaaatgtattgtgatgctgaaataaaataaaatgtgtgaactcaccaaatacagtcctgccaccctactgcctgactcctcctcttccctcttacctgcacatcctcctccacccctcctcttcccctttctttcctctcattcttcttttcttccttgtattcaaaatgacacaatctggtgactaattcctgatctgctctttgatttccccagaggaagaactgatccctccaggggacactattatcctgaggctagatagtgacaacggtgtgctgagaaataaagagcagagatttgcccaaagaagagtggtttcaggaggggcttttggtaggcacagagcacaagagtttgcaattgctatacaagcattattgctctgtctcaaggaagttgtttgcctttcactgacatctgaatttactgtttcagatgaagggggaagaaaaggaggagcaaattatctgctggggacctgctatgtcctagacaccatagtagaatgcatctggcaataatttttggaggtagtggtagggccctgtgcagtcccaggattatttagcttgcctagaatttctacttcttagaagcagcctgtcttagcctttgtgcaaggagtttatatgggaaacaatcttagggagcagaaattagggagtaggagagtgaatgtggaagggggtaaagccaatgataggagccatattgagctgaaaccctgtgagtgacaggtgctggatcccacaagggcatcctaggagagccttcagaaatgcatcttaggacagagtcaggtaatcaattttcagtctcacataaaattaatacttccattttaacattcccaccttcttaatcttctgatctctttttcaatattttgccaaagtcttcccatcatttgtcacctcatcccctaggccatcaacccaggagtatattaggaatgcctataggcatctctgcaaggagtttgaatatcatttcacaagaaagtgttgctgtgccaataaattctctatcccattctacctccagtctaacttcctcaaagttcactcctacatgtgcttcctgatttctgcaaacctgtaattggccgggcctttccattgcaattccttcagtatgtaaactatttcctcctagatattcatcccttctagggactgtattttccagctgtagttgtgctatgacctggctctagttattggcctgtagggactacagagagatggggtcacatattgaggacaggagtcagaatgagaggcacctgcttcagatgtgttctttacagtgtttttaaaggcagacttatttcctttggcaagaggggaggagcttttcttgccttctaagaggtttcaggaaaatcctctcttactgtcttcctaagtgtaccacgtgggtctccaggtcccattcttttcctattggaatttcctattagaatttccacaaaggaggaattccaaggttatgcatttagtctctttggtagcattgccactattagtttttttcctctggatctgattttcagcaggatttcctgagttgatagtcagttcatttgattcttccagtttatttttttaagacttgaaaatgtattgacaaagccagccaactgctcatgtatttttcaaataccagagccaccacataacccaatacgttaccctctaccactagcttatcccaatccaccacaggtaagagtgttagtatttgtgatgctaaagaatgaacatactaggaattaatactacttcactcacctgtagcagtggggtcttcactgaattccacagtcccatcttgagaaactgatttctaaagccactcctaatgccagttatcttacctgagttcctttgatggcagagaatgaggcactagcttatatgcaagtgtttttttttttttaagtaattctagggagcagggcttagggactagaacagtgagacagggaaggagagaaaattgatacaagggtacattatctggttgagcattgctgacagcaagtggtcattcatcctacaagaaatgctctaagaagccttaagaaatgtgtcttagaactgtatactaaaaaacaaaaggtggggggctaggggagggatagcattaggagaaatacctaatgtagatgatgggttgatgggtgcagcaaaccaccatggcacgtgtatacctatgtaacaaacctgcacattctgtacatgtatcccagaacttaaagtataataataaaaaacaaaaaaaaaaggtgtaagcatttattcagaggctccctttcagtctgctgtatctccgggttgcatatatgcacgtctccagcagttccttcactagtgtcctgcttcctggacacgagtgaaggagaaaccccagggcaagaagctatagctggacagtagctacagatgaggtgctccgtgaagttggctgaagccagagcagaagtgatcaccaaatccatccctggaagagcaggtgtggtgagacgatttgaagtggtgcacagtggtgcctgatgaatagcctcagttaaacaaactgctcatttcttgcttgtctggaagcaatcaagcaactccagtttcttttctgaactggaaaaacacaaccatgatgatgaagccacggatctcaaatcgtcactcgagtcagcccagcactccagctacattccttactatgttaactttctcccacttcaaaataacttcgcactctctcttgtcactctgaacctattacatatcctcttttctataagtagcactctttgctgctaagtctgcctcataattcattgagaaaattgagttattctgccaggaactttctcatttttatactaccaaagttaccagcttacctgcatcggtacccatgccctctgtctacactctggctactgtggatgaagaatccctgcttctactagagaccaattcttacaaatagcaaagtccttgagaaagcaaaagatcttgaatttcgcttttttgaactcttaaattttggatctcaggctttttccttttcaaggactttgctatttctccttctccactatattatttcaagtacccacaagtaagttctagtacattctatatattaaaaaacccctgaaatccttgaccacacgtctgcttttgcctatttccttgtttttctgttcctcttaatagcaaaacatcttgaaagagttgtctatagctgctttctctacttcctcacctctttcaccctccttaacccatttctttcagatgtccattcatactgtgttaatggaatggttcttgtggctcttgccaaagtcaccagtggtcactatgttaccaaatccaatagtcagtctactatcatcttgtcccctctgcagcattcgatgaaatgacagattccttactgaaagattttcttgatattcacgaagctacactcttgtgattttactctcatcttattggacagtttttcaatcttccttgctatctctgttcttttctacccaccactaaatgttcgcggcccaaagggctctgcttgagctcctttatttatttatttatttgttgaatttacataactttcctagatgacttcatctggtctatggcttttacatatcctttataggtaatgactctcaggtacacatctacaacttggaccattcctcagaactctagactagactctctagttacctactaaacatttccgaacggtgtctgtgaggcacctaaaacttagcatggtgaaaatggtaacttttttcctttttcaaattgctccttttctagtcttccccaactcagtaaatggtgaactaaggtcaccaaggcaggttttccttacttatttttcttacaccgatatccaacacataagtccatgctattgagcctgtcttttcatcatctcatctgctctcctttctgccaatcaccctaatccttttccaggattcctgcaagagtctcccagttgccctccccacacaacaaccagaataaattttttttttaaggaaatcagatgatcacatcaaaatttttcaatggcctcctgtcacacttagaataaaatccaacaccttccctgccttactttttctattcccctttgtccttggctgctgtcttctgactccatcagcttctttccttttcttcaaatgtgccaagcttcttcctgcctcaggattcttgaacatgcttccctctctccttggcatgtttttcatattgccagctcactcttgccatttaggtctcagtttaactactatttgctcagaatggcctttcctgcctacccaataccaagcagcttcttggtcactatctattgtacggtactaattaattctctaaatggctgctaccattagttaatatttttattgcctcagtcttgtggttgtagtttattatctctctctccctttagacatgagtatcatgagtccaagatctgtgtcgaatttgttcatataagtttctaaagtgcttatcccagtatatagtaggcagtatatgttaaaggaactgattagtaaacactgtacttaccctgcaagagcagctccaagatgtttcctttagtcttgccccttaaaacaggtttctgcctcacacctccactcaggctctttctatatagaagttctggaagcccctcctataaataaggtgtttgtttagtactttaccaaacatggagagggcaatagagggactttcaagagcagtgataggattgccataagattgaggcttactctagacttttctagccctttagaaatctgctggtagaaggaagccaataagggacttttagttcatgttttttgacagactagactttgctttttgaaacttagcttaatgcactgttggtgaacagtcacaaagacataaatctgccgctgaattaaatgctttccttaaaaaccttcaagatgacgtttgaccctagccagttttatgtctcaagtacattaatgctaccccctttccatcatagtaagtcctgtgcaccagtgtagacagtctgacacaatgctagaaagggcatgccattttgtattggggatgtaagaaaaagactgcttggttgaatatgccagaactgaggagccagacaccctgtgacagatgccaggccacaggtacctgggaagtgacacaagccaggggattatccacatgagaagcttattttttaattagacaaagccaggctgactcgacattccctacatctccattagcccagggaactgagactctggtttgccgttttgtttctatcatgctcccctcacactgtaagtgcatcatgccatccctggggccaacctttcccagccttgcacaggtcccatggtttgggatagttgttccttctgtctgtttaaaggcttacaaggtagctggactggaagtttttcacaatcatgcagtactgttgtgataaaccagttttggtatttgcaagcagaggctccagaattttaatggacaaaagcaccaagtaacgagagtgattgccctaaaaattgcctttcatttctccgaaataacgaaagaatttcctcctgaccctgtggccttaagacagctatacttccaaagggacaagttagcataagaatggttttctgaaacagactcaatgtaaagatgcaaaaagtagctatgtgaatttgatatctacattttgggcttatcacaagtttcatgttcagtgaacagaaatgttggcatggctttacaagaatccctgcacattgtactgtgatggtctcctattcaggtaccaccatgtagcttctcatggtggtaatcagtgttaccaccattttggttgttaagatggacttctcttgtttggagtttcataccacaataaatgtttgttgaaatttattggagactttagactttttttttaagtgatcctactttagagtttacaacagagtacaagggatgatttatctaattaataaatctggttaatgtggataagtgaattaaggagtaggtttacacttaagtgtttattcaactgggaaaaagccaacaagaatgagtgaccgaatgcactgtacatatatttatagaggggactgattccaggagcaagtggctcactgtgcaggagagaaagtagtggtggtgagcttgcgggagtggcagtctactctgttggataccaggtgtaggtcatcccctggcccctggaaatggaagagagtgcgtggtgatgagttaactgagtgagatttcagtgtatgaggagctgttggggagaattcttgtgacaacaggcatgtgggtgggtggatgatggcctcttacccatgctgtgagtggttgagacttagcatgtgtctcttagcaaagtaggtaggtcagtgctttggtatattttggcatgaagcgttggtctacaaagggcatctttagtccctgtgcaagtggtgagttggagagaggttgctcattgatgcatatcttctctgtgtttctacttacagcgtgaagggagccagtcattatatccccttttaaactaaaacacaaaagtcacataaccagtgatagccctgtggtgcattaactttgtcatctctactaagttcaaccttaggtgacagagtttgcccaccagggatatcatgtgattgtctagagggcttccagatcctctttagaagctgctgtgcaaggcaacattatagtttctcttatttacatttttttcacctccagttccataggaatttcctagagaagctttccaacgccataaaaatgctgtagggcaaagcacacaatttacacttgggtgtaagccagtaacaagtccggcttctcctcaccccaccccttcatctttggaactgcctcggtccagtccgggtcttggctctttttttccttggtacttcctccgcagcacttgaaactatatgtggactttcacagctctgaatctctccttaaatactcctggttaagtttcttgactgatcaggctgagatgctttgtctcctcaccttgaaggagggaaaaggaggaagaggagcagcatgtatgtggcatgcaggccactgagatgttcttggaactgaaactcacatgttcttctggagaattacatgggagctgcagcagccaaagcatgctccaggttagagaaaagtgagtgagtgtggcactgggggaggatgtctcagaataggagactagggtcaccatgtcaaacataatcatgtctgtgagaggcaaagacttcctttccataaggagatgcagggaatgaatcatcattatagatccaagagacaaaggaggtcatggaggagaacgaagaggaaagacattaaagagaaaatgggagaaaatgcctgacggagcatcctcagtgtctgaccttaagcccccatgtttcttttgggatttgttttccttttcttgttctaagggtggctataagggaagccacctcagtagacaaacagaaaaagatactgtgatttgcggcaaaagaatgagtccattttccgttttggatcacccagactgtgcctctacttccacctccagtattttgtatctttttacttttgctttatgacagtgaaggtataggtagtgtgatctctgggggtggggaagggataggtaatccttaaaaataagacaaccatctgttatgattttgtgagttcttgtgggttctcgcgcgtctactgcattatcattcaacaaatatttactgaatgcctactcggtacagattctgtgccaggagccctattgtataggctactgggttaggcacattcacaaagattatcatatctagttcatactgctgtgttgtcgggtagttcttaggccatttaacagaggagaaactgtggctaatggaaagtaatttgtttaagggttgatgatagagatagtattccaagcggggctggatttaattctaatgatcttttcttgttattctgcattgccttgcttttattttaaatcagaattgtttttttattacccagaattgcctgttttctgagctgcagtatattttagagtcggccagacctagttatgaatcccaagtctcctgggattcataaccacttagtagctatttaacttgtgtaaaactgtccatacctcagctttaccaactgtaaaaaggagatataaactccaaaatttaagggtctctgtaatgattgagtgaatacacacacacacacacacacacacacacacacacacgcgtatggcatgatacaatgcaaacatatttattacataggaaatgctagtaacctttccctcatttccccttctgttgagaactgaccgttcttattttctgggtttgcagaaaatttagtagttttctatagttcttgcattaggtcaaagaactaagtccttgcatatttagtcacatcagggtagtcaccttaggcagaggtgtgaatgagaaggactttctcagtcacaaagaccaaagattatgaaactaacactactatatgtggacaagacaggaatggaatgataggaacatttggcagtgcaaaatgccctctattttgtgttttcctaaagatcatcatatgacattaactctcagaggacagattaatccttcaactggaaatgtgggaaagaagaatttctttcattgaaagcatttctttccttctttctttctcaccttcattccatatccctgtcttccatctttcttgaaaaattcgacatcaatctcgtatttcacttgccatcatccactgtgacaatgaaatgcatggcccatttaggtagggttcttctcaacggtaagatattcaaagtcagaaataccctgtataaggtgccactgtgagatagctccacacccttagagcttagtgctttttcattttagatgcttagattactactggctcatagcacagccatttatttcaatatattatttaagtctgtcatcctccgtgaagtctgttctgacttcacctccctacactatactctcctgtctctaaatttgcacagtatttatttcctattgcatcaccctagtcccatttctgcatttaatcaatggacatttattaagaggctgttttatgcagaacttactattaagtttgttgtagatacagaggtattataaattggggatattcttatccccaaggagttttcaacctggtgatgtttaggtcaccaactatccattgagactttctttgtaggcttttaaaaaatcctgcagaaaggattgtgtggctgttagctcagtgatttttggacttagatcatgaaggacaggataatgatttgtaaatagatattatgggagttgtaagcaaatgctggaagaaacatacctccatcaccacatcccatagagataaaattctactgcttctacagatcttctggttaaaattctgtggaaattgacatgaaaaattataatgacctagaaaaggacttgctcttatgacatcatcatgactagtttattttgttttattatcaaggggttatattttgcagtaagcttctgaagcacatgtacagtaatcttaaaatactcatttgaaagatcagagtttaggttctctgagatcattctttcagaggataagccccagatttcttacgatgtgatttttacctgcacaatcagtaactattctaaaaagtagagagatatagttcaatgagccatttattcacttacccactcttttgtatatttatccatttatttatccaatcatgcatgcattcattcaaaatgttactaagtgtttactgcatgttacttttcctaagagttaggaacagagacaactttttaccttcagagcaagactattcctgaaaaaccttatattgttaagaacttttatagttatcattttattcttgccagaaagaaaaacatttctcagcctaatggtgcaataagtttaatttgaatgttactagccagactcctggaattcactttctgccatgtctgcactattctaggagaagtgaatatgatatgggtgatgataacggagaggcttcagaaaagtgaatgaaggaatacatacataataattattcccagaataattcaccctgtcaggtcatttttaaatttggcttcatcttgttagcgaacatcattgtcttcttcattatttcatacatcatcgtcataactatcaccaccaccaccatccatcaacgtttagcaccgttaagacccataatactccagcaatgcgctaagaactacgagaagcaatcttttactgaaaagattggcccactctcttcaggtggttggcacctaattttatctgaataatgaagtgatagtacataaacacatatttcccagagttttgaaatttcttgagaaactctttactttggtatatgacgagaaaagagttaatggagacaacatatgttattcaggcgatagataccctaaaagccctaacttgaccactacacaatctgtgcatgtatcaaaactgcatatgtaccccttaaacttgcacaaacaataataaaaaaattaggtgatttgtattataaaatatattctcagaacatttgaccttctcaggctttcttattctttttggcataggtggaaggctgggtaaccaaccagcgttccccctttgggcttaagattaagaggcagcatcaatataatttatcagagttctgaacccacaaaatgcttaggactcagcaagactctgtgggatgggggcattttacaggggagatatgacctcctttttaaaaagtttggagtctgggtcaggtttgaatcataagcataaaaatacagtatttcttagaatcctcaaatccctagggaaactatttctctccagctttgctaaagaaagaactgttctttgtctaaaagtctcctccatatcaagcctctgtcatggactattttttccccgctgtatcagaggaagtatcttactgaatagatctgctttgctcctgtttgctgagacttattaaaagagctgactgcaaacagatttttactgcctcagtgtggacttacatcaggtagcacccaataagacttgacaagctgacatctccaatccatcaggagtggtgggtgggggagggaggacaggaaggagagaatcttatgccctcccacttcctgagagacagactttggttgagtgatgtagggtacatttttagaaatctatttaatttctgaattggagttttagggattttgcttttagaatacagggctagaaacaatactcatcttgtctatgctaaacagaaactgaaaattacacacccttaaggtcacaaaggagcaaagtccttaggagtaagaaaaaaaaatctttacaaaacactggtaacagagcatcttaaacactctgcattgttctccagccaggcagactaaaagctctaagtggttggtaataatggcaagcttttattcagaagaaggaaacatcttgtagacacagatttctaaatatgcaagctttattgtctcaacttttgccccactctctacgtacttttcttaagcattagtgaccctgatagcaagaaaaaaaacaggcaaaaataacaaccagattctgagttgttcccttgtagaatttttgttcacatgtggaatgacgtattggttcatgtgacttcttgttctattaagaacgtcttaccaacactgatggctcatcgctagggaagtatttcatggctgctcttttatgggatgaatataggtactgatttctgcttaaataattttcagaataattagattctgtgattcatttgaaaagaagttggtgcctctttagagggagtcatactgcctgtcttcgtaagatggggacctcttgaatatgggaggcttaagccactaaggtcagtgttctttcatgatcacttgctaaaattattagggctaataggaatggagatttggtggaatgacatcatcagtgtctgctaattatgtctgctaggagcataaaaggagagcatcaagtggaccaagagtaggggaaaaaagtcatgttgttaacttaaaatggtttcaaccaaggatgttaaaagaaatacctaacgtttcttaaatgtactgtaaatgtttcatgtcttgttgattgtgtattacactctttaaaattacttctatcctgcctatattttaattctttggtatctcatcttatgcttggtggtaagcatattgaaggagggactaaatgctatctatcttggatttcttgcatcacttagcaccttgcgttgtatatagttatgctcggtaatatttattgaagtgaactaaattgagatcaagaaacattttcactgtcacatattctgaatataaattaacaccaagagaagctatctccaagaactgtttgaagatgtgggggtacctagaaacttgggagagagatattgaccatattaacttagggtttaaaattttgaaattagaaaacatacgccctatactttatagcaatgtatttcaaaagttgatagaaaagattggctttccctgatagtcagagactttataatattctccaaagataaaattctaatggaaacaaagcacactaggtgtttcaacatttatcttaggtgcctattcagtgagctttcacaaatgccttcatgggtgtaacccacacctctatcagtatatggaacatttttatcactagttgtgtctcatgccccttcccagtcaatacttgtcctctccccactcccaatacacatctatacacaaaggcgaccactgttttgatttatttcaccatagattaattttgcttttttctttcattaataatatattttattttatttttatttgttttttattatactttaagttttagggtacatgtgcacaacgtgcaggtttgttacatatgtatacatgtgccatgttggtgtgccgcactcattaactcatcatttaacattaggtatatctcctaatgctatccctcccccttccccccaccctacaacaggccccggtgtttgatgttccccttcctgtgtccatgtgttctcattgttcaattcccacctatgagtgagaatatgtggtgtttggtttttccgtccttgtgatagtttgctgagaatgatggtttctggcttcatccatgtccctacaaaggacatgaactcatcattttttatggctgcatagtatgccatggtatatatgtgccccattttcttaatccagtctatcactgttggacatttgggttggttccaagtctttgctattgtgaatagtgccgcagtaaacatacatgtgcatgtgtctttatagcagcatgatttataatcttttgggtatatacccagtaatgggattgctgggtcaaatggtatttctagttctagatccctgaggaatcgccacactgacttccacaatggttgaactagtttacagttccaccaacagtgtaaaagtgttccaattttccacatcctctccagcacctgtcgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttataaatttgttggagttcattgtagattctggatattagccctttgtcagatgagtagattgcaaaaattttctcccattctgtaggttgcctgttcactctgatggtagtttcttttgctgtgcagaagctctttagtttgattagatcccattgctcaattttggcttttgttgccattgcttttggtgttttagacatgaagtacttgcccatgcctatgtcctgaatggtattgcctaggttttcttctagggtttttatggttttaggtctaacatgtaagtctttaatccatcttgaattaatttttgtataaggtataaggaagggatccagtttcagctttctacatatggctagccagttttcccagcaccatttattaaatagggaatcgtttctccatttcttgtttttgtcaggtttgtcaaagatcagatggttgtagatatgtagccctatttctgagggctctgttctgttccattggtctatatctctgttttggtaccagtaccatgctgttttggttactgtggccttgtagtatagtttgaagtcaggtagcatgatgcctccagctttgttcttttggcttaggattgacttggcaatgagggctcttttttggttgcatatgaactttaaagtagtttttttccaattctgtgaagaaagtcattggtagcttgatggggatggcattgaatctataaattaccttgggcaatatggccattttcacagtattgattcttcctacccatgagcatggaatgttcttccatttgtttgtatcctcttttatttcattgagcagtggtttgtagttcttgaagaggtccttcacgtcccttgtaagttggattcctaggtattttattctctttgaagcaattgcaaatgggagttcactcatgatttggctgtctgtttgtctgttattggtgtgtaagaatgcttgtgatttttgcacattgattttgtatcctgagactttgctgaagttgcctatcagcttcaggagattttgggctgagacgatggggttttctagacatacaatcgtgtcatctgcaaacagggacaatttgacttcctcttttcctaattgaataccctttatttccttctcctgcctaattgccctggccagaacttccaacactatgttgaataggagcggtgagagagggtatccctgtcttgtaccagttttcaaagggaatgcttccagtttttgcccattcagtaagatattggctgtgggtttgtcatagatagctcttattattttgagatacatcccatcaatacctagaacttcatataaattcagtcataaaatatatcttactgtatgtctggcttcctttgctcaatataatgttttgagattcactcatgttgttgcatttatcaacagtatgctcctttttaaagctgagtaatataccattttatgaatataacagaatttattgttttctgttgatgaacatttgggctgtttctagtttttggctgttgtgaataaaaatgctctgaacatttttgtttatatgcttttgtggacatatgtttttatttctcttgggtatatacccaggagctgaataattggttataggataggtacatgtttaaccttatcagatatggccaaccatttttcagagcggtagtatcattttactttctcaccagaaatatatgaatgtttgtcaacagtgggaatgtaatataggaaatcagacagctggaagaatgaaaagggaatgctgagaaataatacctgccgggacttcgttttagagctggggttgtggttattagaatttagaagctcagaggtagtgacccgtggatctggtgcagtacttagagcctcaaggagaaggtactgctcagctatacttgttacctgtaagttaactgactctttcctctattactaacattttggtcactgagttccatccagcaagtattttttatattaaccattatattgtttcatttctaaaatttctgtttggttcttctttctatcttctgtgtctttgctgacgctttcgattttaacttgttgaaagcatgttcatgattgcttgtttgagtatttttataatagctgctttaaaatcttggtcagataatttgaacatttgtgtcatcacaatgttgggggcctgtcaattgtttttttcttgtacaagccgacatgttatggttctttgtatgctgagtaattttggattgtattttggatattttaaatattatgttatgagtttctgagccttatttaaagccactcagtttggtgacactttgaattctggtgttcttctcaatctgcctgttgatattttattctcagagacctcagataggtgtgccatgaattttatcaaggtttcatagttgtgttaagtaggagaaaaaaattggcatgtgttcactccatcttatctggaaccagaaccagtaagtttggattttgaagacatacttcacaagatgaaagaaaaatcacttctttatttatgtaaacctgggtttctcatttattatctattaccaccattagaatttaagctttacaagggcaaggatctttgttctatgtatcccaggtactgggaacagagtctggaactaaataaatattggaagcactcaataaatattttcgaatgaatgaaaaagctaataaacaaagaaaacactagtgtacactgaacagtactgcaagaagatagttagaattaccgatacctgtcaccttggataagttgattaacctctctgtgtatgtaccagtttttttcttgtatgtaataggaaaatgatattttatagaaagaaatgatatatgtaaagtatttagcataaataagtgctcaaaaaaccccacaaattcaatgtctcctctcctcttcaaatgccaaaataataaagataacttttaaaatgtggagcaagaataaccaaaggatagacttatttcatggggcagttggtcttatgtaaacagatgataaatgaaatcagaaatagtccacctctattttaattacatcttctctattaagaaaaatgatcttcgtatggaaaaagggagttcatacataggctttgacgttagagtggcctcactggtgacttttcttaatctctcaggtcgaactcaattctctctgtaaaatggaaataacaatgcctactcccacaaagttgttttaagtgtgacagaataaaacttacgggaagcgtgggggaaggagaggacatagcctctcctcattacccagcctcaaagagaatcttataattgccagctcatttccaaaactacttctattgggaagtggtaaattcacaacctttattagttttgctgctgttcaccttttggtctgggatagctggactaagttcaacacaagtctgtacctgctgagtcacagcccactctgccttattgcctgtaactcccctgttccttgaacaaactctacatgtatcaggcttctagccttgcttagaccttcagcttgggtccagcagatcagctctctacaagagctctgtgggagacctaggagcctgtgcctgtctctctcaccatgattgcccagtaaacttgctgtatattttacgtgttacaaattctcaaagagatttgttgctttcattccttcttttcaggcattgaatagaaatattccaataggatttacaaaaatttaagttaaatttttttttcaattttactgtccacaaagcagccgtgttttgtatatctgcacattctccacctatctcaagccctgtaccgaataggtgctaagtgaaaatctcagattttataactgctgttcactggtgcaagagatctgataagtgttcaaaaaatgcattgatttccctgatttagttgtttattgatataacactgtttaacttttctttagataaccacaacattccaaagaccccaagaaaataatgttaatcttttggaaactacataaacgtatagcaaatgggcatctctatgagtatctacctctgtttataattctttggcatttagctattgagttcaggaagaagatatagtgattaatatcactgaaagggaatcagaggcttcttctcctgagtcacaggccatctttcataaaatatccgttaaagagttgcaggagacctacttgtttgggcgttttcccctgtgagatcttctgagatgcaacctgatgctggtgtagatctgttgttctcccttgaatgaattgctggagtgaaagagagactacaaggccttcattaatggagtaagagctgacagaattgacatttggtaggctcttgattcaggaataaaagcaaagtgagattttcactttaattacgatcttgtgttttttaccattcatgctcatagattaagaataagacctttaaacagaaaagagtttacatgctgaccctcatgagcagcgagaagtgacgggttggaaaacctcattgcctctctatagccaagcttgggcaaagagatttttacaagggataatagatggggtggctgttcctgagaggaggaggaaggagactgtgtctgaaagcctgcatcaaagggaaagaagagaaccatggaagctctctgggcctgggaagatgccttggaacaaggcaggccaaaatgtctcctgctccgatttactttgtgagtgttttgtccctgtagctgtgtggagctgaggcaaacaggactcacacagttctgacattccagtttaggagattcaaaaaatcttcctagggcaggtggcatctgagcttgggctttcaaggtggttaacgctttgatggtcagacatggggaggttgggaattccatgttcaggctacaggaggaaatgtgtgagattaatttggggactactgctgtccatacagcaacatggcataaagctggggctttagatctatgggaggcatgtcggtgtcctggaaaatatgattaaatagtgagtctactttgacctttttattttctctgctgattgagttctccttaggttgctggaagatactttattttatttctaaccatttagtctcccactgggaaagtatgagtttatgcatttttctttcgatcttaacagagttagaatatgatcatattgaagaatggcatttcttatgtctattcagtccttaattctcccactaatccctgctgttttccagccttattgagcctcagtgttttgccagttccagtgtatttctgtgacccatgagataccaataagcactgtaagagactcatcaaatcaaataggtggaggggacctctagaggtcttggtggcatagctagatgattaccaaagcctgccaaggtagagaattgtttactgcctccttgaagcactccagagatgaggatgacagtctctctcaaggactttattctactaattaatcagccgggaggttcttccttatgtctaattgaaatctttcctgatgtaatttaatttgtttgctcctgtgttgtctactgtgggcatggatagcaaatgattactacctcactaataacaacccttcattaatgtgaagccaaactctcgtcacctttctgcgcctgctgtctagactaaacaattgcagtttcttgcactgttcatcaaagggtttattttaatgtctttagccatcttgattaaagttctctgaactcttgagtatctctacattatttaaaaataattattatagtaaagagaaatttagactaaattcaaagtaactgctttggagatctcatcaatgactttcaatgtggggaagcttgtggactatttttggtgaaaacaaaaatgactggtgttacagccaggtcattagacagggccatgggtgatacagtgcattttttgttgttcattaatgtgttaacagacataatccctttgtggtatacaaacacattttgggaatccttatgaacgtatatttgtgtgcctcctgccatgaaagttcaaaatatagtatacttttaaattataaatctagataatacaagacactatgccttatatcatccatgcctttctaatctgatcatctgggattatttcctctagtgtctcttagagtgccttgtccagagaatttgaaataatagacatgatgattactacaagtaactgtgagatcatatggcatttatttcctcataaaatggctttgtggtttatggagaagttagggagataatgggtaatagggaaaagctaaggcaagagagcaggggaatcaaattcaacatttgttaaatacctcctatgtgtaaagcacctgctagggatggtggatatatgaaaatgagtatgcacagcaaatcattatcgggggaaggaaaaaagaatggataggattgtcaaatccaggtatgcttatatgatgacacaaaggtacctgggaattggagaaggggctgcctaaggatgtattggttgtgaagatattccactgaaatcagtcatggggcattaatattttaggcagaaagaaaccgattcctccaaattagggctcagtaaaaaatgaggaataaaagtatcagtgacatgtgttttatttacaaatgagaaatcattataataatggttaacatttttgagctttgacaatgcctcaggcaaaggacttagaagtccttttacctgtattaattcgtttagctctcacaacaatgctgtgaggcagatgctgttttatctcatttaacatagatgcagccatggggagaagaaatctcatggaattacatggggtgctgggtctaactggcaaggaaggagttcacttggagatggtgccaataggatttggggggcactagattaggtgggtatgtgggtgtctcctagagattgggatggcactgggggatggtgtgatgaccaagaagaactgtaatgctgtgggtgttatttcagcatattctgaaaatagatgaatgcagagttagagaaatctgttggtgtgtcaggatttggtttgagtcgttaaaagatactgggtaaaatgcatgttcaaggattggccattcaagcagtgtgtttcacagggatcaaatccttcttcctttcatcagcccatgcccttctcctccatcctttccctttctcattgagagttttcccgcaagccctggcattggctctgcatggtggtggtgtagcccccatctggctaagtcctcctcatgcatcctacccttgagcatccatgtcactgtcagcctcccggtctcagcatcagacttttcctaattgatgactttgataccttcttctcataactggagatgccagcctcatgaccacattactattttcttatctctctgataaatctctgactaattttcatttctccccaatcttcagaactcctctgctatcctgtccctatcttcttgcagccatagccttatcctagcctcttcctctcttttgatgacagagacaagtgaatgtatgaggaatctgtatactgggtatatttctgtatgagttgagtttgaatctgcatgtcattgtgagtgaaagtgactatgtgagattacatttgctgtatgtatttttatgtttcccaagtgggaagaggcagttgggaataaatggattgaagttaaaaggatcccatggtggtcaaccttacttaaaataaggaaaaggtttattgcacaaagatatgcctatgagggtggttatccagtttttgtgaattgaaaacatcctaaattttcatgaagagggggttgattaaattttggttaataattcaatgaaagattatgaatttttaaaaatatattgcatatttgtgtgtgtatgtgtagagagagagattaaagtattgaatgaaaataaaacattacagcagttatgtataattgatatatatttctgttgtatttgcatattgatgcctagatgttttcatctgggaaagttgctaaaataataatgtgggttgtctctacaaagtgaaattattattatttttcttaactgcattttttcatttgctctaatgaacatatagcatgtgagtgataaaaaatataaagttgtgagctgacaatagtatttcaggaataacacaaatatgaagagtgggcatcagcaagaggtctctcattatgcccaaataagggaggggtttaaaggcctgttatcttttctttccctccttctctagctggccatatgggagtgaaatcacttaaagaaaagcccaacccttgcatacaatctttttctaaaaaccctccccaattagaaatttatttgaggtaataaacaagtatccctgggagcataaaaatgtagtggtgattcacaaaacagtttaacccacatggcacctttgcacaaattttttaacgtgtccattcctccaaacactttcctgccatgtgctgggaaattgacatcataaaaatgctatgaccgatgttcatgttatgatgaccctcttctaagtttgtgcagtgccctttctatacaaacttgtaagcaatgagttaatttggaatgcatagatttatttcttcctagtctgactgagactttagctgtaaggaatgggagtttgacaagcacataaacatgtggtatgacaggaagggagagcaaatgataacttaaaatttttaatgctggcctggggtctcctgtttgcatgagagccctggaaagccactctttaactcttgtggggtccgtctttatggggtatttggaagtgagttgaatccctggttataatggagctggctctcagggatggatagactttcactaattgtgtatggaccccccggagggcggattaatggaatctattcttgtgttcaaatcgtaatgcttatttaacagctgtgcttcctggtttagttgatagccacttatcacagtttcaatcctagatcttttcatttatcactgatacagagacattccctagtctactgaagtcaagagcataataaggccagaccagaaaaccaatcaatctctgagcaaacagatgccatgtacatgctctgactgctatgttctgttatgaagtcctccttggatctaggtagcacataaagttatcaaataaaaattaaataccttgagattccctctttaagggaaagatcctggtgaacatatttttaatcagtaaacttatgaatattttcacaattataattctgttactctggatgtgatggtagtagcttggaaggaatcaagctaaggtcctatgggaaatactttctgagaatgataatggaagaacaattacgtacatgaaagagatccataaattataaaacacttatacaaatcttaattaatgtgattatttgtcggcaaattgctgaagttctgttattgctgagattattcaaatgtagaaagaaaagacttcttggagtttgaattgacaaatactgatttgtgtagcaaagactcaacttacttggtagaggagttgcatatgaatttttcaacaggccttcaaggattcttctcacagctcttctgaacctctgctttgctttgtgtttgtcttttatccaaagaacactgaagtaaggctgtgttcaggaggattggtggagttcttgtctggatctttgagtgctatgcttgaagcaagccaaactgaactgacagcagtttaacacacattgtaatgcatagtcctgggcttcttgtgctagtcatccagtcttcatcatcaaaacaaaaccttccattgtgatcttgcctggatggtgcagttgtagttaattcagttagagcaggcactgcttgttgtagttggagggatgaaattagacatctactagaccaagaacactgtggtggcaggaactgtctgtttttttttcttttttttttttttttgtgccactgaatccctagtgcttcacacataatagttgcttggtaagtattagttaaatgaattttttgaatatgttacagagggagaccaatgtggtactttaggcagaagtcaaacaaaaagtattgctttgacaggattatgacaccccatgaatttttagtcttccaatctcaatttcataagtttcctagagttggtcagaatcaaggcaataaccaacctgatatggttaggctttgtgtccccacccaaatctcaccttgaattgtaatccccataatcctcataatcctcatgtgtcaagggagaggccaggtggaggtaactgaatcactggggtggttccctcgatgctgttcttgtgatagtgagtgagttctcttgagatccgacgttttataagtgtgtgttagttcttcctgtgtgcacttcttcttcctgctgccttgtgaagtaggtgcctcgtttccccttcaccttctgccacggttgtaagtttcctgagacctccccagccttgctgaattgtgagtcaattaaatctttttctttaaaaattacccagtcttgggaagttctttatagcagtatgaaaacagattaatacacctcaccaaactcatcaaagactgaaatgtaaaccagttatcatttagttacacagtttccattgtggatttttccatagcaaatcacctccaaacttattgtgttaagttaacaacacttatttatctgctaacaatttcacagtttaggaaggacccaacagggacagcttattttagctccaagtggcattagttagagtgtttgacgagggctggaggatccactcccaaggtggagtactcatatgcctggtagactggtactagctgtcacctgggagtcaccaggactcaattctcttccatgtgggcctttccacttggccactcggggttcctcaaacattgtgactagtgctgcctggcaagtatcacttctgctgtattctcttggtcaaagcagttacagcccaatccagagttaagggtagtgggggtatgggggaagatagaagtagactacctcttgatggagaaagtgatagagaaattgcagtcatttttaatgaactccaaacattcactgaaaaatatctattaaaaagatttgtcaatcacctcaagttggtttttcgttatgttctcattgtagtagaaaaattccacagttagcgaaattacataggccaagaggagggggatggtatttgacctccttaaaattgccatcagtttctctttcaaatcctggaaaataggaatacaatgagaataaaaccagtgtacttactgtgcagatgatgtctcaagaaaagtcccagggtactgacatctcccatcccacctccccacagacagacagcgtattactgcccttcagtcctcttttgttgaaattctggagctgcctctgcccagttacaataaaaagattccctggtaagtttagaaagagaaaaaggagtgaattacgtggtctgagggtctggtgtcactgaagttataatctttccatctcaactagattgttatctgccaaaggtatttatttagacaagaaaaaaaaaaaaaggctgggtgcggtggctcatgcctgtaatcccagcacttcgggaggctgaggtgggcggatcacaaggtcaggagttcaagaccagcctggccaatatggtgaaaccccatctctactaaaaatacaaaaattagctgggtgtggtggcagacacctgtagtcccagctacttgggaggctgaagcagaagaaatcacttgaacccaggaggcggaggttgcagtgagctgagataatgctacttcactccggcctggcaacagagcaagactccatctaaaaaaaaaaaaaattattttttttcctttcaggtaggtttctcctctccaaggtgctagaaaagtcacttttttatacattaattcttcttttgtaggttttcaacagacaagtttcctttgccaaccctatcttttttcagagatccctgttaaacaagtgatacatgttaattcttgtgattcttttgcagatttcttatactatttgtaataccttgataaaagttccaagcttgcttactgtacttccatttaggagaccctagtggtcaccatttattagttatctattagttccagaaagtgtatatgtcctactttgtagcacaacaatgcactgcaggtattggggagatgggacctcagagaagccaactttcccaaggcatataatacgtacacagcagcaatacgaaaatcagaacagaagaaagttcactgatattcccaccatcctaacataagtattttaatttactgtagcctttgaccttatgcatgcttacttttatatagttgtcatcatagcatgtgcctaatttttattctgcttttttagacaatgtttcaatggatggtcaccttcccaagtttctacatattataataataattttgatttggccgggtgcggtggctcacgcctgtaatgccagcactttgggaggctgaggcaggtggatcacctgaggtcaggagttcgagaccagcctgagcaacatggtgaaaccccatctctactaaaaatagaaaagttagcctggcatggtggtgcgcgcctgtagtcccagctgctcaggagcctgaggcaggatagttacttgaacccaggaggcagaggttgcagtgagccaggatcgtgccactgcactgcagcatgggtgacagagagaaactctgtctcaaaaaaataaaaataattttgatttgttatgtagtactgtatgcggatgatcaaagtagatcttctttggtttttaaaatatattttttctgtacataaaagtaatatatgtatacacattgtggaaatatttgaaacaattatataatacactgatttttatcacacacaaagatgtaatactgttatattttttgaatattttctgccaggcttttcaaaatctgttataaatatattttgtttattcagacacaagtcattttatcgtatacaaaattgaaattatactatcaaagcaacttcaactaatatttacttgtctccacaaaaggaacattttgagaaattccctactgtcttgcttttctataggggctctccttgtggagggtttcattgtttcaacaaggcagggatttgctgggatttggagacgttcctaaatgtaaaatcattccgctccccgcgccccgcgccccaactccaccgcatggtattgcatcagtatagaacagcatgcacgcgcatccctcagcagtgtgtgttatccactcattgcctcatcaaccttggagcacggcctgataatgatgtggggaggtgacctccagctgaatgccgaagctggaagaaatagtgctgttctgtgcaatggtagttgcatctgaataatgtcccagcttctcatttaagaaatgctacccaatggagaagagcaggtggggtctatttatcattctacatgtcagatgcaaaagtgatcttatctgtgactttggtgcaagttgcagtgtcacatgttggattgagcaaaatgcactctcaggatcaacattctctgcttaagtagtgaaacagtagtgttggtgcaggttaactgtttttgtgtgtgtgtgttttatacagtgaaacatttttaatgtgaaattcttgaaatgcacacaaaagtacagaaaatgctaacttggataccatgttttcacgcacagatttaatggatgaggttatattgcttctgatctctttaaaaggctctatttcattggtagggatattgtccctaagtgcaaccttggacaaaatgtttgggatgaggaacatggagtagagcctctttgctgaggctccttccagcccccgcactctagttcctgcttttggaatgtcactgtcaaataagaagtctccttctagtgactgtagcacctacataagagagaacaggggataagaatacaaggggagataaagtcaggtgttcccaaaagctagtagggtgacaagggagaaatggggtagggatacggactcagctagatgttagttgcaccatctgtgagtgtgtcagaagccctgatagactcaatagactgttctgtttttttttctaatcacatttagagacaagctgcttcctgaattggatgaattttaaggttatggttgcacatttaaaaagtgaaaattgaggcttttcccattctttgcctctctcctgagttgtgggagtaattcatggcaactcagaatttacatcttagagcaaacttgctgggtgatttgtcttcattgcattttgggggtgggggaataaacctcatcaagcagggcctgattttccaagagctcatcattcaggcacttattacccactttgtgcagtttctaggtcttttgcttttcaccctttcccctcctgctgggttttggtcattttgctgcttgttaggacttccaccagctgatatggagaagcataaagaacggctaaagcattattaagttctgcttcatgataggagctctgcaaagggcttggtgggggagaattttgaaccctttgcctacaataagttttggagttatctgttgattttggttaggtatgccctccctgtcctccattagtactgataatgaagagctcacttacaggaaaacaggatgaaagaggatggcaacatacagctgagaatcacagtgagccatgacttaaacatgttcctgtaatatgatgccgtaatgagagggagcccaagtccatatgagttcattgaagtatcaaattggtgtgcaatctttcttctcattcagcataggtctggcacatattggagtagaagtttttagtggcggtgagactgcatggtgcaggtagattctagcaacttttttattcctggggcaactttttcaaatgatatgcactgacatctctgagatttgagaggacatcagggtgtggactttggaataattactgaagcaatcatcttatatcccaccatgcaaaagagatgttggtgattttgagaaggctgaacaagaacaatgaagatagttaaagaactccaagctagtattctcatgtctgaagataggagggctcccaaggtagttacacaccttttgttacatatataaaagtttacttgtgggatgctgtttccctcacatcattctgtatactcatactagctcagtcttccaatgtgcaacatgattatgctgcaccccttcttggtcttcattaatgctccaggcttcctttccttcttgactcccaagcatttcttcttcctttgccaattttaataagaaccagtcagctcacctttgaccttgaagtcctaaggaggttgtagttatagtaagaaagatcataaatacaaggtgtcataccttgatagtgtcctgcagaggtcagagctatacttattctccctgcagtcacagggagcaattgatgcatttaaatccactacatttcacatgtcacatccatccactcttcacaatagtctcagattattctccagcatgcaatcatcatttccgctactggggttcaggtttgcattgtttcccttatctacactatgagccgcttaacttgtctttatgccaaccactatttttcttaacaacaatgaaaaaaattaattagaaaaattaattggatcacttatctgccctgtttgaaaactgttcttgggtacttatttataggaatacagcatcctgttcaaaagcttcacaattggccctgttttcagccttatttcttccattgcttctgcccaccctgactccgttattctctttcctccctcctgtcctgcagctataccttcatcattcccatactcttctttgtacctgacacactctctggactctccattcttctcttctttgccaagtagactactcgctctttcagacccagctaaaataactcccctggtgaagcctgaagcttgctccccaccagcttcttatgttcttacttctctataaaacaagcatagtctttaaaccattgttttcatggggttttcctctcctcagctttgctgccttgactcagttattgctaggtcatacacctgagagatatgacagtggcaggccagtgtttggcaaggtagaagggaaggaaggggataggtgagcgaaagatgtaggctttatgcactggtttcctatcctgtctgttttctatatgatggttaggatacaccccaaaatacaaattcctttattttcttgacaaagacttctttcacatcagttttctctctttggtgaattgagtgggacaatgtagaaagcttagagatccctttgcagctttccatagaacagcaaactccttgttccttgtcattgacaccactttaaatcctcttaattcttcagagtctgtcacttctaaagtaggagcacacatagcctcaagtcttatgaagagggaagaatgaaagaaaaggcaaatgaaggccataaaaaactttgtaatcctttacttcattcacagagacttttcttcactttccccagtcctggaaaaagtaatgtgagtagtgtctcatctcttctcagaagacacattctttttttgtctcatcatatttccatgtatccttggtgcctgtttgaggattaaaatagaggagaagagtggatatgtggtgaccaatattaattaatttatatatatatatatatatatatatatatatatatatatatatatatgacattttcttgcacaatagactgggaaggagctactgtagtggacttaatgaagtataattttggggtaaacctcaattttaattccagtctgtcacttactagctgtctgacttcaacaaaatgagtcaccttctgatccttagtttcctcatctgtaacatgggattatattaggtaacatacataagacacctgtaacacaatcagtgcttgagaagaatgatgacttttcttacttatccccatgttcacagtgcctgacacatcatagggttcaatgagcatttgctgcataaacttgacactgcctttgtcagatgcctcacctggttaatttcattttttatacaattattttgttttggaagagcttctccaaatatacagttgtataaatctaaaccagaaaatgatggtgttctcaaacagtacgagagctgagtgttgagctgtgtgatgttcaagggctcttttgacttatctttaatttttctggcaaggctatgatgtagggaagtacttctgtgcatggacaggagaaaaaagagtgtgcttatttctcattcaaaatttggctgtttattgcaccttaagacctaattactctcccttgctgactcggtcctctggtggaacctaggttctctttcttcctagttcccctctatcccttccacccagaatttataggagagtgcatctgagagcagactcctctagatggtagtagttggtgaccagaactggtctaactcatttttcagtgcagaaggacacttttctggtctcataagtgccctgggagcagctctctaacaggtgtgatgctgctgttccagaggcaaggaaaaggttcctcaccactgcttggcaaggcagagagtaggggagtcaccggagaaggggaaggagggatgtatgcttcctctgatggtttccatgcctgtctacacaagacaaccacccagggagatttaaaatgcatactatgaagcagggatattgaatccctgtctttcaagtgtggcccaggaatccatatttttaacaggctctccaggccaatgtcagggacccagctcagcctctggatgtaaacctgtgagaagcagccctgggttgcatgttatcatgggctctccacgagtgctgctggaaggcataaaaatactggagagcttgcggttcttatatgtgatgacctaaaggtgtagaggaagggctataaggtatatgccatgctttatagtttttccttcacatatatacatattttgatatttaaatataaaatatataaatgtgtatttactttatatttgctgggtaattttaaatgtcccaagaaacatgcaataagtcttcacttaacttcatcgatagggtcttggaaactgcaaccttaagcgaaatgatgtagaatgaaaccaatttgaccatcagctaattggtataaagacttaagttcctatagtatctctctggtcacaaaaacatcatcaaacttctaaataaagacctaacacacttctaatattaaacattaagataaatgtgagctatatgtatacttaagaaagattagaggctgggtgcagtggctcacgcctgtaatcctagcactctgggaggcctaggcaggcagatcacctgaggttgggagtttgggaccagcctgaccaacatggagcaaccccatctctactaaaaatacaaaattagccgggtgtggtggcaggcgcctgtaatcccagctactcgggaggctgaggcaggagaatcacttgaacccaggaggtggacgttgcagtgagctgagatggcaccattgcactccagcctgggcaacaagagcaaaactctgcctcaaaaaaaaaaaaaaaaaaaaaaaaagaaaagaaagattaatgaaaataagtaatgattactacccaactattcgagttcagggtctcgggtaaccagagactaccctaacagctgagggtcaaggtgaacactgacctaggacaggatggcatcccatcacagggcacattcacacacacccatacttgctcatgctggcaccatgtagacacggcagttcacctaacgtgcacagctttgagatgtgggaggaaaccagagtaactggagaaaacccacacagatgtggggaaaatgtgcaaactccacacagacaggggccccacccagccagaaatccatttttttctcatcaatgtaaggaaacaaattgaacaaaaatatgtcatttgaggacctgctgtatgtattctgagcacctatattctctagggacatcttgactatacttttaataggattctccctgtgttacagggatagatttcaccaatggacagcctggctccctaatgtatgaacttggtacctatcttcatagtttccattttacctgcccaataatgttttcatcaactttgttacccctcctgaagccacctggaaaataaaaaagtatattccttctgtgcaagttgctgaaaaaacttgggaaagtgagttaattgctacagggaaattatttacctcacttaatgatttttctcttggcttcaatcgggggctttttaagcctcattcatgtcatcctgagaccttcctgaatgatctggatttggcagcctcgacactttagacacattctcactcaaactagagctttgggtgtggttagaaaaacaaatgggaagaagagttaaattcacaaagataattcatctcctctaggtggtttttgcccattgctgagtgcttgtcttctctttccaccaacacctacttgcttggatcttgacttattttggcagttctctgtacatgtaatgtggttgccatggagatgttatccagcatgctgcatgctgtttcatctcctctccatctcttcatttctctctagtgtgtgcttgttctctcacatttctatctcttctacactcaccccaaccccctttgtaattgaagacatcaaacactgtatttcttcaagctattttgcttcctttccccaatcatatcgaatgtgtttttaacttaatataatcaaagcaacctggtaatgactggaaaagggggtaaagaaattgactgaaatgctaaattcctgtaggttatgctaggatgcccaagaatttgagggaattcaagcaagtggtaatcaaattaacttcctttgctttcacagggattaagtctttactgtggttcagagagacttattcataatacctttctgatttccacctgaactacttcatcatgtcctggtgttatctacaaacaagaaatttctgaactatcctcaactcttaatttcccagccatgaaatattcacttcaggcattatttgcatggacccacagggactctctgaagatactgacatcctgggttattaagagttgggccaaatgtagagaagatcttagtgtgaatatcaactattcaccctcaccttgctgtgatgtgtgtagggagtgaggagtgggaaggagtgagaatgggattttgtagttatgtgcacctaaccatgtgaagattgagaaaaagattattcctcttctccactgaggatattttaattttcctcaaaaattgaaaagtactagaaaaaaataatgaataaatgtcccttttgtttttctagtttctcttaaaagacctcctcatctcaatgttataagtaagatgaatttgatttcatttctttccaaactgacaaaatgatttacgttagtaaagaatattcacatattaattttaacatatatttcagattcccccaatgctttgagtttctaaactaaaaaaatcatagccagaaactgcaatatcaagaaattttatttatttttctttcttacggaataaaatatttcagaaacaaagagaaatcgcttttgatttctctaccgatcattaattatgttcactcctgtgtcagctctctccaagggcacaataccatggagagaataaggatttgggtagattacatgatcctcacaggcagatctatgtttttatggcagtgtaatgagaaaaacatcaaaagggagaagtttaaaaagagtctgggcaagaatgaagtcaatccaaactttcatctcattctttagaaaagaaagattatagataatatattctttagaatttattctttttttaaattaataattggaggaattactttcttccacagggaaccagtactcaatgccagttgcatgtgtgtgtgtgtgtgtgtgagagagagagagagagaggcaaaaaaaagtatttgtaaatagattgtgcgtgtgcatgtgtgtgtgtgtgtgtgtgtgtgtgtgtgtggtgtgacatagaaggggtgtgggtgggaatgagaagtgaggaagtagcatgggaggatttcaacactagtcttctgcaagtgaaaaacaaatcaataagtattattgaatacttaccacaagcaagatactagtttgggttctgcaaaggataacagaaggacgagatttgatttttacctttaaatagtatgttgtctatcatggaagacaagatacagacaagtaaaaaattaagtaataaaagggaacagaacaagtcaagtgaacaataaatgaaatgttgaaatgtggactggaggcaagataagacaagaggagagaagaggggagaaggcctcagattgataggaaagtgtagagagaggataagatttgatctgagtccataagcatgagcaagagttggattatgctcaattgagagaaaatggaagaggcagaaagtgtaaataatgtttgtcaggggacagcaaagatggttcttggcttcagcaagagttcatgtaaagatgagagaattccaaacaggtagaagggaccagggtgtagagatcctttgctgagagcagactttggctctaggcagtgcggagccattggagatgtttgagcaagtagtgatgtggcactaagaaatctcacggtaagattaaatggggatagtattggggagggtggcaatgatataaggcaaagggcccaggaggaggctgttgcaagtatctgggtatgagtggatatatgcctggtctagggtaaacatttagggagtagaaaagaagggacaaatgtaagaatcattttgtaaagaaagggaagttttggaggatggattgggcatgggaaattaaaagaaaaatgttggagacagctggaagatttcaagactaaaggaataaggctagttaatatttactgagtgcctactatgtgccaggcacctttccaagtgcttcataagttttaactcattgagagagaggaagaattgaaagtcagctattttgagagcaaagataaagccaatcaatttcaggcactaagagtttgtaatagggataaatgcaagtggagatgactggcaaaggatggaaatggggaataagaggtcagacctggaggagaagaattggactaatccacttagaagaagagtttgtgccatgggaatggctgatatctgcataaaatgagaaataaacagcctgttttgaatttcctttaaaaagtaaaataagagaaaagataaaggcatccagtaaagaaggagaaatcacagatgaaggaggagaactaagataacatagcatggtagtatctagacagaaagcaatttcaaaggaaggagctattctacggtgtgaatctgtggagagatcaaacagggtaagtactgagactaatttatgtatttgattgtccagatcataagtgaagatcagcctgtcctattgagggcaattgagagttgactatagctccaaagaaatactttaatattgtatttttaagtccagagagaatttggatattctgtgccaaagcaggataagtttttgtcactattaaccaaaccaaataaatattctagctcttattgtctgcctttaacaagaactccaagaattcagtcttagactttcataactgacttccttccagagcacgatctaagaattaattcctctataagtccagtcaagcttactgctgtgtggtttttctcctgtttttttataaggcaaattcattcaatttcttcacttttttgggttagtgcttgtgaaatatgacagattgacagcccttagagactggggttctctaattatcctatgaacatagctccttaccagtaatgtgcctctggtctctcttagggctgtaaaaagcctgtgtgtttagttgactttcctgtaggcctctttatggtgatggcatcagggacaatttaaaacaactgatggaccactggttggtgtataaatcataatcaagagcctagggcttggagccattcagatctggatttgaattttagttctaccatcttagaagtttgtggcttctttcttttcttctctactgaccattgcttctcttgacaacattgttcttagcgtggggcattggaaggaaaatgggctttagaatcattcagaagtggatggattcaactcccagtgctcccaaccttgggccttcattatagtatttacctattattttatatcattgatgtgagaatgtaaaataatgtaaagcaccaaaaacaaggctaggcatgtgctcaataaatggtaacattgttgggttttttaaaaaattgagcagccagagcagaaataagacttccaagcaacttcacttatagatcagaaagctatgagattcatttaccttgtggagacaaagttctgaaactatgtgctgaagaggggaaaaatgtcagtcagcatattttgtacatgaagctaaactacagttgacttttaattgatttgattcatcctgggaatccagtgcctaagagcagccagctaattcttcctttcattcatgtgttaaagatgaaattataacagaaagagagaagacaaagctgtaacagttttaaagctgtaagtgtggtggtctcattgtctaaagacacaggggaacctggcttggacttggtcatgttaagtttgatctgagcattcaagtagaacattccaatcagaaatattgagctgaaggtcagggaattggtggaacctatgatagggattttggagaccttggcatgattgttgatgttatggctgtgaatgcatctcagagggagacaatatgggctcaaaactgaaccttggcatacccccaaattggggagtttcaagtcaaagtggagaaaaaatggagagatgactagcctgagttgtataaggagaaccaagatattatcctactttaaataataaagtacaaaaaagggacttgctaaaaaaaactgggagtatcaactgttagagactatagaacacttaggagaatgatgatacagcaaaggctactgattttatttttgttgatctttgtcttagtttattttgtgttgctataaagaaaactcaaggctggtaatttgtaaaggaaaaaggtttactttttgatgatgctgatggctggaaagttcaatattgggcatctgcctctgatgggggcctcagtctgcttctactcgtgggggaaggtgaaagagacactgcatgttgagagatcacatggtgagagaagaagcaaggtcggggaggggggtgcacccagactctttttaacaactggttctcatgggacctgataaaaaaggaacttatccccaagggagggcattaatcttttcatgacccaaacagcttccattaggctccacctccaatattggggttcaaatttcaacatgaggtttggaggggacacacatccttgcttggatggacagacagccaaatcatatcaaccttgtttgattattgatgattttgcagctgtgatagtttcagtagaaaagagaggcaaaagcaaagattacaagggttaaggagtgaagtctggggaggaaatagggtcatcaggcgccaattacttttttaaaaagttcccagtaagaagagatagaaaataaaattactttttcataggggttgaaaaatctctttgtgatttgccctggtcaaaaaagagttaatggtataaatgcacagtaatttcagaagcattaaagagcatgtttccatggaaacatcaacctacagagggagagaaagagctaggatcccctgacaaagaaggaacagcagagttctagcccccacacagtacagcagggagagatgattacacgtttctttcagcttcccagtgaagatgcaattggggttcatggtgctgtcctcttgaggatgagaaaagaaggaaatggggtttggtttgaagaaactcttggcctcatcttgcttgaaattctgactcaagggtcaatctcattttagaatattggaaaagatcaatggatatctttaactaaatacataaataaatttgatcttccccaacctctttattctaacctggtctagaaacagtgccataatgtactgcgttagagtgaaacttaaagaaactctagaaatataagatgtgggtttgactgataacttttgaccagcacttttgcattgtggtttttctcatctagatgtattttctttgattatgtacacatttggcttcacagttttcagatccataatatccctttcactgccatctagtacaaatttcctgtacccttaaaaccaaccctactgttagagactgttcatctcactgaactgtagcccagaaagctgttctccagaatgtgctacaggaaccacattaacaaactccttattgcaaacaaatcttcctgtcagttcactttctccattcccagattatattccactttgcatctctctcattactctggtctttccttgggagaaatgatttcgttccctatgtgaaaggattttatctgtatggtaggtgtggtttatgactgggttttctgaagtcagagatatgtttttgaatgagtcaacagcttccaccactctctctgtctcacatacatagcatgacatgcctgtctcccctaaagacataatcttcacccaggcatcttgagtcttctctctgttggaaatgtccccttgaccctggaagatcctccctcctttgaccctctcctcctcccaattcaacataatcacttctataaatcttcacttgaagaactctgccaaccattactggaaaactaaattataaccttctttttccatgagtgacaattcttcataacttccactctccagccctgtaagtgaagccatcaccaactcatcatatattcatctaccattttgccccctttggcagagctgttagagggaattgtgaagtcaaaaatatggtagctacagatggggcaggaactgtgtgtatggagatatttcctgtgtgttgattttgttgaccacccaatgtgtaagaggaagtagagagaggctacagaaaggacaaattgaggaaatggagaaagatcaaaagggagagaaaagccttcttattcttttccgttgatatcatacctaggtcactttaggttcttacccaagggcttcttgagtacatatgctcagtaggccttgagtacattctttcagtaggcctgaaagttcacaggaaggaaagtcttcctgccatagttgaatgtcctagagaaatctttgccagtcattgtttacatagcccctgaatagtttttccagcctgtgagctaaaatggatgtcagaaagacaagccttcaccttaaaattattaatagtcacaaaaaagagataacgtagtcagtgatcagctagcctttgatctgccttggtattttctctgggaaggtctcaccacttagttttgatagcctacctactctgggctgcattccaacatactgaacacctaatctctggaagaagaaaggaattttattcagtgttttaagaaagtgattttaacttatatacagcatggaaatatgaactaaaaggaaaaataatccagtgacagtaacattatgcagaaaagctacttggtttcttctctctggggatttctacctttctaacattgtctaataagtctggctttcctgtagcaccttaccaggtctcacctatagtagaggtgactaagagtcgtgagcatgagcacaaagaggaatttcatttttcatcactgagttctgtgcatagagctaaatgagaagcaactttggtattctgcacatttgattaattggcatcaaaaggcagcctcactagttccctaaggaagtgtggtaccttcacacataatcaagaatgtgttctctccaaagggattttaaagagaattacatagtgttcaaagcagggatctgggaggtcagaagggggatcattttgaggaatcatttattctagactaaaattatggaggtatgagcacatcttttgccttccttggaaagtgaactttatattgaagtggtatgatttagtgactgcccactgcaaaaaaacctcacaggggtaactaatcatagtaagaacaaaacaaatattcccaagccttaatagttttggatgttataggaatgagagagaatatactgaactggtagtattatggaaaaacagagatccaggaattaggagacccagactcaactaaatgggccaaagcatgacatcattgtcccaagcttcagagtgttcagctctaaatatgaacagttagactgtgatccaaaagtcccttcaaatgctaactcccctgacacccaggcaatgtaaaaaataggtaataataataacaactaatacataatgcttactctgtgatagggagaattctaagtcctttatatatgttgagagcttgtttggaggttctagaatggaagcccagctactcacatacccttgaccgaagaccggtcctcctttattgggaatggtcatcctcttccactgagcctgcagcttagggacggatgcacatggagtagtgagggaggaaggggacacccgcctagccagccagatcagctgaatcaaccctggcaatcgatggagtgacagatgccgcagccagatcaccctcacatcccctttatatatatcgaaacacaacaatcctatgagataggtaatattattatttatattttttatggtgaagaaaataaggaaagagaggttaaataacttgcaagaccacacagcttcagaactggtgggtgcaggatttgaatggagactgtgactattacactgtttaagaactgtgcccttgttcttaaacacctcgctacactgcctgttgcagtatgagtgtgtacgtgtgttatatacactgtattctttccctctttagttactgtttctcccctttattttctttctattcacctctcaccactaagcattttggggcattgtccagatttttttcattcatttgaatgagaatatcttactaatgagaatgagttcctccatttcatcccagatggacccgtaggtaagtctagagagcattgttccctagccatggcctgccacattgaccctgcttggtgaaaggtggcatagataggaggttatcacagctggtgacagaactccttaaaattctcattgctttgataattggccaaagacagcatctttctggagggaggttaatgttctctaccttcttatatcagtcctcctctgttttctttcattgcagattaaactaattcatggtattcagttgtgaaacagaatccaggtaatagctctctgaaattttttattgttaggccaagggggctgaaagcactttttcttcataatagatggtgaatttacacattgccacttacacctctcatgaattcagttcagcccaaactactaaggggctaaagcacatttctcaccaccagtaggagataagaggtatattaaatttgtatcaatcactgttcaagatactttaatatctcattaacttaacaccactaatttagaatttaagatactttaatatatctcattaacttaacaccactaatttagaatttaaataactgtgatatgaactagcccaaacttgaacattttatgatttgtgaagaatggtttgcaaaataaattaatggtataaacaccatttcagagaaaatgtgttatccactggaagacaaactatttttaacccatctcaagtaaacataaactaatattacagtctgctctttaaattagttattcctgagcttctctacaaggtatcattttgcctaaaagaacagcttaggaaactggcatttctaattatattgtccaaccacagagtttaatatttttatatatgacatatctcaaaggaatcatttaaaacttcttcaaatccttcttccttaaaaagaggacattgttgaccagattgtaataatcttgcctgccatgttgaccacgctaaactggattaatcattttggatttattttgataattatgaatttcttagctgggaaaaattcagaaatttctgtttagtctatctaaactagaacactgaaaatctaatttttaaatatctttgcctcttttctccaataccagtctgtaattaggtagcttttaaaagttttaagtccactatttctaatcctttgggaaattgtttctactatttctagaggtactgtgtataaataatcataatttctaaaaagaaactctagtctttcaaaagaattgtgttttttccattcacatggtagagagtaataacagcagctaataataacagaattatagcaatattactaagaacagtattaatcagatgaaatgtgaggtgataagttaatttgcttcactagagtaatcttttttactatctatatgtatcccataaaatcatgttggataccttacatatacacactaaaaactatgtttaaaaaagaagaaaagaaatgtagagataaacaacaggtcaaaggatcctccctgtagcttctcacaccagacaagtaagatggtatgaaccacctgttttatagatgaggaagctgaaggctttagaaggtgacacatgcatgatacaaagttacagagttacagcttttcagagccagaaaattgcaaaaaaagagggggtcaagaatttgtcccttgcctggaactgtgttcttttatcactttacttttaatagctagagaaggaaaatgagagatatgaaaaaccgccactttttaaaagcatggtggcacatggaaagaacaccggactaggggttaggacacctgggtcctattctcagccttgtcatctaatcacaaaagccctgctgggctttgtctgtttcatctgaagatgaaaagattggatgaaatgagatgctatctcttctctgattgacacattagcagatattaattttaaaaatctagtgcttgtaaagacatgcggggtaaagtaagtactgtagttctagggctgttggttggctgggaaaattctggtagagctccttcgagtgcctcccactcaaggtatgccgctaaatcattgctgtgggtatcaacgtggtgcagtagatgagcttggagtggcatggccagagtcagagaggcagaagggctctttaaccttagcctgatcccattaagctcactgtggtgtgactttggccatataaagcaaatgtattggctctgagcccatcaggattctgaggctctttctcaacaagcaggcaagcaggtagattaatcatctaagatagattttgttttatgcagtctgtattagggatctatatagtccaggatgtgccatgtgattcaagaatgctaaaatgcacatctggagctctgtggaactgattttacttcacttggtgatcatggaaggaccctgagctgagagtcagaagacttaagctccagtcctgaacaggcaggtcaccttggcaaagttgttttgcatcttgggacctattttctcctctctaaaatgaaggttctctatggataatttctaagttctctcctagttttagcaatgtgagattctgtgtaatattagaactatatgaggcagaccatctggtttcttaaggttcaaactacattctagagacaaatcaagcaatttaaaatacacacacacacacacacacacacacacacacacacacacacacacacaaccttgatgggacttccaggggatttgagtctcatgggcagaacttctgcatttggctgccacttgaagcaaagctttttgactgtgtacttgaggatgacatgtttggagagaaatagaatagctatggcatctcttaattataatttaatcctttacccaggattcacacatgaacgtttcgaggttctaattaatattaaaaatcgacaaagtacagccagatccaagggtagttggatattttcaggtcttatggaaagttaaattgattaatatagccatttgatctagtttagcctccatatgtagaagccaatctccatttttcagatgtatttcattgataattgagtcttgttaaaatgtggttatcacacttattcactgaggtttaaaatcaagcaactttcttgcctttagactctcaaattatgctaatatattctttttctgaatttttcctattaaataaccttatatttgtatcatattttatatagttttcctatccactctttcatttggtcatcacaacagacttctctgataagctggaagtaaaatgatgtctccattttagagaagaataactgagattcaggtgccaagatcacatgtctagaagtgaccacacccccaattattttttcacacttttcattaccagtgaatggatgggtttgttctgctattcaaagggcatcttgctcaaggctgatgtatatttgcatgctcctcagtaatggctaaatgttctcacaccacaagaaattactcatgaaaacacagtgtgaatgattaatctatatgctgctgacagatatgaatgatgaaaggatactttggagaagaatattttgtatattgtcataaaattttactaatgtttttgataagtgtaaaatatgtgaggagtgcttaggtagataaaatgaacttagagctggaagaggaggagcaccccagaaagagaacaatttctaaggaaaatcagaaggcgctggaacaggaatagccagaaaaatttacagaccaattacattgctcatgagtgtgatttattttctgcaagttcaaatttctcaacttgtacacctaattcaatgctgtccccttcaaagaagtcatcttgagaggctatatagttattccattgatgttgcttattaattgaattatttttggaacttctcttttgtaattgccttctgaaatagatactttcctttaaatattcttaatggtgttttagctaaaggcagaattattcagcacagtgtctgataacaaggtggatgcttacaccagataatttatttccctcctatccttcttcttccttacccctctctcctccatctctctcttccttcctccttttcctctctttctttccttcctctttccttttcttcctttttccttctttccttcctctttccttttcttcctttttccttctttccttcctcctttcaaaatagatgagaccaaattgttttacatgtctcataaactttatttgaagactccagaaattgttcagggtctttgtagtaagaatacattttcaagtatattatattagtgcttatattctagtttgttggtttaaaatatcctgtctcatggttttgtaattatattctatgcaatgaattcttcagggcctttggttggagtgttagagtcattgcaaactataagagacctgaatattaccttcacactaatgatgggcttgggtgagccgctctgggctgagagctgaggaacagggcaagaagtggagcagattgagcattgagttgtgttggggatgctacatgtcactgagtggaggtgtctggagagagcagccaaggtgggatggtagaaaacacgaagccatggcatatgaggaatatgtaaaggccttgggatgctaagtctgatgttgtatatgagaatcaggctggtgtcaggaaaggacatgaaactggagatattgcttaaaatgttacttctgctcccaattagctgtgtaactgtcatactggacccttgttgactccaatagcgatggcaccatatctgaaaggcctaagaagagacccagagataatgaatgagacataggatttactggggaaacttacatacaaggacaatccagtggtggtgggctggacaggagaactgctaccatttgtaaaatgcatgcagtttatatagcattttcacttagcaatgttcacctaaacgttcatttaacccaaaacaaagggctctgattccctgtatggcctgcattccagcagatgaactgggggtttagatgtccttcatagataaaaagtgaatctctgggttggctattccaagatttcttagcttaggactctgaacatttttcttagacagtagggtcattctcagggtatgcataagttattgctgtcaggtgcatctgccatacaataacattggaaaataatttaacctccttgtgcttgttttttaatccatcaagttaaaattacggaactaaaagagtttaacaggtctttaaagagtaaaattgatttcataagggatgtatgataaatgtcttcaaatacttgagaaactctcatgtagaagaaggattagactaagactgtagaatctctaaagaggaaacatgtatcaaagggttgcaggggaggaggtttcagctttaagtaagaaagaactaagtagccaacaccgagatgcctaccttgagcccagaaggtgccattaaaagttccccatcagtgaaagaattcaagaagagctaagaagaccaatattatgatatagaagggaagcataaactgtaagaagtggtaggctagttgattgtgaaaatctctttcaattctaagattctaggaatcgctactcctttgggatcttctgtgttcttgattgcatttgtgaagctacacaggaccagggaatgacaggcttaaacatcccaggtagttctggaaatgagaagtgatccatgagggtttgattcatgctgcataagcatcattagaatcaccagaagaatatgcatcctagcaacctggttgtttaacctaatgttacctggaagaatcaaagaagacctcccagtttcattgaatgagaggagttaaaaaaagagtcttcaagctgcctcctttagcatcctcactgcagttacaagataccccttttgcttcttagcagggacatggtctcacaagaaacattaagcccaaggctccagagtaacatgtcatatgaacacagagctaatcattattgattccttgggccattatggtaaaaagacattaattaccatcagtgcagttgcactaatgcagttgtaatgagcatgcctttgggaattcccagtgaagggactgctcatcagatgacagcagccagaggggaaaagggtgggctgaggtgaaggtgtccgggaggaagacagtttcattggtctgactctagttacctccagagtttctgctaatctatgcacaagtaaccagagcactctgtgaaatccctttcccaccttttcccattccttagtattttctgttccctatacatagtgtaatagccctgatttccagatgcatcctgtcatatcagatccctgcttactgtactcatctcacaactcttagaagtatgggcttggcaagaccttagcaagagttaaagagtatgtgcatatctctgggatagagggagactctaggctcctacatgccacctctgttagcagaaagttgtcttggtacactcctactttcatttcttatctccaccacttccaacctttaatccacctttgttttttgatagcaattgttagcacttaatgagactctactatgcaccaggccgcatggtaagtggttaacctaagttatcccctttaagccttacaaacctaatgaagtaggtccctttattaacctagttttcactgatagggaaaaacacagaggctcaaaaaggctgagtaatttgctcaaagtcatacctctaggctgaacttaaaccaaacacctttttaaaaatttttatttttaattttaagttctggggtacatgtgcaggatgtgcaggttcattttataggtaaacttgtgacatggtgatttgctgcacctatcaacccatcacctaaatattaagcccagcatgcatttgctgtttttcctgatgctctccctctccccacttccctgcctacaggccccagtgtgtcttgttcccctccctgtgtctatgtgttcacattgttcagctcccacttgtaagtgagaacatgcggtgaccaaacatcttttatttaaaatttttatattactttttcatgtgattcctactatgtgaaaacttggatgactctattgcataatcaaatgcgagttcaagaagtaccaaatttgataatggtatctgtatttctatttacttgtctgtctccagccagctttctctctatatacctgactgccttgttcatggtataccctcttcatacttttaatcttccttttattttatctttacaggtatctgatcaatgtcacttttgaggggaggaatttgtccttcagtgaagatggctaccagatgcacccgaaactggtgataattcttctgaacaaggagaggaagtgggaaagggtaagacatgtctttgacaattcttgagcaaagtagagtagaaatgtgaaattttgcaacacaatgaaggaaagtagtcctttggcttttgtccctagacctgtggagcaagggatcaataccttgatacacaggagaagccatttctcaaacttgcatgttcatttacttgctattttggttaatcaagggattgttttctttgtgtattaccatttattgttgataattgcattgctgtctgaatcttgactttgtttttgtgggagagtatgtgtgtacaatataacataatttggtgaagaaactgaattagtggtatagttcaggagttgtgtcctagagagcatctgggaagcttataaagatgaatttatgagaagaaaggtttagacttattgtgattgaaggattcccatgcaaggctctgctcaatctctcccactgccagttgatcacagtgtttgaaattctaccatcagaaattaatttctgtgggcaccagactgtctaggtccaattcccagctctatgtaggatcttagacaaatctcttcactacttgatgcctcagttttctcatctagagaaggaaaataataataatagtaccaacaggtataaggatgaagtatacgtaaagtatttagaaagttgcctggttcatagtaagcactcaattagtattacaattttttattattccagattcccagttgaatacaagtattcctgagagtaatgtcatcactgatttttctccaaatatgttctgcagtgctcttgtctctcaagacattttgctgaaaaatagctttacagatacataaggttgggagatgctacctactgtttctcactctaggagagtcttggaacatactaacccttggaagttcagaggtgtcttatagcaaagaaacatctttacttttatttagaatggaatttcctaaaattattctaccttgagacccctttgttcatgatattcatattctgtgaaaacatgttgggaaactgatttaagacaacttccacagattccatggaccaattggctgagaatgggcttcaaaatgttagcatagttctgcctagaatggaaatccagctatatatttctagagagagttaccagaaaatgaggccagagataaacttcttgaaattcacaacctcatcacagagagccctggacagctagttatgtgaatgtgtgaatgctcacccgagaaactaggcatgtgtggctcaggcagtagaatccaggatctaattcttcaagttgaaagacctcaatctatcatgcattttctcttatcagatagggcacaattataaggcttaaattatgccagctttttatttaatcttattcttttgagacagggtctcattctgtcactcagactagagtgcagtggtgctgtcatagctcactgcaacctcaaaatcctgggctcaacctgtccttccagctcagcctcccaagtagctgggactataggtgtgtatcaccatgcctggccaactttcaaatttttggtagaaatgaggtctcactatgttgcccaggctggtcttgaactcctggcctcaagtgatccttctgcctcagcctcccaaagcactggaattacaggtgtgtgccactgcgcttggcctgcctgatgttcttgattaaagttgccctccctccactgagttatcatttgttcagaaatggttgttccctgggcttctgcttttcactacaatcaagctgctttcactgctgctgtagagatgtcataatttaagaaatgttctgggttcttcatgtataacaggcacttctgtctgtctctagaagaggaactattaataactgaggcttcataggtagctcataagatgtacagagggggcagctttctttgcagtaggctcacaattactgtctcaagcaggaggaggcatctcacaacagccttttcttaaagagacaccactcaccatcaggtcatattgactcctcttcttgagtccagaatctgaggcctgcatcccctacccctttctagaactagaccctacttcctagggtttggatcccttccctcaccaattctatttttattctagctcttgaatttattctttactttatatatgatccagggactatgtgacaattttttaaatgggcctccttgtccctggtacctgcctttactccttcagattagtccaaaatatggctgccagaatgagcttcctgaagcacaattctgactgtgatgttccttctctgcccaaagccaacttgagccttctatggtttatggactggggctagacttgatctgttcttgcattcaaggctctggtctgccttccaagcctttattctcctcctcatgatttcctgtctcacaattaagctaccctgggcttcttcttgttctgagaatgtgcctttgtaggtcccgtcccctgtacatgtcatgatgtgtcttcctagaatgaattatccaattatataatcataaccatcctttgaaacccaattaaaatgttgcagcttcctcccctcatctttgactgagataaaatctcacactcccttgtcccctatagattttgtccatacgtctgtggtagcacccatcacatctgcctcttgttagagttgtccatatgcaagcttccaaagggcagaggctgtgtctttagctcaattgtgtcctcacagcaacctgtaagggcgtatttcatagagcagttcaataaatatttgtagcatgtatgagaatcattacataataaaagaatcccaaaatctaccattaagaatccaagtttatgttgttgcccttgatacggtagctgttgtttcatggggaggggcaggagaaaatatttgtgtagattgaatttttgtagatcatactttacatgtactaaaggaagttgctgtttaaaggaattctgtggttaatctttttgtagggcatttgggaggggttgagataatagaatagaacattttcatatcgactcaattaacccagggaacactttggaagatagatgtctagtgttcattgaggtcatagagccatgtagctccccaacttgaaggcttctattagggctcacctgtgggcagggaggatggcaggagccaggtgtggctccagggaatggctgggttgtggtgagattgcatcatggaaagttgtattggtccttccactgttatcctcgtccccaggacgtcatcctcaagacgcctaatgctgcttcagaaagtccccttggtccagggaggatttagtgtcagtggactccagggaggcaggcaccagggtgaagattctacagggaggatttgaacactggacagataagcaggggaggaatgtgggtttgtggaagaaatatgggctacagataggactgtcagccactggtcaggccactaactagccataggacctgcttttttcacttttctacatttttcttttctcatctctaaaatgatggcatgggactaagaagacttcttgggtcctttctagtgctaacttctgggactgcaaaatctccttgcaaataaatagcagattggaaaagaaattgggtgagggatggaacacacaggaacctgagcttgttttgaagggcatagctcctaggacatatttgtcattcctgtcatttaagtaaatatttctccagaaaggccctcctaatgacccatgatgaggtagtcaccccgtcacactgtctaacagtagattttaattttcctgaatacactcattatctggcgttttgcttacttgcttgcttgtttgtttattgcctgcctcttcacaccaggatggatgcttcctgggggcaaggaccttgctcacctctgtaattctgacccttcagaagagtgcttgccttcagtgtctggaccactcaaaagataattgctaaataaatgaagaatctgtatgcttaggagaactagaatattgacaagctatttcacttctaccctgaaaatctcccatttagacatagaagtttactggagacagcatgggaacaggtaacttcccctcctctggagtgagcaccccagtgccagggaaggacttggggggaattgtcagggaggcccaactcccagtggagtcatacatgtgtgaccagcttttaacaaggcatctcgggtcaaggaagattaagttgttggtgtgaaccatgtgatacgacttcccaatgttcctttaggttcctaaaagtagtcccaatgctacagtcttacacattttgttcccttgggaagacttgaagtcaacacaacatagtctgtggttttggaaatcagaactgagttcagttctccatgttgccatttatcagctagtgatggatactacctgagtttgtaacatagggttttacataaggctgttgtaaagattcaaagaggttttacagtcaaacatcagtgaatagtcactgaaacagtcagtctccaacaaatgtcaattggtagtcaatacccttcttgtgtaatttttaaggtaatatttgcacatggtaaaaaatcaaatggcacaaaagagtatccagtaaaaagaaagtcctcttctcatctatgaccctttgcttccctctccagagcaatgctgttcccagtctctggaatcctccccagagcaattgttattgccaatttcttatgtactcctctgaaaatactccaaacatttacagatttgatacatttacccaactactttaataaaaaaatgaacagtatctgctcttgtgaacctttaatgggatcctatgtaaggaacctcttggaggcttagggggctagaatagcaaagagatctctggatcagaatttgattcacagaaagccaagaacatctccctggtatgtaggaatgtggagaaggacatttaaaaagaaatattttacacacacatatgcatgcagacatagcatggtgagttggaaagggtagaaatggtgaaaaaaaaaatcattgtgtgcagactgggctcatttgtaaggctcctaagtgggggacagctgcataaacttgctttaaaaatagtctggcacagagatgcagttccaacaagctttaaggcttctgtctctatcagagcctctcatgatttgcttcattgctactgctctctgcttccatttaatcgttcctaaaatggtgataataaaaatgaaatgcagtgggggtgtgctctgagtaatgacttcaagaaatgatgatggtgcatttttgggctctgagatgtaaacagaccttaaagggactgtctgggtcagaattaaaggagaatatgtaagatttgcatctctgcttatctttttcagaaagagacaagagggtgttttataagcccactccctcttccctgcctccacctaccagaaaactcccttccttatgtagattaaaaacattttcagtttgtgtagatcgttctctggactccccaaacctgtttccatctatggctttcaactctgagatgtcacagccacatccaccagtaaaggagagactagaaatgaaagtgcatggcacacagttttgaacccatgatagtactcaggaattaatggatggatcaactggagggaaggagtgcaaccaaaccgagaaaagggagacccccacaagagctgaagcaatgaaaatgtagtaaaacagaatgctctgccagtatctgcagcctggaataaataagacaggctaagggacgctgtgtctctggtgacctcatgtccaggaggtagcaccaactccagggtgtgggggctctgtgatcctagcccctaaggactatggtgatcatagtccacaatgatcaaatcagtgtttatacaatagaggtcaatcactacctctattgatattacttgaaagcttttgactggcaaaataaaacagctcctccatccccgctcatacatattcactcactcagaagaaactggcacatctgtgtgcctctccactatacctctgtgcctagcatggtgtgagacatcactgagcaggccagtaagtgcagtgttggtgactgcttgggcacagctggacagactttgttccacctcccagcctcagaggagaggccaggggatattcatgctctctccaggctctacagaaggcatctaagggggtgaaacagaagctcctcatggcaagcgtgtttattcaggatctcctgataccaccgtttgacaacatgctatttttactgactttgaactgagtactaatatgcatcattggattaagggattagaagacaggatccatggagaaaggctatgggaattggggttgttaagggaaagaaaaaaaaggcaatgaggtgatgacttattctctttaaatgtgtgaagaataattgtaccaagtgtggagatcagctgttcactttctcctctgagacacaaccagagtgagtgggcttaagatcaagcagagagggtttatattagctaaagggagaatttcttaacagagagaagtgttgagtactggaactgttaacaacaccaggggatgactttgaaagtcctcaaaattgtatatgtccttgtctctctgtaatgtacagtcccgtgcaagcaacaatgcgtgaactaaatggcttatcctccctatctccccacctcccctccctcccctccccacctcccctccattccctctccacctcctctccctccccttccaaccgcccctctcttcctttttacttctccttctttctctttccttttccttcttcattccttctttccttctcacacataattattaagcacctatcatgagccaaggactgcccccacaaatttgtatcatagctttcctggtggctgggaaaaacaaaacaagtacattgcaataaaaaaagtgcttgttgtgatgtttaacatttctataaactaaggtgatttttaaatcttactatttgataccatctaacattgggttgatgttcattagtaaagactccattaatgtgtgttttacttacgacaatgacacggggccactggattacatattttgttgtgtttttctgagttgtgattagtgcagaccctcacatccagatgtttccttgttcactgagctccaagagccctggcccatcctgtttgactacaccattctccagggttccagaaagagattacaggaggcagccatggagaggaggaggtagaggtgtgctgttaatccctaaagtctcaacactgctgtaggctcagtccaaaatgtcaagctgctactcccatgcacatttatgaaataattcaaagagaagagcaggatgtattgggggaatagactttggaatatcatttcagaaaggctggttgccttccagtgcttgtcaacagccactgaatgaaaaggataaaagaacaagataaccttggttgactttacttttgaaacctgtacatgctgatggacagagaaagcagaattgaattcagagactgaagaagtgctggcctaaccttggcttcaggaaaaacagtgaaaaggaaagtgttcccaaagccaaaagatggctttcatccatctcatttaaatgttattgagatttttgtttcatgacagttatctgtggtttgtccctgagtcctctaaacaattttttctaatttttattttacaatgcttttccagtactggtgttgaagaagaaagagtggtagagagatgagaaaattctatgtttatatctaggttaaaaacaacatttatgattttcttattatgtaggtaattaatgtttattaaagacatttgaagggataaaataaaatttacccatatctgcacctacaaagaattagcagttatattttaaaatttctttccagtgttttttttctgtgcattctgtgtgtacactgtaatacaatacagaataatacaacagaattggcatcttaatgtatggataatttgcaatctacttttttctcttcctaggatattgaggacatgttccctttttattaaatgtttttcaaaagcatgaaacttaatgccgaatattacactgtgagaatataacatgcttcttcaaactggttccctatgattagacattcatatgcatgttaaatagaaactctggttctcatatgaaaataatttcagagttggtggtctaactgtgatgccataagattgctttttaaagtgagaagatttgtccccttttttttgtatccaatgtccctaaatgttaaaaatgaaaacccttaatttgggaattggtttgtttatatcgattctgcaacaatcaggggacacatatgcagtctggtggaaggctgtcctttgttatttcgggtctgctaggagtcccagagggttttctctttttgatcttctcatacagtgcgctgccttctaactttgttgagatatgtatttcttatctttggtagttacatcacagagaatggggttgtccatgtgttccatgtctgtctgcatttttcatcatgttggtttcattttcttgaaagttgagggcttgtaaaattcagactcacgttcccaaggagtcatatgactactgctcagtatgagaccctttccagcgctgtttctattctgtggttcatacatgacccagaagggagagagcaatgcccttctttcaccagtagggatagaacatacctgacttgctgctatagcagtatattataaaaatacctttacatatttttcaccaaacaagctactttgtgcctatattaatagcatattgactttagctaagacctgaagtttggcattaaagctaaaatacctgattgtccttcatatgcaaacatgcctttattgatctagcacccgaagatcttatgcgttgagtttttcctgcagtgatgatggatttgtaccagccatgcacaggctgtatctccacaatacctatttatgagagctggccagaaacagggtagaaataattcatgtatacaggaagagaagctctgaccttggcatgttaactctgccaagcagcctgtggtacaaacattttaaaggaagtaatagccaacaacaacaaaaaaataaaatttaaaaataataaaagctcttaataaaaaccatgaacataaatttcccacagcagccatagcattcagattattcagggtgattttataattttctctgttagggttatttctgctcataatttggtgaaccttttagtttatcctgacagagatgtcttaaggtggcttgcttaggagcttttctactttccttccaccctccctctctcttctgtggccaggtgtccttcgctgtcatagaggtggcccattgctggttttacaggcgttccaggtcttagttctgtcagctagctgttctgaaggtttaaacttaaagcaaatctgtgccaggggaatggtgagaaagaaagtatgaccctggaaggagaagagtgcacatagaaggcagtcactggggagggagtgatggacctcgaggggaaagaagcccgtgctccactgccctattctccaggtgcacaccacattcctgctcacaccaaacttctggtggatgcctttccatgtttttctagctcaagcgtttgctgtcagatgtcttctgaggtcatcatctttgactcttcctgaaataatatgtactcgtttttcttcattcatcccataggaaaggaagtttgctggcaaaggaacagaatattccctttgaggtaaaattcatagtgaatatttaaggcacctcagcattctctttatagaaaagtgaacacaaaattccattttccctataggatctgggaaagacatataaatgatcagacagtctagcctggaattaagggacattaggaagatttggccatgaatacatctgacttttatgtaacatgttattagcaatgttattaatggacaaatttagcatatatgatcccattttgattcctattaaaatgttgagaaatacttgtacatgtaagtaaattgaggatcagaggtcacatgattttcccaaagtcacatagctaaggagtggcagagctgggtgtagacatttacatccagctccatttgtgtccagtgtgctttttgcctcaatacatggagtataagagtacaactagactaatgggatccaaatgtagcaatgtcaatggggataaattcatagacaagaggacaagtcacactatagaaatgtgcagaccctgctacttgagttttaaaactacgtgttaagaaatggtccagcatctggggtggagctggaggtgtggaggctggttagcccagactgtgactggctatttcagtgtaacatttttctgtgattagcaaaaatagaaggaagaaaggaaggaaaggagagagggaaagaaagataaaggggggagaaagctttcttgtatctttctatacttataattcctgttatcacacacacacacacacacacacaaacacacacacacacacacaaacacacacacaccctctcttttcagttaggaactcagaacctatctcctcaaactgtgaggaaagaacatgtttctttgaattacaaaggccataactacctacagaaacagctgtctaggtcctcattgcatggaagggattttcgaggaaatagtcatcttctgaattaaaagcttttctaaaatcaaccatcatggcagtggcaccgtatccctgcagccccattgatcagacatctgttggaggtgcagagaaatgtcaaaacactgaggggaatttaaaatagctgacctacaaaaacagctcttaaaccttagtgggacagtaacatgaaaatttaactgctttatttgaaacacaagcaaccaaatattttatgaactcaactagctaagggagaggagttttgagatcttacataaaatgagataaattaaactcaattaagttaaaaaaaagtataagaaagaaaaagtaggaataaaattcaacaataagaacactgatcttcaaattcatcattgctgcatcagtgtttcctcacatgtggctgtgaatttcaactgtagtatttgagttaattcagaagggatgagtatttttttgtttaaataatcatctatttttatagttatcttctacttttgggaagtggcacaacttacatttatagtaatgatacgaattttttgatacatatattcttaaagattatttcaaaaattagtataggtggtatacagatgtggcaaaattgttacagtactacttgaatgaatgaaatttgggaaacatttccacagggcaaagtgttcttctcccccaccccagccccaaaatcatggtgtttgaggttgacccaccttcccttccttttccctcctcacctctctgcattcagcctccatgcccaataattgcaactaactattctccagcacctcttgtgcttttatgccttaagccctgtcttatgcttttctcttgaccttggattcttgaacttgtcttttgacacacagttcaaaaaccaagagaaaccatattttggtcacctctgcccagtgcagtgatttatctaaataaatttaaataaatattattccccctttctgtgcctttgtttcttcatctgtaaaatggggattataatagcacctacctcaaactgtaaagttttaattttgttaaaactaaaattataattcatgtaaaattcttagcacaatatctgacatgtagcaagtgctactctcgtgttcactatcattttacttgaacacattttaaaccaatgataatacaaatgaaattagattctagaaaacaggaaaatggaaaaattgaccatacttaactacacaaagacacacacaaactagttgggttttggccttagtcactaacaggaagaaactagaaaacagtatatagatttttgatgtgcctagttataaatttgaaatgagcaagcttttttccttcattctaaaatgactttttgcacagggatttttaaaaggtgagtcttaattaataataaaatactgacaaagtctacagcatagcacagcagcccatgctgggcctatcactcagaaatcaggcaattagaaacccctcagttttgatatagcacattgtgggttctcagtaaccattaaattacaaccaaaacacattaagcaataatcacagtttatgaaaccttatagtgtgtccttgtgctatttgatctacttgggtgttgtttcactgtaataaaccaccatgttgtggttgatcttaaagaattgccaattttccctttatgtcttccttattctgcagcagatagattagctcataaccattaaaaaaaattccttctgcaagggaaagtggtttaatgtcaaaagacatgcccatagtcatggttagtcatagttgaacataaaggggatggcggtgaaatggtaggtgaggggagtggtgaatggtcttaacaacagacaactgaatagcgtttcacagtttacatcagaggttctcaaagtgtggcccctggaccaacagcattagcatcaccggggaacctactagaagtacagattctcagcttctacaccagaagctctagggatgaggcccagtaatctgagttttgacctataaaacataagggccgctgatcacagacatttccttttcacaaggagaagtatctgcttaatagatatttaaggctgccactctgtcattgttctctgttctcattttattttccagccattaattttataataaaactgaatctttatcctttcataaagtggaggacagagccagtagcccagtaagaaaaagttaaagcctgccctactcactccagaagattcttaattacctgatatcttcatgtagttgctcaagacattccctgacacgaggccgattgggtttatgcatttggcgaatattttcccgagcccctactaagggctgggcactattctaggtgctggggaaacagtattgaacaagaccaacaagttcccttcctcaaggagcctgtgtcttggtgagtggggccagacaacaaacatataaacaaatcaatacatatgatcatttcagatagtgccatatacgcttaaggtggtaagacagggtgcagtggctgtcagactcttaaggccagtctcaaaggggcttttgatagatttatcattttaaataagttgctagttaaatttcttcagagtatgttcagcagctgtcataagaaatttcactagcaacttatgtaagaactttccaaattatgtccacaagtcctctgcctaaattgtatacagattctgtgttgaggctacaggcccactttgaggccacaggagaaatatgagtagtattttatctcccatttttttctcgctgctagattttagagaatgggtatggatttatataatctgtcacatcaggctatgaacattacaatatttatgcttgatttttccaaaaaatcaagaagcattaaccttcattgtttaataagaactgcatttagtgagttacctactctagcctactgttctaagtgagcatggcatcttttggctttctttcacagctgttacggaaattacttcacttccttgtctccagttgaccctgtaccatcgaatgtgacacaacatgggacctggtgagggtgtataggaaaggtcataaactggcagtcaacagactacttttgggccatcgacatgttctatacggcctaaaaggtatatttaaagattaaattggtttctaaaatttaaaaattcagattcccatagaactccagattctggatttcctgaaaaatcagaagatgggcaacactgcgttcacattctgcggggccgcctttggttggaatacatgctgtccagttcatctcagccccctgcaagtgtcccacctctttcattaattatctacctagcccctgcagacactggagtttgcaactcctagaacacggatgagttcgaaaaagagtcattccctgcttaaaatctaaaatggataccttagaaatgggtagatttaggattaagggattgggcatttatggagctgacacagccttttgattgctcctgcagtttaccttggagtctctagggggcagctgcgaattctgagcactgccttggaaatgcaagcacacggagcaattacagttctgtgttgcacggaatctccagatgtaccctggaagtgtagaaggcaaaaggcactacttgtctgaagggggttttctgtttgtcagacaatgaaatacagaaatatcgacttttaatgcatttaaaggttttaggcacatgaggagtgtgcatttgtcttttttcttggcagagtaacaaataatcctaactgaaggaacacccggaatggcttcacaggcatgagctttacagagaattggagtgatccaagggcatttacctagcaaagaaaggaaggcttcaacagagaaaaagctcagctagaggactaggagaatgaaggaaaggggctgggtaaatgaaacatgtgaatataggaaaaactgaaattagaaatgaaggcagggccagaatgttgcatcttaaatgtaagaatggaaaactgacagcaattaaaaacagagtgatatagtctaaaagtgtagagagaaagcttgatgattttaagtcatgctatactgattaaactgtggagagagaggaggaaaagcagagtcaagaaaagatgaggttgaagttgtcaaagcagaagagccgtactcaagaggctttgaacagtctggctagaagcgaagggaagttaataatgacaataattacacgtgtatctttatattgtgcaagtgctaaataaggatgcaaaggaagtgcttagtctctttttggcgattttagatcccttcatcccaccccagaagttagaaacacttcatctcagaatggaatttcctaatattcatagaacaacattgaccatatagcatttttctactccacaaagctctagtgaacctcttcttctctgatccccagtggtgtttctgcttttcatgtgaaagcagattctcaaagtccacgagaaggaggcattgcttttgctgcctgtatccagagttagcacttttatcaatcagttagcttcagttcaattcaacaaacctaaactgaagggctcttctatgaaggactctgtgctgggtgctaagaggaaaatataaaggtaaatagacaccctgttctcaagaaatgtacccttttaacagaggggttaagaaaatcacacaggtatgatgcagggaagaatatgatgtggtaggcagccgctaagatgacccccaaagattgtacttcgtgttattcatgcctgtgtgtggtcctctcccccagttatgggctaaatttagcaacttgattatttggaagagaatagtgaagtgatgagatgtcagttttgagatgtgcacatgaaaggactagcttctgtattggggccctctctcttgcatcccttgctctaagggaagccagccacctcgctgtgagcaaccctgcccaagtgacaaggaactgatgtccctgagtagcaacagatgaggactggggcctgcccgctgccatacagccctgtatacagccctgagccacaggacccagctaaagcgtgtctggaagctgaccgacagaaactgtgggataatcaatatttgtgctttataccactaagttttataactttttacacagcaatagataactaataaatgataagacaaaggggcttataaaaagaaattacatatctggttaagggaatcaggaagggttttgagaagaacatgattttattgataggctttaaatgatagggaaggttttagaggtgagtaatattggaagtgaggatgatatttcaggcagagggagtaacaggtgaagtacaatatttgtttattgaataagagtttttttttaaaaaaattgtctaggtgataggtacaaataagggggtagagagacatctttaagtaaagattgagcttaaagagcattagaagcaaagatagtttgaattaactcaagaagcaatcggaagccatgaaatgtttgtgagtgggagagtgatgtgattatgacttctcttcaaaaaattcatccagcagctgtgatggggtgtaggaacttaggtgcctgcaggaatgccgcagtcatcttgggcctgaatgaatgtggacaatcatggagcagaggtggctgcgagagtgatggcagaggtggaataaatctgtaacctactgggaaagatgagacaatgaccactgaagaattgaacttcaggaaatgggacatttatgggacactgggacatcaaaacaaggaacaaaattagtgacggggaagcagtttcatgggttcaattttaggatttctaattctgagttactgttgagtcaggagggaagtagaaatgtcaatttgtggttctggtgtgaagataccactaagaatgcagactgagggatgttctccacggaggggataattgaaggctagtgagaagatgagtttctaacgagaacagaaggagagggaagaggaccaaggacatgggctacaggacatgcctctgggtgggtacagggtaagaggagagagtggaatcagcaaaggaaagggagaagtagtcaccacccaagaggttggtagagccaggacagcctgacagcaaggtgaaggcaggggactttaaggaggagaggaggggatgaagcctgacttctcggtggttctcattcatgcatcattgggaagaaatgcttcacaagaccccaccccatcaaaaacagaccatgccaggcaatcacagaacaatgtagctctgttcttttactcattgtttaaaactcaggcattagggtttttcttgacaatttaaggaatagatggacacaaatatttttacccaaatataaattcttattgttcttcagtgatggatctgtgctcttcaaaatctatgtttttattctccagctgaattattggccgcttaaaagactcttcttaagtgtaagatcctaaagaaggaaaataccttaaaccgtggtcttaaatgtattccatctaattatgaggatctctttttcagaatctgaggaatcctgtttcgttttcatttctcttttatgtaacgatattttgttatttgtgtctgatgtcaaaagtatagcagtcgttcattaaggaaaagttaattagagaagagcatgaagaaaataaaatccaccccaaattcaaccacccagagataatttgtttatattttgatttatatcattttagtccttttatctttatattataaatgtgtgggttggctttttggctttttttttttttagatggagttttgctcttgttgcccaggctggagtgcaatggcacaatctcggctcaccgcaacctcagcctcccgggttcaagtgattctcctgcctcagcctcccgagtagctgggggagtacaggcaggtaccaccacgcccagctaattgtgtatttttagtagagacagggtgtctccatgttggtcaggctggtctcaaactcctgacctcaggtgatccgactgccttggcctcccaaagggctaggattacaggcgtaagccactgtgcccagcctataaatgtgttttataaaaacatgtgggaatatttttataaaattgagatagtattatacatcctgttttataatctataatcacaatatgctgtgaatgatgtcataaatatattaaatcgtataaactaaccatttatctactattaaaatatatgaaatatctaatctctgtccattatctatttagattcatgtatttatcccatgatttttaaatttctgcccctctgtactcccctcttccctgccccccaacacaaggggcaaatcttggtcatagcttattggtctgaacgtgttgtattgatagtaggaagatctggcatttgttggctttgccttctgcatcactcactttttagtgaactgctgaagagcacaccaacaggtgtcagggaacaccaaacacctgcttgtgttggctcttcccatatcgctaacatgaactctgctccttctctaagcaagcactgccctcctgggattcccattgcagctacaaatctgtctcctggtgctttctcttaaatgcctttttaaacatgcttaataatagatgagcacctgggcccttcttcatgaaggggagctctagcagcttttagaacatggaaaagctatttggcccttaaaagctgattcttggaatatccccaattccccaggacaccattcagtaaccacgtgctccaagacaggaagtggttttcctagtgggttttattgctccacttccccttcaccttactttttcaatcctgaagataacttttattgactctttgcagtcagtcagctgactggcagcaaagcaactcccaggcccctctcctgctctccttccctactctggcaatcccatgctgtgtgactcaagcaggacatctgtacttgacttggtgcgattgatccgttttctgagtcctagtatcccagaaagaaatgagtcccttccccttggattatcatgtcttggctttgccatccatctagtgggtgaccttggacaagtcacaaaatgtccctgggcttcggtttccatccatatctataaaacaagagggttggattaaattcttatggtccatctagttcaaacaatctgtagttttaagtacagttttagattttccagtgttctgactatggcgtatttttagtgacatctatttattcattagttataagaatagcttatttttagaacttcatttcttagatggggcagctcagtcacttggttccatggtctttgttaacagctaccttcctgggaaggatgcttggaagggaggttgaatttttccactgtcctctttcttctgcctttttagtaaaatttagtaaaattctcagtaataacaacctagagcagatttcttcagaaccttgcgaccagcgatcagagaaagacctttgactctctttgctttgtgcagttgacttatttgtgtctccttcctggaagaaacgttggtgattcgagtcaggctgaactgcctgcacattggtgtgtcatggttacgtgcacacagaacaccaccagtgttccctaccccactgcaaaacagtctctttttgtttgttcgttttattctgtgatcctagatactgttttacgtgtgaccatttgtctctttctctgtaatcttttccttcaaaattagaaacaatttatagggcacagtgatgctttttttcctttttatattttgaaattattattgtattcaggaactgaatcatatgttcatgctttggttgaccattcattcaacaaatctttaatacgttcctacagtgtgctagattctgttctccaaggaaggagattgaggaagatgagtggagagaactgacaggtagagaagcaagagaacggagagggaaaggtaaagaaaaacactacaggagaagctagaagggagtggaggtggagttttctcaaaagaggtaaggaacagcacagactccatctaaggcagaaggcagaggaaatgaaagtaaggaatcagaaaatttagggagtgtcagccaatccttcttgtaagacaattctctcaagcaactggagccctgattgacagataacaaagtgttagtaatagctaacactataatatgtctacagtatgtcagtatttataggtcaggcactgttctaagcagatcacttacattaactcatacaaatcctcacaacattgctatggagtcaatatttaatatgacaaaaacaaatataggccaacaacatgaggcccagagaggtttagtgactttctgaaggacacagctagtcaatggaagagccaggcgttggaccatgcagtcgaattccagagactatgctgacctcccatgcaccactgaatgtaacacagagaaaggtctggtcccattctcattctattgaggatgcagtggggattaatctgcagtagcttctaagtgtcctaatgcccattttccttctcagtcaattcttaccgctgtaaaattcaagcctcatacttgatgtttgctgacagcaagaatctggccagcatttttgctttagccttaggcatggcttgagtatcatcatgactggttgggctgggtggttctattctgggatgaggtaggttaggagaacaagcttgaaaagatgtggcttttgactcactggttttcttgtacatggaaagaagtataagaattttacggcttttgaatgcctttgggtaatcttgtgctcggtgggttttttggttgaatgttgattctctccaaatgatatgcaactaccaccctactaagtcttaacttctctgggtttctcaaaagtgttacactggcccaactcagggaattactaattcacttcttttactcatagggagaaggctgtggaagactgacatttttcaattccatttcttccgttgaaatattgttttttgttctcctgggttcctgtcctttctaacaggtgtaagcctgtttctcctgcttgtaaaaccttcagtgaagtagccagaacctgagacagaatattatcctcaccctgagagctgttctgaaaccttagaatgggctttgcagaactggaggcaaatctagcttttcctcattgtaattgccattgtaacaggtgaacagagatgccaggacctgagttatctggacaataccacctgagaagagcaaaacacaccagcaggatggccagaactggactttggggcttttagcagtttcatctatgaaagaaaaacagagtcagcactttttgtatacaggaactcagtgaaagtaaattgttggaaacagaaccatttgacgcattggcagccagcagtttgggggagccagtcctaagactgttctgtatatcattgcattggcattaacctgtaaggctattatctgaaggtttaagcagagaccatcagagtcagcaatgggtttcttaaaagatgtgcttcctgtcaagattttcactttggtttttcatatacaaacaagcaaacagaattagttaaccattgttggggtctttcattcttctgtttcctgccacttctcaacatgcacacattttcaaatattttcctagagcttctttgcaaagagcccagggaagcttttctttcccttgccacctcctcccttttcttcctatctggccctgcagtgagcttctcattacacctcttatcataataattccagaaataacatctaccttttctgtcatgcctttcatcggaggattcccattgagccactctagcagtgagggctattcagcagcccacccctggcacagcattcctctgcttttgggtcacagacagaaaatacgggaagcataggtacagcctttttggattttgagagtcagaagggagtgcagaaaggaggtagcagagttgcataacatttttttgtgatttttgacaaaaatcagatacttagtcctaagactggctcaacaaatagaaattttagtgtgaaccataggcctgtactgcagaaaagaggaaagatggacaattaatgttaccaattagtggttatagatgaaacatgcctactgaaaatgggtagagatatacttatgtgaaatagtggatgtaaagctgtggtgttaggtgagctcccaccatatacacttgaagagaatgaaagtcgcctactgagttaatattgtactgtgtgcttccattataattgcccttcctaatgccatttgtgatttcttatgtgtaaatttgttaacttactgacatctctctgacatttgatactggggacccctatctccttgcaactcctcctttttttctgtttaagtctctcctttctctgctggctttttttctcactccccctccccttaccttccatctttactcccactctgccttcccttatttattgatgtactccagggtaccgtttttgatcttctcatcttctcagagacccatctacacagacttcatgaaaaatgcctgtctaaaagtaatgcctttcaaatctgcatagcctgatatttctcctgaacccaacttagatgaccaacccccttcttttaagccttaacttttatgtctcacagagaccccaagcccaccaaactcaaaagttaatgccccattttctcccctctctttccaacatgcttctcctcttgtatcgatgttggcatcacaatctacttaactgtccaaggtagaaagctgggacttgctaagtgattcctcttcctcatctatccatctctttgatctaccatctcttctttattttctcttttatcgcctttgtcattgattgcatgaattactgcaatttccttctttccttgactctaatctagcccttttctaatctatccttcacacagtgtcagatggatcctcctaaaacataaaattattcatgtcagttccctgactaaaactctgcaatagtgctccagtgacatcaagatgaaaactcaaagccccgctaaggagcttccatttctattttctttgttaacagctaccttgctgggaaggatagttggaaaggaagttgaatttttccaccgtcttctttcttcagcctttttagtaattctcagtaataacaatctagagcagctttcttcagaatcttgctactgagtgatcagagacagacctttgactctctttgccttatgcagttgaaccatttgtgtctgctttctgaaagagacattggtgattggagttaggccgcctgcccattggtgtgtcttgcttgcctcttccttctctttttccataatttcttaacttatacccatgcataataaattgattatggttctttgaatctaccataccttcctcacctccttgcactgcacatggtttccgctttgtctagaagggccaatattcctcctcctacatcagactgttagcacttggctaactcttcacagttcttgaaggctcagttcaaatgttgccttctctggcaagcttttcctgacttctctgcggcctccattagaaacagattaggtgtttccaaactaaccaacacacttcatccatgcatttattacaccatattgcacttgctcatgtttacttgtacctcttctccagaggatacagagagcctctccacagaggctgcagagaggtcaggaaaagcttgccagagaaggaaacatttgaagtgaaccttcaagagtaatgaagagttagccaagtgctaaagtctgaggtaggaggaggaaaagtggcccctctagacaaagcagaaaccatgtgtagtgcaaggaggtgaaaagggtatggtagattcagagaaccataatacatttcttatggatgggtataagttccctagagtgggaactgactctttagtctctagattcctagtgcatgatgcagcctagaacacagtaaatgctcattaaatgttaaatggatgaacagatcaaatcctgttctcatttaattctcataacgcatcttactggataaatattatcctagttttatagatgaggaaaccaagatctggagaggttagatgactttttcaggattacgcaaatatcaagtcagagaaacgtggatctgttcaaacctcatggacatttcgcatagaccactggactaatttctgtttactggcactagaaaacaacttctgatataggctgttttctagcttagttatgagacaggtagagaagggttcatattaaggagttagggttagagttacactgagtgggaaatatcagcaatggattctaagcccagtaaaatggatggacattatacttgccactatttcacttccagaatttctacaaacgcctataaaatcaacaccagccaatcaatcagctaatattcattgagccaccattttatgctgaatataaaggtagtggtgctattttttgacaaagtttacactgagatatttttctttcccgtctcatctctgtttcttttcccaaaataattaaacttctttctagattcttgtccccactgggttggggacagatgttggaggccccgctgtctacacatggctgctgattaattttattgaccacatgcctggttttaatgcaggacagactccactatcaaagaccattcctgggcccacattgcccttgtcatttcttctcttttctaccataggccatccctgcctgaggtactagaccttgggaagatataagccatcttaggccttggcttttgagacaatcagatgtattcttgctatctctcttgccccttttcttctagcactggcaggtatgcttcaaattggacttccctctcatttagtggaaagatcccagcacagatttgcaaggtagaagagcagagagtaagaggccatatgaagtcctttaggttaaatggtattctctaactcagctttgaccagagagttctgcattcatttatttacttaaaaaagtttgttcagcacctactatgcaccaggaactaatctactactcgagcaccagggttcagtaacaaaaaagacaaaaatgtatgccttcatggagtattcattctagcaggaaagatagaaaatgttgggaataagtaaattatacaatataattatacatcatacaatttgttagacagagataagtgttgaagagataaagcaagggaggaggtctgaaatgttacagggagtgtgttgacattttaagtaaggcagacctcattgagaagatggattaggagttactgaactgaatgaggtgggacttttttcccccatttgccaattgatgttcatgggatataatttcttgttcagaactccagcagaaagaaagggtggctggtcgtcctgaatctctaccttttaagatttcatgggtaagataaatcaacacacatgtaaaggggattttctatcatcttagtgagaaggcacacactatggtctgctgaattgtaagtgagtgagagaaggtccctactatggggacagggcagacttcctgtgatctgattggtgtcctgaaagaagaagagaatttacattgacagaggggaggaaggggacaggtttcaggcaagataatgctgcgaaggaaggagggaagcacatgactgggcatgtggagaaggcatgtggaatactttcatatgaagggagtgtccacatggaggagaggaaggagtgaaagaccaaggttggcataattattgggagatgaagaatatcaaatgcctagactctggagggccttgactgccaagccaaagagatttcttcctctttctgctttgttcataaggcaaactcttccaggaaccatcaatcgaaggagcctgggcagtgcagggcatctaccacacagcatggtgtatagtggctgctcagtgaacacctccgaagcttctgttgaagtgaattgctggttctctagaaggaacatagtaatgtgtatagttttcaaattcttaatcatgtagtttatgctcacatagaaatgttaaactgttagcgctagaagggtacttagaatatgtatcttcatccttctattttgcacatgagaaaaccagggggccagaggtttgaatgatttagtgcaaggtcataccacttagttatgcagaagatggggctcatcttccagattattttccaagcagcttcttctggggacattttcccaaacagtctggtgtccactggtatgatatcttgatataaatatcaacttgtattcaatggaccctaaccccatgtgatctacaatgaaaaactggtttctatcaagttaacttgggaaatgctgtctattatattatcatctcgaagagttaaaatgcacattaaaaaatgtaggctctaagattcctgtagtaaaaaaagttgcttaatttcactatagcatttatccaacatattttactatgatttaattttttccctgaatacctgtaatcttgtggaagtgctcataggaaccaattgtaagctgttctcagcaccagttgacctcttgctaaaaggaaagaagaaggtatataacagagaagcttcagccgaaaacctaaaacactcaaggaaaataaggcagtagagaagagcgagtccctcccacttctatcttctgtcttctctccctgcctgcctttgttccttcctttgataaattacttttgagcatctactagatgcaaatcctcatgctaccggcttcacatacattatcttgcttattcctaacaacccctggcaagatcagtaatattccctccaaatgaggaagctgagctcagaggtagcagggaattgctcaaggtttcacaattacactagtggcagggcccagattcaaaccagtgtgtgattaaagccagtatttttgtccattgtgctattttttcccaggctatttcttcttatccctctttcttctccttctctcccttgtgatgtcaaccacacatagcacatatgttaaaaccaatatcctaataaattaaagaagatactggaccctcaaggagatgtaacaataaggctcctacagctcctatgcctcttaggtatttaatttagcatgtaatttagtattccttaactagatcacaagatcctccagggcagagatttgttatacttattctaaagtcctcactccacacttcctgtgattgccttctgcttggaaggtggagatgataaaatccagaaatgttcattgaactcatggtcctttcaactggaccctgcctattgtcaaaggcgctaactgcaataaggtctttcatcaaaggagaaactgctttctctgtggcagtgggaggaaattttaaatcctaggacttcttatagcaagtgacaccttgccccttaagcttttcacacctgctgcctggtcttccaagtgacttagtgtcacctacttggctgcgttaaagccagtgccagctgtgcccttcatcattgcttgctccaaagaggctaattccaaatgtctgtaaggttgtttagttattaatgtttatacttctctatgctactggattagatactctaggagggtgagagctatgtaaaactcaccctgtgtttccctcacagcactcagccctgggcctggcatggaataagttctcaactgtccgttgagctttttctgaaactgtgctttagaaattcagcaatatgatagactagatagagctagggtttatactactccgtatgtgctctcatgtaatttggcatgtcaatattttgatacacctagtttattactgttctagtgatttaactgtggcccatatataatacagtccaatttggtccaacagcagacaggcccagccaagcctcaccaatgaattttcagcctttataatccacatcaaacagacagcccctaagatatctcaaccaatgctctctgactcgtcaagctcaaagtcatcccactgccagcgtcctttcatccaactgaaaccaatagtattgaggagaagctgcgggattcattaacccagagcatggaaccttattcataggccctaggcttctgcctctggggtattcctggtgagaggctcattatttgtgaccctcagagctttttcctaggtggagcagttatcttttggaagacattcactgaattccccttttgagtgggtgtggacctctcttcaatgctagtcaggctacccctctattctattcagcccctttcctctcctcctctccgctctttcaggggtaagaggtgggcagcattccttaacacgatggccagggaggagggcatggggagaggaacagactacttcaattatttttaacttcaagaccatatacattatgggttcaaaatcaccagaagtcatattgtaatccatacatagttatattcagtcaacaatgaaagttaatgagaagagaattgtggaaaagcaacatggtggattggacagcatttaacctttgggcttcaggaggacttaagtttaagtatgagtcctgttgctttatgggttgtgtgaccttgaacaaacttactcaaattatcaaaagctcacatacttaagttctccaaagcttaatttcctcttctattaaaaagagataacaattgtattaattttctattgctgcataataaatttccatcaacccagtggcttaaacagcacatacttcttatatcacagtttctgggggtcaagactccaggcatgtctttaactggatcttctactcagggtctcaaaagatgcaaccaaagtgtcagccctgctatgttttcatcttgaggcttgagtgaggaagatgctacttctaagtgtctgctgctcattggctgaattcatttgcttgtggctatttggctgaggttcttactgggtattgactggaaacaaccctcagcttttagaaaccactcacagctcacagctcctggccatgcgaccctcttcataggtagttgacaaatggctgtttacttcctcaaggccaagaggagaatctctttctcaagtgtgttaagaagaaattttgtggctgggtgcagtggctcacacctgtaatcccagcactttgggagctgaggcaggaggatagtctgagcccaggagtttgagaccagcctggatgacatagtgaaaccctgtctctaaaaaatgaaaataaatacggaaataagagaagaaggagaaggagaagaggaggaggaggaggaggaagaagaggaagaggaagaagaagaaagcgaaagcttatataacatgacataatcatgggagtgacattatatcacctttgcgattaaaacataacctaattaagggagtgacattgtatcacttttccatattctattgtttaaaagaaagtcacagggaggggattacacagggcagtaacccagtgtggtcccctttgggtgtatccacaataatatctaccactttttattacagtgaggatttaaacagctgatgtatgtaaaacataaaaggaatgtcagtgcctttattcctgtatatgggagacacactaaggcaggtattcttaaagaagaggagtcaaagacagtagatagagttggaggaagagaaatgggtaataaaagaaaagcttagcaaggagagtgcagatgcttctattccaaagcttgtcattagaaatgttgcatatatgtctttgaattactttttgtaaatcagggagagaaacttcctatcactacctctcatatctgccgctgtatccagctcttcgtttttgttccaggtagcagctgttgtagactacttaccagtgaacactgtctggggagttaagaaagaaaaactttcagtgtccaaggtgactgactagaagaatataaatttatgtggtgaaatgatgcctttgagtttcttctaatcattcctctccaatttacctctttctctttactcttccccagattccacaactaagtctttaagagtcacccccttctctttctgttacttaaacatttatttatgtagaacttgccttgagggaaaatgcgagtgaatcagagaaatcagtgaattggacaggagaaatgctgaaggaggtcagggaaaggagttgttgacatcattccctctacctagaggcctaatcccatatcaagtgggaaagaaaatgaaaaactagggtttggagagaaaaaaaaaaggaagaggaggaggagaaagaaattgtttatttctctgaagaaattagcacaggcacacctggttttattgtgcttcactttattgcacctcacagacactgtgttttttacaaattgagcatttgtggcagtcctgggtagagcaagtctacagctgccattttcccaacagcatgtgctcacttcatgtctctgtgtcacatcttggtaattctcacaatatttcaaactttttcattattattatatctgttatggtgatcagtgatctttgatgttactactgtaattgttttgggatgccaccaaccacacccagataagacagcaaatttaattgataaacatcttatgtgctctgactgctccagcaactggcctttctcccatctctcttcctctccttggatctccttattccctaagacacaacattgaaattagtccagttaataacccttcaatggcctctaagtgttcaagtgaaaagaagatttgcacatctatcatttaaaatcagaagctagaaatgattaagcttagtgaggaagcctcatggaaaacctagaaaggctgaaagctaggtctcttgtacaaaacaattagccaagttgtgaatgaaaaggaaagcttattgaaggaagccaaaagtgctactccagtgaacacacatatgataagaaagcaaagcagcctgattgctgacatgaagaaagttttcatggtctagatagaagatcaaatcagccacagcattcctttaagccaaagcctaattcagaggaaggccctaattctcttcaattctttgaaggctgagagaggtgaggaagctgtagaagaaaagttagaagttagcagaggttacttcatgaggtttaaggaaagaagccatgttcataacataaaagtacaaggtgaagcagcaagtgctgatggagaagctgcagcaagttatccataagatctagctaagatcattgatgaagtggctacactaaacaacagattttcaatatagataaaacagccttctattggaaaaagatgccatctagggccttcatagctagagaagagaagtcaatgcctggctttaaagctttaaagacaggctgactctcctgttagggactaatgcagctgatgattttaagttgaagccagtgctcactgacctcttccaaaaatcctagggcctttcagaattcggcttaatttactctatccatgctctatcaatggaaaaacagggcctggatgagagcacatctgtttacaacatgatttaccgaatattttaagcccactattgagacctactgttcaaaaaaggagattcctttcaaaatatcactgctcattgacaataaatacatctagtcattcaagacctctcatgtggatgtacaaggacattaatgttttttcatgccagtcaacacaatattcattcaacagcctatggatcaaggaaaaattgtaactttcaagtcttattatttaagaaatacatttcataaggctatagctgccatatgtaatgattcctctgatggatgtaggcaaagtaaattgaaaccttctggaaagaatttgcccttttagatgtcattaagaacattcgtgattcatggaaggaggtcaaaatattaacattaacaaaagtttagaaaaagtttattccggccctcatggatgactttaaggaattcaagacttcagtggaggagttaactacagatgtggtggaaacagtatgagatctggaattagaaataaagcctgaagatgtgactgcattgctcaaactcatgataaaacttgaggaaatgaggagttgattcttacagatgagcaaagaaagtgttttcttgagatgaaatctattcctaatgaagatgccataacattgtcgaaataacgaaaaagaatttagaatattacataaacttagttgataaagcagtagtagggtttgagaggattgcctccaattttgaaggaagttctgttgtgggtaaaatgctatcaaataatgtagcatgctacagagaaatctttcatgaaaggaagagtcaattgttgtggcaaacttcattgttgttttattttaagaaatcgccatagtcaccccattcttcagcaactactaccctgatcagtcagcagccatcaacgtggaggcgagatcctcctccagcaaaaagatcacaactcactggaggctcagatgatccttagcattttctagcaacgaagtatttttaaattaaggtatatgaattgtgattttagacataatgctattgtacacttaacagactacagtatagtataaatataacttttatatgcacttggaaacaaaaatttgtgtgacttttttatcataatacttgctttattgtggtggtctagaaccaaacctgtaatatctcctaggtacacctggtactaagaatttgacttcttcaaaattattcttttccagactcagattcaagtatcctttagaaaatagcctttatatatttcctaaagaaaattatttacacatttccagtgtaagaaattttagaataactttcgtcttcacagactaagttgatggtcattcatcattgaaaaagagacagttctctattgtgtggtgaggcctttaattggttgctgctataattgatggtgtattcttttgtggcatatactgagtttgaagaataagctaggtagccatgcaatcatagcataatggaaagatttcagaactctacgtcccaaaacccaaagccaagccccaactctgccaaagccagctccatggccctgagcagtcactaaaccagtctgggcttcagtttcctcatttttcaagtgagaattctgaaatatcatatcggtagatggggacctcatgagaaaataacagttatcagagtatctgacacataaccagcattcaaatatttgagcacgcacggagaaggaatgcataagcaaataaacatgcatttttggcaaatgaattctaggcaatatgcaaagctagtctaacttttacttcttaaatgtgtttgaagttgtaatcttatatgtaagtgtcatgggaatgcttataatcaaagtatacatgtaataattagccactgagaataattagcccttaagagagagtcatagcttcttggatctggaaggcacatttgatgaagataaggtctaggctgagaaaggtttggtgactcacccaagatcatacgctgaatagcagagatggaactagaagccagcaccttgcctcctacttagtgctccttcagcaaggcagagtgtgcccacaagtgattctcagggaagaatggtgaaaataggtactgactttcataatcaaaataatgagttggggtttttttaagttacattttagtttagtttagttagctagcttgtttgtttgtttgtttgtttgtttgtttgttttgagacagagtctcactcttgtctcccaggctggagtgcagtggcgtgatctcggctcactgcaacatctgcttctggattaaagcgattcttgtgcctcagcctcctgagtagctgaaattacaggtgtgcgctaccatgcccagctaattttttgtatttttaatagagacagggtttcatcacattggccaggctggtctcgagctcctgacctcaggtgatccacctgcctttgcctcccaaagttctgggattacaggcatgagccatcacgcctgaccttaaggttacattttgagaatgactttgattaattaaatttcacttgtatagaaatacagccttgaattgccaaaaatgttaaaaattctagccaagtaattccagatgctgaagaaggaggcctatattttctaaactgaacttcattaaagcacctgcctatacatttcctctaatgagtaaacactaaaaatggtgctgcacagggctcagtcctggattcatttctagttaagatgatcatccatgactttgttaccgaaacagcatactcattaagttcatagatgagactgaatttaaagtgtaggctaaagtcttgggggatgcaattagaattgaaaatgacctcaacaaattggacaagtaatcagaaactaacaggatgaagttcaataaagacaagggcaaaaggaagtcaagaactcagagaaaataaagacagagaagtataagacatggaaatggcaagtcaggctgagagctacccaaagatacatgggttaccatgaacctcaaattaacgatgcaaggctgggcccagtggctcacacctgtaatcccagcactgtgggaggctgaagtgggaggatcacttgaggtcaggagttcaaaaccagcctggccaacgtggtgaaacccccatctctactaaaaatacaaaaattagctaggtgtggtggcaggcacctgtaatcccagctacttaggagactgaggcaagagaattacttgaacccaggagatggaggttgcagtgagctgagattgtgccaccgtctgggtgacagagcaagactccatctaataataataataataataataataagcatgatacaattaagtagcagggtttagcttatattcagagttctatgttttctggaaaggaaaactatggttccgaagtttttatggaaggtttataccctaaatggttcttctcacaacagagttgtgtccaccaataagtaacctggtgtaacaactaatggttactattgctcacaaatttttaaaaacttcaaattttttttaaacctcattatcttctggttacttgggtaggtaatgagtgctgtccttacctactcgacctaggctccatctcaatcacacattttggttcctgcaggtacagggaaatttggctatgccttggccctaagcttctcattcataatagatagttcagaatggttcaaagtatttaatagtgttgttattacattttttagaatcagccatcactgtgatgcttgaacgttttgtcaacatgcaacattctgtaatgtctagttatttctacttaaagccagattcggaataaaggagcatagaacatgaggagaatccagtcaaagacaaactatacaatagagagggggaatgaattggatgctgagccaggaccagagacaacagctatggggaataacagacagaaggcaagatcaatgtgtgagacaagataggcttaacaatagcagggcaaggggcagtatggaagcaggggttttgactatcacttatgaacgtcctacttccagataaagtcctaaactgaatctacacaggctatctcatttaatattcagatctacatataaatatagttgatatctacatttttttctttttggttattttagagacagggccttgctctgtcatccaggctggaatacagtggcatgatcatagctcactgcagcctcaaactcctgggctcaagcaatcctcccacctcagactcccaagtagctgggactacaatcatgtaccaccatgcctggtcttgtatctacattttacgtctaccagggcctggtatccctcttcctcaaggaagtgcagaatagttatttttccaatgataccataagtggaaaaactagcatttgaaccaggtttatgtgacttcaacatctctattttttcaactcaactgatttgcctctaaaagtgtaaaaagaagaagagaaggtgaagagtaagaggcggaggaagtgaaagaaaagaacatgggaaatttaataagggaaagggatggagagagaaaaagatgaaaaagaaaatgagtagaggaaggagagaagaaaagacaaaagaagcaacaataggataaacaggtaagaaagagaggaaataaaggctccagtgaaatgaaagaaaagaagtgtggaaccccagcagaggatgcagtatgcttctgataagagcattctgagtgctgatcaggtcatctctcttctggggcacattatgcttttccaatcttccttgagtactgggtcctgttgagaactgcagaattttcaggagataaaaagaaccttgtgaatgtctattggaaatcaagagaatgattataaggccagtaagtggaacacgtgtgggaacgtaaaaggagatgggacattgaacgttgagaagtgacctattaatggtcttcgggtatgaaaaagctattaacacagggactgctgaaaactgcaggatttatctggcattagaactgacctcttcagtgtctatgaacactgtgactgcttttactgcctctaccactgcagaatctttgtatttttatgacccatccaagcgctatctggcactagggtctgctgctgactggttgccacagtctatgaatcaaggagcattgctcctgaaattctgctgggatctttagtagaatgggcatgatctaaaccagactaccttgcctggaaagaatatggctttggtagagacaattggatttgatgttttgacactgcaactcattagcccaatgaccttgggcaactcaacttttctccctcctcagtgaaatggagaaaacttaacttagctcactgtgtatgcaggccttcctcagggcttgagagataggaagcattccataaatgctatttttcatttcctttttccttcctctgaggtacaacaaacgtgcagagaggggctcatcttcaccatgggttgtcataattagggaaccaggagtaaggtaactggggtaagaaatggggtaatgtccagaaaattcagacccttccatttccatagatggagtaggatggaatttgccatgctgaggtcaccaggaatacacagttctctgggtaacaggacttcttggaagcttccgccaaccttattttccaagcagttttttagtgtcaagggctgacatctgtgtcctaatacttacattttgaggacagaaccattttgaaatgagagttcaaacagagatggactcatgtacctccagaggtacattgaatttgcaagtgaaaaagatcctttcttgtgttttgagtaccagatggaaaactgaagcccagctcttgcctgtctttggaaagcatgacttttccctagtgatactttctacagtccatggtcagtgctcaagggctgcctctgccaataacccccttctgtttgcatggacatttccattcacattcattcagtatgtacttatgcattcacgtggacatgtcttggttttggtttacttcttgcaaaaacaaaaatcactgagctcaaaatcctttaattatatgattgttatttccaggtattgtagggactagtctcttatacgacttttctttcagtaaccttgtgaacaatagtgtgaaaaacagggtcaagggaggtgcccttgtctgagaagttgtctcttgtgtacttaaaccattggaaatgagcttttgcccagtttctttgagcagaccttgtttgtctctttgttttctcttatgttgtctttggctcaggtcaaggagtacataactctcaccatctgggacagcagaaagatgacagcaggtttttctgaaaagtagaaaccttcctttccacttgagtgagaaatctaatctcgtttcttttaaatcccctttgccactcagacacataacacttatttgcaggtcagtaacagcattttggcctagactcttaaccaagctctgtttgagttggtgaaacaattcactgattgttagtaaataagtaaagcctgggccttatttatatggtacacaaagtagacagtaaagggagaagaatgctgaaatagtaggtggatgatttgaataagtttcttaatagatgcagtttctctctatattctaagggtatagtgtcctaaatagagaagaaaactagtaaatcttttcatcagggtcctgcttactattaggttatgaatgataataatttgttagcttaggtaaggccctgtgtcgtgattatcgttatcattttgagaaaattctgactactccatggactattttttgctgcaagtgcaaactgtatggaaattgtgacatttccattcactggttggtgccaaaacctttactggtgatggaatatctcacttaagaagacaactgatatttttcttgaggaaatgtacacaggtgtgtaattaaatttcacactgtccttttctatacttacattttttaacctactcaacatgggccatgagtgttatgattaaaaacatacaaaggggaacagtgagcataataaccaatggaggttcatccttcaggtttccactgaaacatcagttacctacatctagattaattcctcttcttgcatactaccctgcaactctgcctattttctctttagctctcaaaactcatataatttctcatctattgcctgaatttggccaatgagtacaagattataaaatccagtctttcaacttgcaaaatattctaaatgtcaatgtctctcaaatttgtatcatcagttttgaagcccagactcttatgcccacctactcattaatatttctactgagatatatgataggaatctcaaacttaccttgtcccaatacaaactcttgattttctctgtgagtctgtttcacaccctccatgttcctcattttaggcaatatttattgagagtttcctttactctagatgctgctctaagtgctttacaagtattaacttgtttaatcttcatagcaaccctatgatttaggtattattaatatctccatttaacagaggatgaagctgagattcagagacagagatacagaggtcatacagttcatcactagcagacctgggctttgatttgaagctgtctggtatcaataactgtattggccacagcctaatcactgttctgcccaggatctgtctcagtaaatgtcaccaccattcacccagtggcttgggcccaaaacctcagagttatcttcgatttctctctttctctcaacccaatatcaaattcattagcaaatcctcttatctccacctgtcaaacatatccagaaagtggccacttcacactccctctattgccatcatcacagtcacgtccccatcacctgttcccttgtcttttgcatccactcttgctccccttagtcaattcctgtgtagcaaccaaagtgcttctttcaaaatgtaatagtttgtgtctgctatttgctcaaaaccctgccatgactttccaccacatacagaatacccaaagccttactatggctgcaggcccagcatggtctgtgtcctccctatctcaccagactgattttctgccactcttcccttggttcccccaaggttctccagctatactagccaacttgctattccttagacactccaagcaaagccacatcaaaagatctttgcccttgcagagtcttctgcctgaaatcctctttcttcagatagtcacatgacattcactttattcaagcctctgctcacatgtcacctctttagaagacttttctgaacatcctgtctaactcccatcacacaccatcctctttcccacctttaattatctcaatagctctctctagctgatattttgctatatatttgtttattgtctttctccctcactagaatgttctggagggcagggactagtttatcatcactgtcctcagcacctagaaaattcctgactcctgattgttgcgaaataatacctgctgaataaacgaaagaagaacttatattctaattacacatgtgaatacaggcaacttctgcctaagcttaggtctccatcataaaatctgtgaggtataaaatacctttctcagcataatgtagaggaaactccaatacacactcatttcttcactgccactaactgcctaaatgaaacagaatgccttgcttaaaacaagcaaatggctagattcagggcaccaagttagaaagcccaggttcacatacatgctaatccttctgtgcttgtactctaccttttgattgctacttacgtctgctatttccaacagagactgcagacactgggtgtctgttgattccaattagaaaattgtcttcattgcaaagcagcagggggttgtagtccagatgtgtgtggcatttccatcttcctctgctcctcccaggaccctaaactagtaacatggtgtctgggaaagtgatggaagagtagtgagagggagaaatgagataagtatccattcttcacccagaggagcatttaaaggcatctattgatttcccttcctgtagaaaacaggaaaacatcaaaaggccccctctccatttccagctgacttggtttcaccatctccccttctcagtgtgaagaggtttcctcccattttcctccacagtctacgtttctcagcctcctctcagcattaatattccatcagaccccagaatgaacactccgagtaaagcagtttctgtcctgccttactggaccctctgttggcccaggcacctgaatgaaatctatcactctctgggcagtgccagcacgaaagtgatttccatggattggcactaagcagtgaagtattgactaaaaagaagaacacaaagaggttaaagatgcatcatttgaagattgttacccttctcttgctgaattttttcatagcctcccaataatgctcatccttggaatgggctatactgcccagtcttcagtaaaactctaggaaaaatcaagaaagtagcaacgagttcagataacaggatcctaactatagcaggatcttcagaagttactgtgatagtgagaaacaatgaaacaacacatgtgtaaataaataaaactgtcccccagcctcacacaccttccccaaccatgcccagtatggcagaaactgttgggtacttaacaaaatgtgtttgttcacctttctgggtatacagatggactctatttcccatttatggtgaggtgtggccatgtgatggacccgtagccaacataatatgggcagaagtgatgggtgtcacttcaaagcttagcccataaaaccctcccctgacagctcaactacgctccttttgtctctcgctagttggaatgcagacacctcctagggactttggaagactcctgttgaagatggcagagtctccattggcttgggttcccaaatcactgcttagaaaaggctgccctgccaacctcaatgtggttacacgagctagaaatgaaattctattgtgttggaattataatacatttcacagactatttgttacggcagttagcctaccatagttaatacactggaagttataacgtctttctcaataagtgtatttctctttcctcagtttcattacaagctcctggaaagcagaatctgtgtatcccctaccgtatcccctgcaggatctcatacagagactggcacaggacacataattagtaaatacgttggtcagagagattatgtctaccttttattctggaacatgagtaggaacatggccaaatcatatgggtttttcattttgctttgaaatccatcttgggtgtgaaggatcttttatgtatgtatagcagctcaggactggcatggtcaacgaagtgtgacacacattttttattatccataaatggattatctgctgtgacccagctcttccatcattccggcacattcctcctgtcagcagctgtgtcgtaggcgctgagagggaccctgagccaagggagaatcagaaacaggtggggtgggtttgggggtgggtgctggtgttactgactgggtatgagttgtgaatacatctgcaagtcaaataaaatgttgattatcttttcactattatatgcatcttcttattaactattatgagacataatcaagagttgacaattgaaagatataagttaagaccaggtaggagcaaatgaaactttttcaagtcaggaatatattagtttggcatgagctctctttgaggaaacaagagacattttatttctaccagctggctgcaggtcaggcaggcgatacctggtaaatattaaaatctttgttgtagaaggggatgagttttaccctgcatccttgattactccaaagtaaacttccagcctttatccttagtggcacaggccagtatcctcatgaacacccctaccaccattacctcctacttttctccctgtctccaaagactcacttttggaaaatggttgtgtaaaccagcagttctcaaacattagcatgcgtgaggctttgttaaaaccagattgctgggttctgcccacagttgccaattcagtagttctggagagatgcctgagaatgtgcatgtcaaatgatgcccatgctgccggtcttggggccacactttgaccttcactggtctaaacccctcaacctcattctatatcagtgaaggaatctacaaacatgcacaagtgcaacagccttacaaggtcaaggatcccagcacctgggagtgactttatgtgacttccctttcccatgaagccagattgaggctgtgaaggaggagtggagttctcagggcagctcagtgaaatgtcacctgacagcagggacccacacagtctctcttttgcttctccaaatgtgttccctcatttccccactaggaaaatcaataggttgccacagatgtgtgggtctcaattctggtgcccattagaatcacctgcttagcgattccaatataattggtctgagataggtcctaggtatcagcattttaatcacattacaggtgattctaatatatacactggttgaaaaccacagacgttttctaggtcacttccagatctaccagtctacctgcacaccctccctccccgtggaatcccaccttgtctacctttgcttagccctcaaccctccagcctagctgaactctttgcccttacctctctccacatacattatattccattcaccctgggacacaaagttgcttcaaacctcattaacttccctgcttaggcagaggatgagtcccaaacaactgcagaaattcactgataaaaatatagacaacaaaataggagcagttctagaacccctgtgaaaagttaactgtggaagcagtgggggaacccattcctggaaagtaacttttactcataaagtcacacctgagcccgaagagtacacattacacttaatattggctgcatattatctattctcctgggctggcccaaccccattttgtggtgattcctgcagattgacatgtactttctatttacaagtgactcatgtgataacatttctgcaaagatggtggcttttgcctgataggaattcaagtgctaccttaattttctgttttacttatcttggtacagatgtgaacttaccaactgttagcctaacttactttcatttcattctcttttgtaaactgaactggaagcactggaaccttcttttctgaacttcacttgaagctttggttggtggagattttccagttgagttgtcagttttaataaggttattgtttggggttttgttttctttcaaatggcttaagttggaggggaagtctagtaatttaattctaccatgtggtctggccatgaacccaaggcctgaggactggtgcctttctgctaattaattctcgatgtcagacatctggaaacccgccttttctgcctcatctgagttgactaattaattaagctatgtttgtaaacaggcgttttctcctcagcacttctttcatcatctgtttctttagccacaagctggcgaccccatttaatggtagactacctggccaataattctgttcttgcacaggctgtggaggttcctttaggaggccacttagcactgtgcaagcagcccaggctttggagtgaggcaaatcaggatttgaatccagttgagccatttattaattatgtgaccacaggcaagttacctggcatcttaacatgtcagtttccccattttctccctgcaaaacctaccacttagcccagtgtctggcacatcatttgttactctctaaacactgagtatttttcttttttttcttttctttttggctggatgggagcattcttgccaacttccttgcctttgtccagggagtagctagtttcaaggcacttccacaaatattttcaccttagtttctctcaaacctatatgagggtattttggcaaatgtttttaccctcatattttacagttagagaatcagtctctgcaagtttatgtgccaacatcccatgggcagtcacagacagggcttggccaggtcttcatgctcttggcgaaaatctcttgctttgagaccagatatccgcctgcccttcagtggaggatgtgagactagattataaacactgggaggaaaaagttgcacaagatatactgagagcacctgatatggtttggctctgcgttgccaaccaaatctcatctcaaattgtaatccccatgtgttggggagggacctggtgggaggtgattggatcatgggggtggcttcccatgctgttctcatgatagtgagggagttctcatgagatctggtggtaaaagtgtttgacagttacccgctcctgatctctctctcctgctgccacgtaagatgtgccttacttccccttcgctttccaccatgattttgagtttcctggggcctcctcagccatgcagaattatgaatcaattaaacctcctttctttataaattacccagtgtaaggtagtactttttagcagtgtgagaatattgctgtgtaacaaccacctcgaaacttagtggcctgaaacagccatcattttattactcagccttctttgggtcagcagtttgaattagaataagtttgaattagtggtttttgggttggtctccagggggtcacttatctgatgagtctaccaaggctgaaccatccaaaatggcctaatttgtgggtctagtgttggtactggggatcagatgagcctcattctacgtttggttgtcctcaaggaggctggcccaagttttttcagcattgtcagcaacattccaagaggacaagacaagacccactgactatcgctcatccaagtctctacatgtgtcacatttttcgatatcctattgggcaaagcaagtcacaaagctaaactcagagtcagtgtgagaaatgattggaaaagggcatgaatactgggatatctgattcatttagttaccactaatataagaatctaccataaatggatataaaaataatatctaccttataagactattctgaaaattaaatttcatactgcatgtgttttgctcagcatcacctctgacataccaaatgctcaataaatattagctagtattggtagaatcatcattatctattattagctgccaggagcaggttccccttttgaaatcttgctgttatgtgtttagctaacatttatttagtgcttaccgtggtaatcttccttatgctaggtattggggataaaagaaaatgataatattcagtccctgccattgaggaactcatagtctactggaggagaccagacacataagcagttagatataagatatcatggcaagttgtgaggccgagatatgcacacggtattttggcagtacaaaggaaggatacctaaccccttagtccagccaaggggtgtggtaaggaaacacttcttggcatagatgctactgagccgaatcctaagggaagagctgtgtcattcagaagaccaggggtttaaaatagaggattttggcatgagtaaagacattcagataagaaagagcattctgtgttatcaaatgaaattaaaaggctaggaatctgaagagataagccaaaaaagaaacaaaggcagggaggcaagagagagagaggaaaagagagagggagagaaaagtaaagaaagaggagaaggaggagcaagaggagggaaggagggaaagaggaagggaaaggagaaagggtgaaacgtggggaataaatgtgtaattttccaaagttagatattattctataggtgaatgaggaggccctgacagcctttgagaagggtaaggatgcagtcagatgtgcagtttagagcaatcactctgggggccaagtggagcatgaatggaggtggggaaaccattaggagtaatgcagaaatccaggcaagagggagagtatctgtgaatggaagtcaaggtaggatcctttctatttccaccctccacagctgaagaaaagcatttccgtgagagatgcaatgaccttggatatcctagtttgggagcctatagtctagaatatctgacaaaaaactattttcttcactctttacagatattcttatctaccaaattgaccgttattgtctagaagagtggtcgaccctgggcaatcttagagtgagtgttattgttaagtatttagtcttgttttggatggccctggtgaggtgtgaggaaactgttctatgaatttgacaggtcaccttagagagaacagtaagtacattcttagacacagatccttcaagcctttttttttctttgtggtctaggcttctaaaattataatgtattttaaatgactttgacctcttccatttgtgctccctcattgcctcagtaattcttatgtgtctctttaatgtttataccttgtttcttttcatatgtattcacaaccttatgtcttgaatttcctggatgatcacactttcaactacattgcttcattgtcccagaaagcacattcataattatcagtgtttacattcagatttgtggtctggaaaatattgtcattatacttatgcaatatgtcccttttccagaatgcttctcattactttctttctgatacttctgtatgggcaccctgcagtgataaaagcagctctctgcagtctcatctgatgatgtcctgctctagtccagctacatgttctagctccaaagaaatttgcttgagaaccaattttgcttgtttgattggtttactaaatgtgcaatgatttgcatcacttttcattagtgtcctgagctatatctgagaggggttagtttagtatgtctaagatctatcagtagattcctgcatattttcaagtaaacttttctttaaacatattgaaaacacttgaaattcagagaaggatcatgaagagggtgtaatgagactgatcaggaggcaaggggtagagcaagctggggaccagtccagtaagccttgtttgaagaccagtataatcatttctgactcccaggggtcttctgcaacaacctggtgccttctgcatggtggcgctgtttccactcagtgtctttcatcctcctgcttctttgggcccctagaccatctaatgctatggcaggcccaaggcacacagaactgccaaggagaataggacaggtgggtattctagatcagcatcatttattagacattattatgacatgcctgatactgttctctgcattttatgtgccttatggcacataatattaatatttgtggcatagaggagtggtaaaaaacaaagcctttggtgtcagactgcctgtgttcaaatcctgtttctgccacttacttggtttgggaacccctaagtggggagtcttaaaggacccttctggttatgagctcttaatcctgggaagggacttgtagaaggagtgcatggggaatagaagaggagacggaaggcatgcaaatgactgcacctagcagcagggtctggcacatgggccaggtggtaagagatgccaagtgacctgctgagtgcgtttggctgtgactgtagactctgtggctgtccaagcacccccacaaggcctgagggccaggaagagaatgcagccacaggtcactaaccaaacaacaggaactctagccgattggccctgcctgaacccaagactcaaagagcttgagtggaggccccctgctgcttcttcctttggagagacacttgtttggaaatggctgaggaatctgcctgtcacttgcaacccaacttacttcttggcttctgagatgttgacagaaattggcgatgataaatgtcactactgccaccacaaccactgtcatttactcagggctcaccatgctccaggcactttgcaaagcactttatgtacattattttatttaattttcatcagaaccccacaaagatagttatattgccatttatgaatgaaatacacagtacattatgagaactgttttgattataaagaatagacacccaacttgaaccagcttaagcaaaagacaactgtatgataggatactggatcatctcaacagaactcacaatgggaatgtggttgagcccccagaatagccataaaccgggactctgatgctgtcatatatcttgctcatactctcacttgtatttacttttcagtagcttctgccttcattcttctctccttccataggtcagtttctccataggctacaaaacatggctgcccagggcttctgaattttacatattatagcttatgccactagattgagactgacttaacattctcctgggtcctaccaaaaatcccgaggattcgacccagccagtcaggtgccccacccttcaacctctcagctatggctgggtcagtgagtagaccaggaggtggaataaaatggcaacctccacaggatcacatgggtggagttgaggaaggggcagttcacaagaggaggagataaagagctatggtgaggggggaggggggagggtgggggggagggggggagagtgagtcagaaggagaggtagggatggctggttggtagctcaacagtagccatctacaacacagggttaaaaagattaaggaactcatccagaatcacatgcaaccaatgatggaaaagcaaggattcaaattgggcatttctgacttcaaagtctatgttccttactaatatgacaaattagaataaagtagggtgaatgaatgagttcacatacacatacatacatatttgcctgagtactaatgaagaccttgccaagtcagtgctcaaatccagagagtcacagttcagaattgtccaacattacacacttttgctctaccctcacaactgtcatttgagaataaaggtagagagtaatgacaaggtaacctgatgacaagcagtatcagtgattgcagcctgtggcccagttcccaaaagcagattataacagcatccctagaacccacccatcattttcagtcagcagttcagcatcgctgctgagctgtgttctggagcaagccaaggccttgggcatggtgcacacatgtccaggaagaagttgatttagagggagtggtctgtttgagtggttcctcactgtgtcctgcatgtcccagaagatggtttgggacccagttttgttgttccagaagacaggtcttcattggaggaaggcacatcaaaggagaaggtagagctcggttctcactgattgagctcctataagtctaagaataggactctgaggattatggcttcccaaggatggagagttgtggcttgggagtttttgagcccttgagccaagaggcattagatacttcaggaaatcctgttgaatctttccacctatttgagcctgtttagcaaactgtttacaaaattctctgacctaaaagaattaatgcccttttctaaaatggcatcttgtcccagggaggggtttatgacgaggcaccacctcgctcaatgggactctttggattcaagaccttgggtaaattcagaagggtactggcatttttattcctgtgatttctgtttttatttgcacgtgaatgaaaataatgaatgaaaccaaaagaacctcatagagttcgccctgatgtttggaaaaaattgagttaaaagcttgggaagtagaatttgttcagtatttcccccttgacaattgcaagccacttgcacaaaaaattatgtttctgggaggaagtcacattaaggagctgcactgatgttttcaattgtagtagtaatagttataatgagaaggaggaggaaaaaatagcaaatacttgcagaaaactaatgagcccggcacagagagattaaataattcatgcaaggtcacacagcttgtcagtaccctgcctcccactgccaccagccaccattctgcctatctggcccccattgtgaacttcggtcgccacttgccatgaatcctttagacacaaccatcagggatcttgggagactagggtgagctgaaacagactcttctactctcttagatcacagtaagtttgcaaggaatatagaggtcataaatattctcttggtaacatagcgtggtgaaaaaaatatgagctgctagagtcaaacaaatcagagacaaaattctggtccgtcaatgagccttgggttttttggtctatattgtaggcaattaataatatccaccttttttagtggcattgaattgatagacctccacaagaagtgcctggccctcagcctggtccctaatggctctaattactctaatatgatcacatctccacccgtggtgttatctgaaatgaccataacagctctctggtgctgagagaatcaacaacttctattcctggcaggtgagtctgctctacctcccccattttcccattccttcactctccagagtaggaaagatggaaggaggataagcagcgaagaagagtcactcagagggcagtgcctagcagcaacaatgggtacacacagcgctgagggggcctgggctctcttggagaggcagggctcagccagggatagcatctgaggcccgagatggcaatggatgtctcagtgtccctgggagagccatgcaggtgccagacaggattggctggatgggcttcccttcagcgtgtgtacccagagacaccggtccccagcttagtaagtgaagaggcagtcataggccaaaggcagtcatggatcaaatttaaatatggaaattatttccaagcacacttttcaaaaactagatttctaaacctagatggcactgaatatgcaaataattaggagaagaagcatcaaagccatgccagtggcctttttagatactgcagcagattgtgccattgcacttagagccattcacatagaactgagtctgtccagggtaactttataatcaggaaggctgaagagaaacagaatgaagcaggctttacatcttacatccttttcatggaagaaagaacactggagggagatctagtggaggctttgtggagggtgtgcagtgacatcagtcaataatttactgagaacatagttgttattcatgccagtacaagggacaaaaaaaaggcaatctaatatagtccctgccctcgaagggcttaaggaccagttcagagatatgaattttgaaatacagctaacattttaatatgatagccaaagggagaggttgacccacaaaattattacaggagatcaaataagaaagctctttctctgggctggggtgatcagggacagtatcatggcagtggagaggtctgagaagggccaaggagaatgcagaacattcctgaaacatggcaaggggacagacctgcaggcaggggaaggtcatgtgcaacaacagaaagcaaaacggcatctctgtcacatgtagtataggaaaagctacatgcaaaagtatactaataccaaagaagaacactttgggaatggggtagattgttttacaagttaggtaggaaaccaaccctccatttaaaaagaatattatgttctactgcaaaagaaaaacagtaaaattttgtgcacagaaaaaaagaccagtcagaagacaaatctcagagtgggaacaatatttcaagcatacctgagagatgaagggttactatcatactacaccaggagctcttctctatgaatggataagaaagacaaacaactcaatagaaaatggataaaagatgtgactagatggtaaaagaggaaaatttaaatggctaagagatgtggaaaggtgcttgcgctcactgtgaggcaaggagatgaaaattagagcaggaagatattgtgtttcattcctcagattggcaagcatttagtagtgataaaaacttagtgctggtgagagtgtgagcaggatgcgctcttgtgctttgctgataggaatttcaattgttgcaaactgttgtattctggcaccattgagaacatttaaaaacatacatatccttttgttccgccttttcatttctgggaattgatgccttagaaataccaagatatgtattatgtcttctggttaattttttggaaatatcataaatatcaatagggctatgcttgagtaaataaaggcacattcattattataggctactatgcagttcttaaaagaagttagatctactgttggaagaaattccacactgaagtgggaaaagtaagtggtagagaaatgtgtgtattatgatttgatttaggaaacacgcatacataccaagtcacacaaatccccttctttgtatatatgtagatgtattttgaacggatacagataatgcagggccatacagtgttagaatgttcacttggttacaaagaaatgagggggagaggtagtgctgtagtttgaatgtgtcccccaaagttcattaagttggaaacttaatcttcaatgcaacgttgttgagaggtgggaccttttagaggcaattaggtcctgaggctctgccctcatgagtgaatgaatgacattatcaaagtagtgggttggttattgagagagtgaatttgttataaaagtgagcttggctctctcctgctctctctctcacacatactctcctgcccttctgccttctgcgtgggatgatgcagcaagaaggcccttgccagatgccagcacctttatattggacttcccagcctctagaagtgtgagggatacatttaaaaaaaaataaattacccagtctgtgtgtttttttttatagtagcagaaaacaaattaaagataggtaaatagagaaaaacaaagattgagcaaaatgaagtattatcatatactcaaacattaaaaatcctcagagttgagttaagatgtatagctttgggggtggggaagtgagggtgtcctcctgtcctcggatttctgctctattcagagtctgaggcctgccccggggctgcaggacagaatgggatgcagaatttaggctgccttgcagagactctgcctcttcctttagcttgctcagggaaatagcatgtagctttaagtttcacattttaaaagtcagatgaaggcttaaaataagcagcaagtgtttcatgttacatccagatgtcatctcaagcaaaaaacaaaaatgctttgatttttgaaaaataacctttgacgcctaaagaggctctaataagtgtttttgctccagaatcttaaaaaatgactttctatgcagacaagagaggcagcccgaggagaccgatgtcctttgctaatctatgcaaggactgcagcagcctcaataccctgccctggtcccctctcccttcttcacaatgacacattcgcccttctgctcacatcaactgttcatggtggggggacaaacgtgggggctttcagagaggaacacagtctctgtggtctttttaatgtgtggccttgtcagggtgctaattggtgccaatttcactggcagtaatggaggaatctgttagcagaaggaagactttgaagtctaaaagcattacagattagttccctagaattttcctacgggaagccttatgagccaagtccactcgaaggtaccacaggtttgtaaggtagacttccttctgaggagaaattcccagctattcaggtgttcagcctgtaccaagagaaccaaaccagaaactctaaaacatcactgtttttctgaaaaaaaaaaaaaaaaaaaaaaaaaacaaaaactaggcaattttttttttctcttgaaaaagatgattttggtcctcaagagatctttttaaatgttagaatggcagataactgaattttttgtagacagatgttgtgaaatgtgcttatggtaatgatgtttgtttagttacctcaaaggaattctgagtgctttacagtcattttcttcattatttcttaaggttttttattttcctgatcatattttaatctcaagcataaattcttcattcagttcttctcgctacattgtctctgaaatatctcctgttagcctcatgttctaccgctgtctgcacttccaggattgtagactcacaccacttcggacatcctggatgcactttcaagatgtttgcttggtgtctccggcttctctttctctatttactatttttcattgctctttcaaacttttccatttatatttttcaccatactttctcccccttgagagaaagattgcttgaaatacaccttgttcttctacataatttttgtttccttttttgttaattttagttgtttactcatttgtaacctgcctttgctccataaagaattggcagtgactatctaaacatgttctttaacatgaaccctgtttgttggaattgggaatctgatattcagatttttttttttcaaaaaagtttcacctttcagtactcaaggaatttaactttccctcttatttttttttcatttccttgaagaaacgaaaaaaaaaaataacgactttaaggcaagctcgtattttgtagaaacaaatcagatactgccaccccttcaaaaagtaacctctaaaagcacctcttcatcgggctttaatttgtaggatgtagagagcccctgtcctaaagaaattatgatcatgaaattatgtggaaggcacctcagaatgccacacacctatttttacagatgcagaaactgaggctcacagtgttttagaaatgtgtttacagtctcagaaatactcagagacatgtttagaattattttaattaagacaatcacttggaacatttaaaaaatcattaaagaaggtggtagataccatgaaatgatgaatgattgggttctgggcagtggtgagctggttgacgtttaacaacaggggccagggctggacagagggagcctgattgatagtgtttgccaacttcacggtgcccatgccagtttcaagctaccagcctgacacccttgaacaaggagttgggaagagatgagcacaatccagtcagctctcaagattggcagagatcatccggctacagtgagcaggcccgtaaggaagagaactgtgctagacaattgctccccatgcctcagaccttacaggtgtgaaaaataagccattttcatttagcctctgcaccactctgttccctcactcttgccctttccttggcagataaataactcttacctcctcagctatcatttacgtttcaagccacagctcaaaatgagggtctctgtgagatttcttctgattcttttagaaaacatcacttctactctgaatgccggagtactttatttatatcttttattacagtaattaccaaagcctaacttgtcaatggatagtggatattagagtaattaccaaagcctattattgtcgatggatagtgtcttttccctctagactgtccttggaggaaaaggaacatgtcttactccttcattgtcagagaagcagtgcagagtggtgggtaggagtccaagctctggagtcagactgctcagcttcaagtcacttaccgtgggagcttgggcaagtcatcaaacccctctgtagccatctgtaaaatgaaacattaaatgtgagcttcaatctcacaggctcactgtgatataatgagattactagatatggtcagtgcctagcacatctataccctcaacaaatgctacctggtattgttacctctagcacatagcccagtgcctggcacagaatcggtgtgcagtggttggtggttgaaatgaatggacttgaagtaaggatattacccagctaacttggtagaagttgggaaagggtgtgatagagggaactgcgtgaacaaactactgttggggaaatgagaatgatatatttaataaaaatcagtagattatagaattataggatcagaacccagttttccagctgtggtatgatgaacacagagcaaggtaggatcattcgtaccttcccttcaccccatatgctagatgatgtatgtctataaatataccattgttattgcaatagcttttgtagactgctgattgaaatatctcatttttgatactgtgcaattgctttttaaaacatcaaaatgctagattttgagtacaaatactgttacatttcattcagtttggttcagttcatcattccaactaattcatatctcctccaaacttgattctgcaatgcagtttatctttcctcctatctagttttctgttgtctgcaattttgtaagcatgacttgtattttgttttctaaaagactacccaggccgcttctaagaacagagtcccctgatatgacactagtgacttttttctatgttggcagtcattcattaaacaatctctttttttttcctttttgggtacagattttaaactcctttcaaatctatcaaagtgtgcaatatccttattgttcacaatagtatctgagaaactctgccaaaatgttatgtctgtagcattttttcccacagatatagtaagtctattagaaaagaaaatgcagctagttcgttgcaaagtgttcctgattaatccatgttagctcttaataccaacaacttccttttccaagttgaactaaggattcatgatgtaaaatagtgaagttaactgtatcaaggtaggctagactcaatgtacagaccttgactatctaggtgagaaatttgggcacaattctgaggacagtgagagattgttgaaatttttgaatcaggattatatgacaaaattgtgttttaagaaagccatctggcagcagtgtccacaatggactctggggggacccttagtgaggtttgaaatttcctgcaataatgtcagaatgggccgctgggctataataggccaggctagtagcaataaagatggaaaagaataaatttggatttaagagaaaaaaaatcaaaagggactgttgagggaagatgataggaaataaataaataaataagtactttagggcttctcaactttttacacattattgaaggtgcagaatataaaccagtttggccactagggtaaataggcctatttggggagggggtgaccaatgtcctggacccccaggactgagtctctcctctcccaattcctacctggccaaactggcagaggacattagtatctccactggctggagagccatttggaaatttctgttttagaaataagtagtcttagcaatatgagaaaaaacggacttgttctaaaatcaggatcaacagttcagagaagcctatacacatgaaggaaagcaaacgtttggttcagtgcatgattctgaacaaagaagcaaaacatcatttatacccttgaaagaaaaccaaccagcatcagccaaacaaggactgtgtaggtaccaaataagatagcctatgccaccaagccactgcctgcattataatgatgcagtaacacaagggcagtggctatgcaggctactggacaaagaaaccaagaaggagggagtctgggttttgcattaatatggaaatccaagccgatttgcttgaaaatttatgaagtcctaccaacttgttgcttcttattgatttctgtagttaataaattaagtggtgctgtagttcctggtgcctcacctgttctactaatttgcattgctgcatggaggaaatcatagattgagaaaatgcaggtgcttgcaatccataattccttacgataattgaagatgctcagttatagaaaataagcaagtgttccctctttctccattaaactcaatgagacagagagaatgagaaccccccaacaaagccatgttgattcccttataaataggaatgagtggctcttctgaaaaataatggaacccatacatttctcaggatggttgccagcaggccgccatgttcatgattcagggacactggcctttcacattggagcccatgtggatggtgctccatggtgttggggcactcagcctgtgtggccataggtggtggctcacagagagacatatctgattcatcccagggcttccacccagcccaggaggtgcacatctgcattgacccatgttcatccccagcctaactgtgctcccttcccaaacagtgttagtattctttaatcccaatttgtaattttattccaatttagatccacctagctctccccactggatctcttctacagccaaaacacatcattttggctcatttgctcccattgttctgttgacatttccaaagctatctgctgctctcaccatcatgctccttgttacagttaaatagaaaaaactggcagccacacataatgcgggaactccagcatcctcacttactacacagtgctgcaagatatttgtttacatatctgactccactcactgtgagcttcatgaaggatagaatgatgcttctttgagccatgggtcttaacagggtgccagcacatagtaggtcctcatttaatgtttggtaagtgagtgataaatgaatgtattgcctttcttacatttggacacagtagtctcatttggggcacatgatttaaaaagtattcctatctctagtatgtacaatgttggcacttgttggcttttgttcaactgcttcctgggattgttcagacaatactgggacaggctgtttgttatgttgtggccagtggtttctgattcttgtgttcatccttgtgcaggtggggaagtggaaagacaagtccctgcagatgaagtactatgtgtggccccgaatgtgtccagagactgaagagcaggaggatgaccatctgagcattgtgaccctggaggaggcaccatttgtcattgtggaaagtgtggaccctctgagtggaacctgcatgaggaacacagtcccctgccaaaaacgcatagtcactgagtatggcatcctctcaatgactttgggtggcatgggagagtcagctttgatgcacctgttagcacttggctggcctgagacctgaggcatgagaattgggcactgtgtctgatttctagttgcttttgagctgtgggattactggcagccctctggtctgatgtctcgttctgtccagctggtgacctgggaaaatgatggccaacttcccacgctaaagtttcttcggtcttgcttggccttaatgattaggacctcaagtttatggagatttaagtttacttctggtgttcaaatatgttttcttgggccagcatgtcccagaatcttgagatttagaaccattttttgaaaaatataaaactaatctatgcttttaaaagtcaggataatggttctccttggtgtgaagtgcctagagtgggaaacaagaggcctctctggtactggtaacttttctgtatctggatccgggtgctgattaataagagttcagtctgaaaagtcattgaactgaagccttcaaatatgcacccttttcttatgtattttgtacttcaaaggagaattaaaattaagaggaaacatatctcaatatgacgagataatgagaatattgcaggtctgttgcctgctttatttcttcactcgagtctagtataaattgtgctgagctgtgaagggggcctgctttgggattggaggttttttaatggcaaagggtaataaatgttggctttttgtacaaagacttttttgtttgtttgtttttgtttctttaattggctaggaataaaacagacgaggagccgggttacatcaaaaaatgctgcaaggggttctgtattgacatccttaagaaaatttctaaatctgtgaagttcacctatgacctttacctggttaccaatggcaagcatgggaagaaaatcaatggaacctggaatggtatgattggagaggtgagtgtccacaagggctgtttccatttccattttcatttattttccttcttctaaatataagtttaaaacatgctcactttatgcatttcagaaaatataaaatggcaaataagatgtattgttcccactatacaaagaaaaccactgataggctgtattttccttgtggtggtcccttgccctcctgaatgttttaattggagcatcgcgcctttcttttaggtggtcatgaagagggcctacatggcagtgggctcactcaccatcaatgaggaacgatcggaggtggtcgacttctctgtgcccttcatagagacaggcatcagtgtcatggtgtcacgcagcaatgggactgtctcaccttctgccttcttaggtaaatgatgggtttgctggtggaaggaaatggacgtatggatggggaagtgaaataaggaaaaaaggagcacatggccaggctgttccagctagaaggtggtttgctaggagctcaactcagccagggacttcacttaggggacttcaaaatcaattactctcaaacatgaaagctgatgaacacccagaaaaataggaaagcataatgccatctaagaaagtagtactgggctggtcctcagagggcttactgtagtcccattcctgccatttagtcagcatgtgaccttgagcaaatttgctgtatctggggacttggtttcctcatccataggagaagtcatttcaaccaggctgatctctgagactgcttcttgccataataatttctaattctggatatcattgaaatatctatttatttttaattatctgcaagaattgcgctcagagctaccaaaaaagattttttgtttccacgcaaattttctgaggctttgccagatagagctgatctgattcttcctcccaccccactgcacccctccccataccattctctccagcatcacttaaatgtcaaaaatctcagacgtgatataagactgggtgagatgaggccaagatttcaattagatgaggtcttttgtgagctcataccccatattttttgcaggggccatggaatgaggggttggaaaataaaacgtcaccttgaaaacagaacactgggctagcagaaaggagactgggtttggcataaacaagctgtaagcccctggacgagtcaccgtctctctaaggcacatcaacattttttaaatggggctattacagtagacagtgactaacatttctttaagctctaaccatagggaattaattcaattaatgcattgcaaagtggagttataggctccatagaatttttctataaattactcaaatttcttagctaatcttcttactcagagtgaagcaaattccagccttgccaattttatgtgaaatgtgattagatagtacacactgtatccagtaattctcatagcttctatacatattttatttgcttttttttttttttttttttttgctgtgcaaggatagttggaacattaagagatataaacaaaaccacattctaattctaaccttgtcagtatagcactaccttaacttctgaactggcagagccagtggtacattaatatatccctggaatagcatagaaatgtcaggcagggtgtgtttacgtctgtattcagaggaggagcagttagttatagggataagagaagccaacatttattgagcacctactatataatgtgccaggcatcattgtacatcctttggttatattaactcataaaatgttattatacccattttatagcttaggaaactgaatcttagacctattaagccattttccagccgtctcttagctgataactggcagctctaggattaaaatccagctatggtagccttcagaacctgtgttctagtacaaataaggccgtttcagagttcagcccctaacccaggaaccagcatggggggacaaagagcaatgtaatacaatgaaaaaacacagactttttggctcagtttgtaagctgaccctgacactttctgagtatgaattggaaagaaccttgacctctcagtcctagtttactcctccataaaatagataaggtaatccctaatgaaagggccattagaaggattatatatatagtatgtggtaaaagtagtttctaaattgtaaagaccaaaacagacgatgtattttgtgtatagaaagtttccctgggcctaatgggaggaaaagaccatagaggtggtgcttttactcagttattccccaatcttagacaaaagggaaatcagggtagaattgcaatcaattagagtcaagtgtgcagaggttttctccacacctctggagagagcctttgaattgtacctcttacgctcgcatctctagctgccattgaaaggttttgcatttcacagttggtgtgttaagcactggggctttatcaagatcttttaaaaattgattaagtgaccaggcttttacaattcctttgggagttcaataacaaagtaggtttcagagtaagaaatatattttctaattttcagccaatttttcccctttttaaacttcatctttattaatgatttggaagatggagaaaacagcatgttaattcacttagttatgagtttacaatgtgctgtgacagctaaaaaggccagaactattttgagacacaattgagggagcattgtatcatgggacagaatagtgattgtccctttttataggcctttacagagatggcttctggaatatagtatctagtttctggacacctccaagccagagagatatttagctcaattggaaaggattcagcacacatgattaaagatattaaagaaagcatatgtggaacattcttgctaccttgcccagtcttgtcccatcaaccctatcacttcataatgggggatagattgtagttggtttgtgaattacagcttagacatgttcccttgtcacttgttaaattcccactgttgcagataataatatttaacgtggaaggatactttaacattgacttatattctcataccctaatgatgtctgataacatacaatacatcaaagtaggttgaaaaagtgaatctaggctaggaagtttaagagaaatgatacaaggggaaaagggggctggttatttattgtacataattattcctgaacaaattcaactctaaaatagtaggtaggtctgttgagaaagactgtatctgcaaggttcagaagcattggagaaggcatttccaggcctccattacatggtgtggccatatagatgagaacataaattgagtcagtccaatacaactcactcacttcatagctagtgcttcttccaattgcaccatttactgaaatacccagatattggtccaataatggcagaagctgcctctacaacctaagaggctcacgggcatgaagctgtccttctcatgtatttgaaggaaggcaatccttgacctttaaggaaatggttcagtacaatctaacctaggccctggcttcctgaaggcagacaacacattgtggtttgttccccaccccctaaaatatgaaatgaatatgtgaattaattcgaattcttttgctctctgttctaaccctgagcactgcttttttcccttcctcagagccattcagcgctgacgtatgggtgatgatgtttgtgatgctgctcatcgtctcagccgtggctgtctttgtctttgagtacttcagccctgtgggttataacaggtgcctcgctgatggcagaggtaaggccggctggaaccgctgcacttccccagtttttttctccttattttcaaatctctggactcctcatttgttatctgcattttccctagcatatccatttctgaaaaggaaccctcaggtgaacatttctaagtcaccagcttggcgtctctttagaaataccccagttaagatgttagtttgaatctataggtctgctttatgcctggccccaagcctagtttcactcccaagtaaaggagaggaaaaactattggtagatatgggtatagcataaacatgtcacaggaaactattttgataaccttaggctgtgggcagtctgttggaacagatgtcgctaacaaggcagattgtacacacatgttaagaacaagaagaaatggattgccccaggatatatgcaggtggttgtggctggttgagttccccagtgccaaaggatcacaactgaggtaccagatctccaaagcatatgcccctggttcaacccccttgcccgagagtataaaagttgggtgttggaaataaaatgaatgggaaagaccaattctcactcatagctattattgggtatggtccaatttcctgggtaggtagacctagagatgtgagggctgcccatgtgtttgaggcatttatgacagtttttaaaagttcacatgatttctaaaggggaccatgggatccttgtaaataactcctctaaaacttcctgagaaccccaggattaagaaatattctgccttctctgagtcttctccattccagaatgtgagctctatcctagaattaaacctccaagaggaaagattcttaaacctggctacacataagaatgatctatggggcatctaaaagacacaggtgcttggacctcattttctgattcactaagtctaggttggggcttagaccactgtatgtttcaaaatagtgtttctctacgttggttgcatgttaaaataaccagccccaccctacaccaatttaataagaatctctgagtatagggtttcaggcagcagtattttataaaatcttcctcatgcttctgttggattcacagtctaagctgtgaaacaacactttactgaagtatttccaagtgcagacctaccttttaatttggtttgtgtattctgaggtgggagttggggtgtctccatggcatggtacaatcaggggccttccacctgtgcttcatccagaagccatgacctatatcccagcctgtgtggcaccagtgagaagtggaacatctgggaatcacatgagtatatacttaggttggcaatgtcaagagctaaagtcagtgtgcattgcctctctcccttgaaaaaataacaggagccgaaaatccagatttgcaaagaaagctcagagcgagggcttacaattactcactttaccaaaggatgtttgtcttcacagaggaattcaacatggggccactttaaatatcaagtctccttagagcattttacaatttataaagctttgatttataaacaacgttttagttacacatctgttgcatgaaataaggtccacacgcacagatgtgtgtgcacagttagatatcaggttcaacatgagttgtccctgatgatttatttggctgagcagatgctatcaggatcacagattacatcataagacctgtgcaaatatgttgtaaaactgtgcaggcagatgttcatttctgcagtggaggggctacatggagattcagacaacaggcaagattttaccatcagcaaatagagattgcagtgaggtcacaatacatacatgggcagaagcccaagcactgtctatgcaaaggttaggtggggggaaatcaaagtcaaaagcagcttcctttctccccttagatgcaggtagccaggccaggattctatgacttcccctttggccttcctgatattcttttttttttttttttgagacagagtcttgctctgttgcccaggctggagtgcagtggcgcgatctcagctcactgcaagctccgcctcccgggttcacaccattctcctgcctcaggctcccgaatagctgggactacaggcgcccgccaccacgcccagctaattttttgtctttttagtagagacggggtttcaccgtgttagccaggatggtctcgatctcctgacctcgtgatccgcccacctcggcctcccaaagtgctgggattacaggcgtgagccaccatgcctggcctctgatattcttttacacgcaagcttctatgacaggaaaccagttgggaagtgttggcatcggagtaggatcagggttgtctttgaaacattgagtgctaagtgctagaagctaaagaaaaatcaggaaaaagtgcattctaagccatctagcatcagtataaacagacttggagagggtttatgaatggcagaaaacaatcttacccagttcttgctgatgtttttggaagttaaaatgcattcttggtagatacaaatataaaatttaggaaaaaatgacagacatgacccaagtgtgaccatagtgacatagttggcctgttttactcagttttgatgtaatcttgagagggtcttgtatatgggggcaggttgatggctcctccagaggggagtcatgactgttagttcaagaaagaccatcctacacacactccgggcttctggtttttctcctaaggaaccctctgcagccctcctgagagtccctggaaaagagagatacacactctcaaatttaaaagccgtctataaaagggcttggttttagcggaagggtttcctgctctgagcagggactcaccctgtgtatttgtaggtttcaacagaaccagccacaatggcttaactttcgtccttgtctttttgtcatgccagagcctggtggaccctctttcaccatcggcaaagctatttggttgctctggggtctggtgtttaacaactccgtacctgtgcagaacccaaaggggaccacctccaagatcatggtgtcagtgtgggccttctttgctgtcatcttcctggccagctacactgccaacttagctgccttcatgatccaagaggaatatgtggaccaggtttctggcctgagcgacaaaaaggtaagagactcatttgaaatctcccgtctttccctcaatcctgttctcagccatactcaaagttctcatgtacctgcttgtcttctaaatttttggaattgaccgttctttcttatgttttcttgtattggaacatgggagtagaagtcagtttccctactgaaataatatgacttcatgttggcctcctgattcgtgaaaagttatcactagtacaccctaggctgaaaataaggggcttggtatgttagcggctttctgagtgcatggtacctcttgttggatgtggttgggtggcctatctgcacagggctgcccatgtggggtgttattagaggaccgccgccgtgtacccacaccgaggagatgggcgcatgatggcctccttttcttcccagtggtgtttggctgtgggctctcccttggttccggtgcacactcgtgtttctggggctgagcaggaagaagcattgtgtcttgaagagaagtaactgctgtttaactggatgatttggatgattgcccctgtgtggtgctgatgaatgggctgcccccttactaattgcaggcctcctgcgggcctatgcaattgagagagaagggaaagtgtctgctgttttccatcactgctggatgaggatgtacaaaacccattctaaatacatctgaccctccagtctgcctgaagcatcacattttccatgggagatctgtctcctgaaactatgtaaccaggactagggatgggagacactttcatggagtgtcccataaagcttatggccaaaataattttggagacttgcgcttacaacaaattttctactctatttccttaagatttagaaaatgtgatatttttccactcccacccccacccccccaggatgaagccatgagctgcagataggtgtgtcttcagaccaaatagtactttgcacatgggttagatttgcccaacctaaaaccctacacacttaagcaaatggtctgagaagaatgaaaaggaggagatattctcttcaggggctcagattctcatttttccttctacatctctacttatcaagaacattcaaaagcatgtggagaagataaatagtatcttgagaaaagatactatatatatttattatatatattttatatatttattatatataatatatattatatataatatatattatatattttatatattatatataatatatattttatatataatatataatatatattatatattttatatattatatataatatatattatatattttatattatatataatatatattttttatataatatatattatatattttatatattatatataatatatattttttatataatatatattatatattttatatatattttatatattatatatattttttatatatttattatatatattttttatatatatatatattttttttgagtgcatggtacctcctgttagatgtggttgggtggcctaaatgcacagggctgccagtgtggggtgttactagagggccgctgctgtgtacccacactgaggagatgggcacatcatggcccatggaaaatatatactccactgtgtttacccctttgtgttatctgtttctctgatttgtcttcctttttgctttattcttcttccttatttaaaaaaaaattctctctcttgtatttttttctctcttatttggaagcttttatttacttctctcatctcatgatttatgatacatttatttatatatcatccatgtattaacccatttttaaacccctctcttattgttccttcatcaacatctttcatcacgaccctaactaaaatctgagttgcacacctccttttccccccatttgcagccgctaccacaatcgccttttggtgactgtttctgtaacctggacagtaatagggtgaagaacaacctcagagctcaatacttggttgtggcttagggtaaggtggaccacgcccacctcctattgtttggatgtctgatccctttaaatctcatgttgaaatttgatccccagtgttgaaggtggggcctaatggccagtgtttgggtcacgggggtggatctctcatgaacagattagtggctcccttgggaggggtgggactgagtgagtttttgcttttttagttcccatgagaattcccccaacagctgattgttaaaaagagtctggcacctcccctctctcttgcttcctctcttgccatatgatctccgcacatgctggctcccctgccccttccaccatgagtggaagcagcctgaggatgtcaccatatgcccaaacttcaacttttccagacatcagaattgtgagccaactgaatctttctttttctttataaattacctagtctcaggtattcctctatagcaacataaaatgcactaacgcaccaccctaaaacatggatgttgcagaaacttgatgggccatgccccatgtgtagacttgtcagaggtatggcagaccatgtcttcacatgaggctgtggcagagaggtagtagactatgtaccacacagagtatagcagggccatgtcaccatgcatgacatggcaggggtgtagtgtatcatgtcctatgcatggttatagcactgtatggtgagatcatgtcaccgtgcatcaatatggcagagatgaggtgggtcacagaccttcttggctgttaagtggaggatctgcatgggtatcaaaatgcttccttcaaatgtctcaaaaattacttggcatactgcacttatctttctcttaccctcatgggccacgcagtaacaactgaatgtttttctgtttgaactaagcataactgagatggaggaagatagttttcttttccatgattttgaaataagtaccatttctaggcttcttaaagcggacaggatatgcacatgtctgtcctccataccgtgttcattatgttctaaaagttggatcccatcagtttgttttatagaatgaagacaggtgtgtgtgtgtgtgtgtgtgtgtgtgtgtgtgtgtcagagagagagagagagagagagagagagagagagagagactttcaagacctttgcaaataatttccactgtgaccccagctctgcagtctcattggccaatgcttgggttcctgcatctgatatcctgggtatccacaactgttcatctttttcaaccatacctctatctatgcatctgcccgggaggcttttttccccactttttcactcatcaaactcctactgaaacttcaaaacctagattagagatccctttatttgtggagctttccctagctcatctgggaaattagtcatttccctagctcatctgggaaattagtgctctattatggcaactattcaaatctttattataacacgtatcttccgcattctattacaataatctataggccaatacctgaccacctattcctctgtctgaccctgaactccacaaagtcaatgaccataagttgttcatcattaagacaaaaaaaaaaaagagtctgtggggagagaggaagagaggttgtatttacttaagagcccctggcaaaaacaacggacccagaatcacaggcaaagaaagcaacaagtcagcaagtgccccttaacagctgtttactttgtaaatggttttctgatacatttcagaactttgcagatgacaaaacagtaaagtgtaagcaccctaccagaatctgtcaacatgatttacataattataaaaaacatttaagtaactaatgactgcatatcagtgtcatggacagttatataaatcagaaagagagtttcctgaaaatatacttaaaatgttaaaattcttatagtcttacttacttacagtctaacacctaaagaaaacaaattattgggacagggtatggtaatgcatgagaggaagtatattctgtgaatttagaaaaagaataaagacattcaaacaataatgttgagaaaagaaatgagatgattttgaagattattttccaatgtgattagattttcatcaaggaagtaacatttaaaatggagaagggttcctaaacttgttttgactattacagatgatgtatcttccatataactcacatcaagtgataaatatcttggagcgatgatggaaagatatttgtagccattcgatttatagctttttaaaaagttatcttcagctttattgcagaaaaaaatgtactcagatttcatttgtgttaaggtagaaaacgagagttaaatttccatgaaaacctatttttgtactcctttatactggaaggcttccattttgcggtagcacattacagtgaattcagaattattccactacatgctgtacctaaatatgggtgcaagttcgaacattcagcaacccgactgtacgttccatcagctcccccagtgggaggagggtgtaagggagctagtgacatctttcttctcttaacaaagagcccacaatgcattctcatatttctcacccatccagatggatttctcattttgcagtctgccaaccatagtatgaaggaaaaagagcttggccagtgagggagggggacatatttgctgggcactaggtacattttgtatgctctgtgtatgctatttggatagtcttcacacaggtatgattattctcattttacaaataggaacaccgagactctggaaaactagtaacttccccaaagttatacattatcaagtgacagagccaaaatttgagtccctgtgtatttggctccaaaatcactctgccagggtgcttctcctgtagctaatctcagggaaagctgtgacatagataaggactggaattgacacccctgcccccactttcctatttaattccctatcctttaatgtaatgccttgattccacttaacagggcacattaacaccaccactactattactactactaataatgattatcattgttattattattaataataatataacttcagcgataacttcccaggtaagatttttttcagctcttacaagccaggcatcatgccaaatatatttcatagattatcttatataatggtgctattaatatctttatttgtagatgaggcaactgaagcttggtgaggttaaataatttgcccttatggtgttcctggctcactatagcccctgaacagtgtgccaccctgtttagaccctgatgctatttgatgctctttccagttattcacttttcttcctacattcctatctaccttatcaatcaaagcctaacaagttagatcctttccccctactaacatgtagctatctaattaattgagccataataattagatagatagtattgtaacatttgcactttatttaataagccttttagagacattattttaaatagagaagaatggtgatttccagtacttgggcaggctaatggccctcaaattgactttagcctgtgtatagagtgacccttagctttaagctactgttggatggtggagaatggtggcaccaggagtgagaagggacagttagggggtcagtggggtctggggtcagattggaggaagcccacagggaggtggaggctgctaaagtcacagaagtttgctgtttgaccattgggctctccagggtatctggctgcaaacgatttcacacgttcctaccaccattgtgacacatgcctgaaatatattttgcagctcttctcctcaaggaagtagaggagtttgattaactttcaaatgtcaaaaatgtgctcatctgcttaatgagggtagctatctttgcctgcaacactggaggtacaatcaggatggccacgtaacacctaaatgaataatgagtcttctgggtttccaagaagtcccatgggggtctggaagtcacttcatattcttttgggatataggaagggcatgacttttaaatcaatatgcaggcaagtaaataaatatgcgttctggaacaaatcagcctggtgataagcaaatttactccacaactaccctgaaatgttgagtggttgttgagcatgtgtgaggaaatggggccatgctttccactgcacaaatttattttcctgccctattaactttaggctggaagccagcaggagacagccaacctccagcccgatctgtcacacccttttcctggcccagatcatctcgctcagaccatggaatactgggctaaaaataacttaattgagaaagtagcagtcatgaccaactagccagggagctagtaatgagggcctgggttggacctctaggtagctgagcaaaatgtaagggtatgattcatgcatgggagtcctcttggcctgtcaggcaactattcttcttggagctactgatcaagagcagatctgaaaaatgtaaaactccccaaatcctgggagtgtctgaggtacagaatgcacatgagaggggggaggacacttgccttttgttctcttaattggcagagccagtctggccctttccatggactgctgtcccaagcgctgagcctccttcattcctgccagggtgacctccatccaaatgggtccagaacagatccctggggcttggctagccccaggtctgtccatcagggttggctacccccacttcttatctggcattatttaagaatgggtctgctatatgccccaacaggtatcccccaagtcctaattcctgaatccatctttactgagacaagagatccttaacttcagttcaacatcctgtggcttagtagtgggtcaccctccaagtcctgaggggcagatgacccggagttgatgactgggttcctagcaaggcttcacagttgccttttactccttccccttttgtggtccccttccccttgaacgaccctctttcccttgaacgaccacctgcttcttgccttcctatgacttctaacactgtattcctcacctctaagctctactaccttgttggggcctgaagtgggttgaattgtatcctcccaaagatatagccacatcctaacccctagaacctacaaacattgaccttgtttagaaaaaaaaaaaaaatctttgcaaatgtaattaagttaaagatctcaaaatgagatcatcctggactatccaggtagacactaaatccaaagacaattgttcttataagaaaaaggcagacacagatttgacacagaaggggagaaaacacacagatgagaagaccatatgaagatggaagcagacacaggagtgatgcagccacaggaagacatggagccaccagaagccgaaagaggcaagatatggattctcccctagaacctttggaagaagcactgcccagctaacaccttgttttggaacttctggccttcagaactatgtgagaataagcttctgttcgtggctattttttatggctgccacagggacctaatacaaggccttcacaacttcttctgtaatctgcactttgagctcattgcatcctttagacttcagtgcttctcctctttgtcccgatttgcattgtcagtctcccagccccatcctttcaaagtgagtatttcttgcagtgggatcagattcagttcccctctcctttgcctggaagaatggatccagtttgcactgaagctttgcagagacatgctttataggcagtcttctcctagctggttaattttagggagacattacaaaacctgagtgtcattgtgtgctcccttttgctgtgtccttgagccagattaatgttagtttctcacaatacgtactacactgcttatgtgcacacttccccactaccttctacgaggccttttagtagtgatgtccttatcgaagggaattgaggacatgtttctgtgagatgtatcattttcacaattcctttgtgcagaaaaacactaatgcactcttctcatattctagactgtgccatgttgtttaaatcagagaactggaagatactttatttgatcatcaggcacagggaactcttttctcatcaaaagcaaacaggtgtcctctctcttcttgtagccttatcctccttgttacacagaaatgtacacacacacacacacacatgcacacacacatccctaccctccaagactacataaaggtaccaagataactggataaatagtaacttagcactcacaaagctgcacaaggaacacaggtttcccatgtgcgtagaagacttactaaatagatatcagaaagtttgtctttcttacctgggtaaagaatttggctttgtctcattctgctgatattagtagactcatctttttgtgaaacacaaaaatgaaatgaaggaaggagaaggaaggagacagatggagagagtatgaggggaaagaggaaggaaggaagggagggagggaggtaatcagaagccaacgctgtcctggatctgctctgtattacccttcttagaaaggtatccctatgcaagatattagaggaccagaggcttcctggaactacgactttttaatgcaactatgcaaactagcatgagtctgaattcacagttttgtcacctgcattgaattgaactaggcccaaaattaaagccaaaaataggcaacaaacaattttaattaacaaaaatcaaagtacacagcatgggatgttgtcctttcagatttggaatgttctggatgtgggagaggctagtgagcacttcttttaactgttggaatcattgaatttgtctatagcttccctatgtggcctctcccagtcagactgactctcccaggtggggaggagcaggtggctctgaggattcccaccaaatttcaaatctatttacagcctagtctctgtttctataagagagctattctatttagctaactgttgaaggcagttgctttgttccaaagtttagttacataaaataggagagttccccaacattcttttctgattaaaaacaaaaaaattatcaatgttttagtacggggagggctaatcttttataagttcactaaattgtgggttgtgggttgagaatttattaagaattaatgtttcacttctgaacaactaagttcgagtcctttgagacaaattaatgcagcatggaaatttatatgtggccaaaagcatcaagcctagaatgagtcaggttttaaagatgtcagaattatattcacaatgaaattgtggccagggctgctctgggcttttgtgtttcagccttgttgcctccagctgtaatggtggcaagagtggaaaaggtgtgcagcctgctatatttttggaacctttcggcctagctgggcatatgctagggctgatgggggcctgagactccctgaggctagggaagcccaaccatttagtttacgattccacatcgagatttcctgtccagcatgggtcacagagagccatttaaagaccaagtggctgacactctgaaaacactatagtctcggatgtttcctctcctattttactccagtgccactcaggtgatggctttgatcgagagcatcaggagcattggcttcaggccaacatgatcctgagaatggccagagtggagagaagaaaacgagcaggcaagccgactccctcagcacggagcagcttggattgtcagccatcactccaggaggaagtcaggaggaggaggctcaagacctcgggtcctcactttaaaaagcacatggctagtcagtaccagaagttgtttctgtttgggagtgcacaggaaggagtagctgccagggaagtggtggggtagaacagttcattgatatcaaaattatctggagaaccctttcaaaccaagtaggactctctccaaccagctggaaataaaagtacaggtgccaaaagctcccacctgtgtggcactactctgccaaggaggtagccaggaaatcaaaagtaagaaaaggattgtgagagaaaactactttggggtggtggagggggtggggtagctgttggaaggctgtggaattcttttttctgtactttttaacctactgaagctgctttgagggtgtcatctagagagcttggtatccaccccctgcagttagaatggagaagggctggcatttgacccatacctgagaagactgaaggtgacaggtcttggtgagaactggtccctggctggtgggccatactccccacaatggccagatagatctgtttctcaagaccagatgaggccatatgggaaggagggagtcagtctgggcctgaggtcgagggaggtgtttttcaaggctccctgcccaaaggcctttcttcccaagataaggcaactgcaacagatagagtcaggaggggtgctgtccagtggaaaagctggagggactgatgtgagtgaccagctgcactgaggttggtccaatgttcttcctgagagcatctctggggagcccagaacttgcctggcaaggaggacatctgccatgcctagggagtggcaatgccagaccactgcggtgccagccaaggaagtgctttcctgcctctgcagctcctcttttccctgacaccactgccttccaccccaccctagagtgggaggagaacaactagaatgaatgcaggatctgtaagagctggcatcacgttgagttttatttcttggctagatgatagccactgggattcctggggccaaacctgcctatttctctctgcccttattattgaactatgtaatgaacatatattatgtgccaagcctactattaaactcttcacatatggttctactgttaccgatggagggtcttgaccagaagttgtccaggtccttggtattttgaacaaagaactgaacaaagcacacaaagtaaccgagtaatgaaacacaggaaccaagcagcaaaagcaggaatttatgaaagcgagaaagcactctgcctggtgggagtgggcccaagcaagtggctcaagggcctggttacaaagttttctgggttttaagcaccccatttgaggttcctattggctaccccttgtctggatgaaggatttggtctgtggctaactaaagactgaggtgaattggtgccctatgcagataaagggatggtccccgcttggcccagggccaatccaaggcactctcccttttccatctgagacttggtggaaggaggaggttggtagggagaatagcctttgatcctttgctactgggaatgggagatggggtttttcctttcggtttagcttcaggaagtttgcgttaattggctttaggttccctgcccccaggcccaggttttttctttttgatccagctttgggaagtcagtgcaaattggccttagattccgtgcctccagaccttgatgtttttccttgattcagccttaagttcccttcctccagaccctattctcctgcctcactacttttaatctttatgtccaccctttgagatcaccattattaacatcgttttacagatgaggagagtcatctaaggattaagcaaattcacctaagtcacacaactagaaagtgagggttccaggatttgatccagagagctgaccccacagcctgcatctgcccctgtgatactgcctaccagagccctgtgtcttctttgtgtggacacaggaaagtagggcatgcttctagaggcattggcctgaggcaacagaatctaataaagcctctgtcctggggaccttctctggcctggcttcttggattctcaaaggagtgataatgggactccagccagagaccactcattatccagctgtgagtgcacaggaaccttgaagagaccttgttcattctaaccaacagtatttccagcgaagtttgttttcttcatttgtgcacatacagccccttgcacatttaagaaccacttatataatgagagttgactggatgaatgaatcaaaaagacatcgaatattattgggtgtcatgttttctctctgctaggcagtaaccagtgtgtttacttaatccagctacaaaggaaaagatcccactctcagcaaccttccctttatgggaaaagtagaaaaggcagagagggaagaaatggagtggagggaaggacaccctacttcacccctccatcctcatctcagaagggaaatagagcaagagcagtgtttagtttctgaagtacttgtgacaagaagaccatgagtagcttaaggctataaaccaccttggtattaatttcctaaatgcttaattctgtgaaactcctctacacatctcccagcttatcactagcaccacagttttctgagtaaagtattagccagctgtgtttcttgcaagaactgattgccaacagaccctgaggcagctgggactccaccttttttggactgggtacaaaagagatgttgagctgggtgttatcctggtactgaagaaagaatactgtgatttctaatgatgtctgtgagtggcctcaaatacaaattgaacaagatggctaacagcattgtgtcatgaaggactctgcagctgaggacctctggggttcaggaacctctgggaagtgagccttttttttttttcttacagaaaaaaaatgcacttgaacacacaaggttattaactcacatgcctttacatgacacacccacccatccctgcaaacacaccagcacatacaccacatagggtacagatgtggttttgacttggagcactgagcaattttctgcttttctttttatccttttaaaagcacaccaaattaattgtggccaactacctataaatccctttctctctgccaatcagggctgcctgaacaggcaagaggcgctctcacctgcctcgttatgcaaattgtattcaagtgctgaagaacaatgcagccttcagcactgcaatgattccaggttgctaatgaggagaggctgctgctagaggaattgttttaaccctctgatgctgaggcaagaaggctgagaaggcatcaagtggagatggaggcagagtcaaagtcaatgccagttctcagcaccagacagggtgctcccagagcaccattacctggtgcaacttggcccctgatatagaaggtcacccccgggtctgacataatttgggataatttggagtccaaacagtgtgggcagaatagcttgatttcttaaatatccctgtggtctgacaaccataagtacatttttcaggttatggtggacatctgcaagcacagggtctggcatggtcacaaatgtatcgatcctcagaatacctgtagtcaagggcaggcaggatccaccaggcaaagggcatgagaacgatcaacacacacacacaggaagaaatcaatggacactaagacctcacatcatgagattagtttgaaaaagacctgtaccattcagccattcattcattcaggacctgctctatgtggagcaagaattatttcattctccagtaatcacagttgtcaggacttatttctctcttgactgcttcaccctgttaccttgccccaacatttcagaatctcctcttggaatttcaatctcacctctcaaacccaggtaatcaaaaaggggcttttaacacaattatgtaattgtcatgctgggactctgtgtgagccagacagtttatgcagtagtaaggggcatttccgctaggcagctgtggtagcattgccttggaatggggcaaaaaggaatttggtattgggaagcacagcagttctccagctccttttgaagaaagtctttataatgcaacttcaactctcagttggaaatgccctgaaatcacacgttatccaatacacccatgctccaagatgagtttccccaggttacagatggcctagacaagcagccactccacttctgcccttccacttggcactactggcacctccatgtgagcggctttttttttttttaatactttaagttctagggtacatgtgcagaatgtgcgggtttgttacatagatatacacatgccatggtggtttgctgcacccatcaacctgtcatctacattaggtatttctcctaatgctatccttcccctagccccccacccccttacaggccccagtgtgtgatgttcccctccctgtgtccgtgtgttctcattgctcaactcccacttatgaatgagaacatgtgatatttggttttctgtgcttgtgttagtttgctgcgaatgatggtttccagcttcttccatgtccctgcaaaggacatgaactgatccttttttatggctgcatagtattccatggtatatatgtgccacatgttcttaatccagtctatcattgatgggcatttgggtcagttccaagtctttgctattgtgaacagtgccacaataaacataggtgtgcatgtgtctttatagtagaaagatttataatcctttgggtatatacccagtaatgggattgctgggtcaaatggtatttctagttctagatccttgaggaattgccacactgtcttccacagtggttgaactaatttacactcccaccaacagtgtaaaagccttcctatttctccacatcctctccagcatctgttgtttcctgactttttaataatcaccattctaactggcatgagatggtatctcattgtggttttgatttgcatttctctaatgaccagtgatgatgagctttttttcataagtttgttggctgcataaatgtcttcttttaataagtgtctgttcatatccttcacccactttttgatggtgttgtttgttttcttgtaaatttaagtgctttgtagattctggatattaggcctttgtcagatggacagattgccaaaattttccccattctgtaggttgccagttcactctgatgatagtttattttgctgtgcagaagctctttagtttaatcagatcccatttgtcaattttggcttttggtgttttagtcatgaagtctttgcccatgcctatgttctgagtggtattgcctaggttttcttctagggtttttatggtttttggtcttacatttaagtcgttaagccatcttgagttaatttttgtataaggtgtaaggaagggatccagtttcagctttctgcatatggctagccacttttcccaacaccatttattaaatagggaatcctttccccattgcttgatttttgtcaggtttgtcaaatatcagatggttgtagatgtgtggtgttatttctgaggcctctgttctgttccattggtctatatatctgttttggtaccagtaccatgctgtttttgttactgtaggcttgtagtatagtttgaagtcaggtagcatgatgcctccagctttgttctttttgcttaggattgttttggctatgtgggctcttttggttccacatgaaatttaaagtagttttttccaattctgtgaagaaagtcaatggtagcttgatcgggatagcactgaatgtataaattactttggacagaatggccgttctgatgatattgattcttcctatccacattatccttacagcatctgaaaaattagtggttcagtaaagaaggaggaatgacttaaaatagttcccaaggcaatctgtaaactgggccttcatgacccatgtaaagtggccttcatgaccactacatttttttagcatgcttttatgtatttaaacttccagtttaaccctttatataaacaacaaaaacaattttggggaagttgaatgcttgtttaatcacacatcagtaagacattgttttcaaattatcttccttttaacacctagatgtcatcacttagaccgaaagaacagggcttttgattttgtggatgtgaaaatagggggtgtcaggcttggatgccccaaaaggaggttaggaaagcaccagagctcagcaagtggagtacaggtatagataaatgaagtatgggggccagctctgaacccaagcaaatgcaattcattttcctttcctccaatacttcattacccatttctggcctttgtcacccccatgtcatgggtgcaactggctagggctacatcacaggtggtaaaagaatttaccaagacagttgtgggtaaagaaaggcagatttattagagaaactaagaaaggtgcattgcaagagtgcaacaggcagtacagcagagagaagcctgtctgccaagatgcagaggatggaggggagttttatagggtcatgctggaaaggctactgcagataggttcatgctgctggggctgtttggaaggaggtatttgggaacaggatgtttgtggttagccatttcttacaacaatagcttgttagccacttcttagaacaatggctctcttctaccctcattcctgttcctgccagcgagggcctctttcttgtttctatcaacttatcaagactccacaccccagacacccacccctgtcctcctacaatggcccaaacacacccgtcaccctccactagaatcattgagcaagtgctcatttccttcactgaatcataagctccttgaggcaagagacatgctttcaataattatgtctttccagctcctgagacagtacctggtacattgtagaagtttattaaatgagtaaatgttccaagaacataagctaataatattaacacaaaagttctgctctcttttggattaaattggctttaatgagccaaccacttatagtattgtttcttgggggcagcatatttctgtttgtgagcagctgatttataaatgaactattgaggacaatgtgttcataggttggagtctgcctattgaaaattgcagtccaaagccaaaaatatattaacctttgtattatgtgttcttttgcaatattagcaaccatggccctcattcatggtaatcacatgaaaccacatcaatagttacagtctcagagagcatacctgtcattagtgactgctgggtggcattctccaggctagatgctttacattctttgactcatttgccatctcccacttttaggtagatgctacctctactgtgcagtagagaaaactaagacaagaagctatgtgatctggctaggttcctaaacccttctcatgcctcagtttcctaatgtgtagaatggggattaaaatgttacctactttatagctgctgtgctgatgaaagagttactctttgtaaagcttagaagagtgcctcaagcatgctaaatcctcaataaatattagtggtcacgtcctacatccacccagggttcgctcctaaacccagctcacaaagcccacgctgtttctagcagatgattaacatgtgccctgaaagccacaaactgctacaaatacacccaagagcccaccactcagccctccttccaccctgcttgccccaggcactcacttgtttcagtgagattttgaggtgggagtaggagggctggtggagggaaggtcaaacgtcagggctaaaaaagatgtggaaggggcagcaggcgagttgcagtgcttagaccccttgaaactagctctggctccgaggatgcctggatgaagagcatcttcatggccctctcagacaagaggtgcctagtacctctttgcagccaaccttgtgggtcttttgaaagcatgctcccagcatcctcctaggcacatagtaagggctcagtgagcatttctgaatctgtgtcttttgcccatctctgtggtagaaaacaatgacttcaagagtgagcttcaactatgattccacctgactactgggctctaccccaaggaaatggtttctcacaggagtgggcaaattataaaactggtctttccccagcaattccattgccgggtatatgcccaaaggattataaatcattctactataaagacacatgcacacatatgtttattgcagcactatttacaatagcaaagacttggaaccaacctaaatgcccatcaatgatagactggataaagaaaatgtggcacttacacaccatggaatactatgcagccataaaaaaaatgagttcatgtcctttgcagggacatggataaagctggaagccatcattctcaacaaactagtgagaaactaacacaggaacagaaaaccaaacaccacgtgttctcattcataagtaggaattaagcaatgagaacacatggacacagggaggggaacatcacacaccagcacctgtcgggagtggggggctaggggagggagagcattaggaaaaatacctaatgcatgcggggcttaaaacctagatggggaattgataggtggagcaaaccaccgtggtacgtgtatacctatgtaacaaacctgcacgttctacacatgtatcccagaacttaaaataaaataaataaataaaaatttaaaaactaggtctttcttaaggccttccctgcttgcatggcatatattgccaaagaattttctgttccttcagacactcagaaaaagtaaacctaatttattctacttcaagctctctcagagacttagagaagagccttagtttcattgcaaattattgatgcagccagataatttataacatttctaagtttttaattaatacccattttgactactgtgtttagcaataaagttgtttttattgccatagttgatagtctatcataatctgtccactattaaaggaaatactctctctgaaggccccttgccatttggaaaattcatagtaatttcaagttagatgtgagtttgggagaggccgagtcccagtggttttagttcctgaagctcctcttctccattcccagcccagagagcttgtcttccaacctctataccacatagggtttttcctggcaaattcattcttaaagcatactagctattaatgtgacttatcctgtgtatctgttagttgcaagtagaatgtaatgatgttctctaaatgagggatacaagtcagtttcattgcttttcagtctcaccgcctacttttcatttattcattcatcagatagattctaaatactacatagcacttactggaatagagtataggaaaatcagaacagctctgcataaacataatctctgatctttttgttggtactaaggttagtgtccaaccacctagtctatctcaggagtccttagcatctgccagactgcctatagctaaggcctagaggccctcagaatagaaaagatcagtagctctgttttgttatctcaaagtctctagaaactgccaccctcaatcaccttgtaagccccttgttcaacttggattctacctgttaccaaaatcctgctcctgtcctcatttctttgaattaactaaagcctctgttgtatcatctacctggcttttaaaagttactatatcctctgcatttaaaataatacctagtatataacaacaattagcttaatcgttattgaatagttactagttaatctttgaatagagctaacagatttagcaaataagaatacaggacaccgagttaaatgtgaatttcaggtaaattgtgaatatgattttagtataagtatgtcccaaaatgtcatggaaaccctaccttgtgagacgttggagatatgctgaaacagccctactctcagagtctagtgagggaggcagacacttcgttcttaaaaaataggatggtaaatacaacagaggaatttcctcttttgctcctttcaaggctaaatatagtcttaatcttttacaagaagacttgctcccctcacttttaatcatttctgaaccttctgctgtgagttatggaagagaacacacggtggtcagaagccctcctactggtgtataacgcagcctgaccacatccattccacatattgctctttagcgtccagtgacaggctctttattttaaaaaagcagcactgcattatgtatgcatgcagtatgtggtcaggtagaactgcatgatttttcttgagcatgcatttgacaaagcctgttcctgtcccttctagttctagtgcagtgtggttttacatcctgtaagaattattttgtatgcttcctaatttaacttcatccttttaatatcttcttttgtcaggccagacttactgttttgatgtttaattctatttctcaagtagccatccatccaatccaatttgatgcctacagcaggtttaaagagcaggttttttcatcctgtcacttaagttattaaagaaaacaagacccttccctgtgtgtttaataagttgccccacactcccaacaactggtcatgtctatcctttcactaagtatctcacctgcctagtgatggagcctcttatttgaaagagaaacgttttattttacagcattctttgctgtaggttagaaacattttccatttgttaattagctcctgccttggaatttcaagaattttgaagtaggctaccttctctgtaatccattgacaaagagaacatgagatgcacatttcagaccatgaaaaggattcagtggcctggtctcatgatagaattatcatggagttcaataagaccatttgtgagtaacttcccactaggtaggtgaggaagtatcccaattagtgagtctgtttccctctaatttgcatgtttaaactatattaaggctggtgcaaaagtaatcgcggtttttgccattcggttttgtcattaaaaaataattacttttaatggcaaaaaccacaattacttttgcaccaaccaaacaggtgtgaaattgactcatcgagaatatttccccaaatatctgttacaaatcaaaggcaagctattataccagtaatcctatttcttcagcccatttgcttactctagaaaaagtgtctgctccaagcctgggatgaaacaggacttctgattttaagtggaaaaaataaatgttaatatgtttttccgacataaactcgaagttgttcttctgaaaattcagctgggtgtggtggctcatgcctataatcccagcactttgggaggttgaggtgagaagatcacttgagcccaggagtttgagaccaggctgggcaacaagacaaatatctgtctttacaaaaaaattaaaaattagctgggcatggtggaaagcacctgtagtcccagctacttgggaggctgaggtgggaagatcgcttgagcccaggttaaggcttcagtgagctgtgattgtgccactgcactccagcctgggcaacagagcaagaccctatctcaaaaacaaaaacaatacaaaaaaaaaaaaaagaaataaaaagaaaagaaaagaaaatgtacatcaggctagtggggctagactcagagaggaagatgcttacgagtggtatattgttaaagacaagggtttccagggaatgaccagtctaagttcaggccaccagatgagtatctgatctaaaatttggaagaggatctaaagaaagtttactcttctctgtccttccatctttttatatgttaatagaatttatatgttgtatggtgtgatatattaatatttaacatatttataatatttaattgtctcttcatactagactgtaaactcaatgaaggcaagaatttgtctgttttgttcactaatggatctgcagtaattaaaatagggtctcgtacatataggtgctcacatattaatagatgaattaattaaccaactagtcaatgaatgaatgaataagaagacagttatgtaattcatatagtgtccacagcataaggcagtacttttcactctttattagccatgtgaatttgagaacagtgaaagatagtttcatgaccaatggttgagggggaaggaagagagggtaatgtagataagaaatatttgacatttagaatcccagatagaattttctcaccttgtggtttctatgcctgtcacaccatctaaatcgggcaggtatttcagaagagaactgagtaagtgaggtctccaactgtgctgctatgtggcttgtcggatcttaaattataaagttctttcaggacctatttggcaatgacttcttcaaagcccctgattattcctcggctcctgtgtgagacaggcacaggagtcccctccttgtatgcatgtgttaagcctgccctgttctttgaatggtgaggcatcggcttcccagtcagccaagtgtttgctgagaactttctattttcataggaaaatatcgcttctgtaacaaaaagtaaccaaccctaaaataactatgtccccttgccacttttagaggggaaaagatataatgataacaaagaaagcttatataaagaaattattaaaagtaatgacagtttctaggatattcctggaataagtacatagtaaacataatgtcctaaaccatgtatggtcttttgtgtcttaatttctgtatatcatttacctccctgtatcatgacacatagcagatgctcactgaatatgtttgaatgactatagtttagaatgattttcatcaaaagggttgaaagtaagttttttggcttaacccttagtcaactggaaaaattgaacttcatttttctaccaacgtggttattgatatttcacttttgtagcagtcaccttataataattatgtttgcattataattggaggtccattaaggacaactgaagtacactggcatcccattagtcctaaaagcctgagacatggaaatgtctgccgtatcttgctgtcgactgttcagggcagctcctggtgcagagtaggtactcaatacatgtgtggagactaaattaaaaacaaaagagatggagacagaagcagacaatggctgtttggtcttcgataggtaatgaatttcccaggcctctgtttcctcctctgtacaggcagaaagttgctcaactggcatttctcaaactgtttcatagcctatgagtgttctgggaaacataatggctattcttgagaaaaagaaatccatgggaaaataagtttggggaaatgctgtgtcagggttacataagtttctttaccaaaggattgttcgagtcctctcctgtgatggtccgttgtgaaccccgaggggcatgcagtgtgcgtggtgggatcgccaggctgcatcccaatactaacattccataaaccggagtgtccctcgcatagggctgactttattgaccaaaggaagaagctctgctgggctgtaagtgggtcacaatgtgacagtaagtacacatgctggcatttccgtgcctcaatttggaactgacagatctgattgattgccaggagggcagagacacacctgtccccctgccttgcctgtcactggatcctcactcaccctggcctccgcctggcggaggtctttgacatttccgccccaccccagcttcatgactctgaagatgctgataccgtattagaacctcaggtgattgtgctaataactggagaaccctaaattcattgggaatcttgcatgtggaaatcttggtagtcttctttatcttctttatctcctccaaaattttatgagctgctgaagctcctggtacaacttcagaatcccagtttccatggtgaatccatctgtcttctttacttgaaagcttctttaaaggccatttctctttgctagcacccacagcttttataaaatatctggaacaatcccttgtaccctcccaagttggtctgtgaggtagagtgcagtggacagtaataacacctctttgtaacaatcttgtgtaagaataggttgaaggagctcaacgaaggccacctgtcacacacaggatgacttaaggataaaactcaaatgcctctgtccttatgcctctgtttcacttcatctccatgttatcataatcatctctaactctgtcacatttttggtgccaaagaaatattcatatgcattgtcaagtcctaagtctgacaggctcttgcgggatttcagatctgatatattttgtgaaggaaaaatggagaaagtgccaggaaagatgtccttgactggcattaggacacattaactccttattcaccagagatgctaggcttgccctagatctgaggaatgttaatgctcaactgtgtgttgcatgataatgtatcaacagctaaatagtgcactttgaatggagtttttcatataataaatatatccacatgtgcgattcaattcattcattctttaaatcactcattcattcatattgagagcttactaagtgttggatgcttttctaggcactagagatacagcagtgatcaaaacagaccaaaactgtgtccattatattacattctaaggaggaaagggcagaaaataaaaaggcaattaagtctggcccaaagttagtgagggatcaatatatgtggatatccagggcttttggggcagagaagagcatgtgagggtaggagcttgcctggtgagttttagaaactgcgaggaagccagtgtggctcctgaggagtgggtgagggaggagagtgggagagaaggtggtggggatgaggctgactctgccgcttcctctccttcgttcttctgaatgtataggcagacttggattcagtcaaggcttccactctgatgtctttctttttcatttatccctcccattattttccctctgaaaatagtccaggctcttagtagttttccagtaaacgtcccttctctaacctctctgttcttcgagccatgctgctttagctgaacaatagctacacctgagcactgtggggttcacagtgtccttcctcagtctgaccattcggtgtgctccatgggatggtttctatctaggcgccaaacattcctcccaacgtcagtgcagatgccatgctcacgtcccagtgcttcttttctcatgctatttcgcttgccccatcaccctccccagacctctttgcctggataaacttggccaatctggaggagttggctccatctctgcctgctctgtgcagcctccccaaccatatccttttgtaatgattttcactccctctaaacttccgtagcccttcctttccttacctcccattggataggcatactaattcaggcactggattccttaatctgtacattttctgagcatccattctatttgcatagagccctgtggtgtgttttacagttaaatatgagtatcctgcatttgaatccttgctctgatagtttctagctgtatggccttattcaaattacttactgtctgtgcattagtttccctgtccattaaatggagataataatgcctacctcatagcatcaatgagaggatcaatgagttactatacgtaaattatgtgacacatggtgagtgctgtagaagcattagctgctgctggaattatataattatcatcatcattatttccagctaaactgtaatggtagggattgtatctgttgcctcattttatttcagagctcagtggcttatatgtggtttatgccctttaaatgtgtgctactgatgtgatattttatggccagacacaagactttgccaaacacttaaaacctcaaggtgcaggttatgatatgttaaagttaatatagttaatataggaataaacccactttcttggctctgctaactcagggaccaagcctcagctagctaacatgccattatctgattttatgaaatatttcaggaaatattaaggcttatgtatccaaattttataaaatacaaaagaagtgactgccttattgcattaaaaccatcgttgcgaggaaaactggtaattaactaaattccaggaatctgaagaactggtgttttatttgctgcaagcttttgtttcggctccagcaggagggtgatgacaggagaataagttccagtcctcaccacccccacccttctaagacctattatagaaccccagctccacgttgagttcagagaggcacaaaattccttccccagcagcacagcatccagagctgtgaagatacagcctcgaatgacagcacagccagaggcaggagaaaggccacttaccagccttctcacatccaagtgcaggtctcttcatatgtaaacttaagggtgtttgccactgtaggcaattatagcactaatgttaataataagaggaaaacaagcagaaacaattaaggtgttgaatgcttattatatgccaactccctttttggcagtagcaaaatgtcatcagattcatcaggggcccaggaagagaacagagttaatttgggcaattttcctatataccggtagcttctaactacattctgcaatattattgtttccataattcagccatgccttttgaatgaatttgaacaatattctctccaatgaacactttataatgaaatataacaataattatttattcctcttacctccattccagattctttcatgaaggtgaagggtttaactttctaatctgtcaccatatccacagccagtttgttttaggggtagggtcttggggggccactccaggccccatgttttgagatggaggatttgtagtgagatgctataccttatttctccttttggaacattgttaaaattcagtttcaaagctaagtggcttgtttattgagtcacacagttaataagtagtagagctcagatttgaacttagatctttgagcccataacccatgtgtttacttacgttttatcaataaattgtcttttttttttttttttttgagacaaagtctcactctgtcacccagggtggagtgcagtgacacgattttggctcactgcaacctctgcctcttgagttcaagcaatcctcctgcctcagcctcccgagtagctgggactacaggcatgcgccaccacacctggctaatttttgtatttttagtaaagataggattttgccatgttgtccaggctggtctcaaactcctgacttcaggtgatccacctacctcagcttcccaaagtgttgggattataggtgtgagccaccatgcctggctaaaattgtcttttcactgtaagcacagattacctccttttcacatctgtcccaagcacttatgggccatggaacagtgaaggagctcatgctctcagaaagtctactccttgtgtggtcacctgaccttcttcttctcccactgggcccgacaagggattatggtagaagaggagagagggtgcttcctgcagccacttcctcccctctccagatgctgcccagagtctggaatcacacatacatatcccttcaccctaattgggccatagggtattattatggaagatttagtgatgggcaacatggtttggtgcaacacccctgggctaaggaagataatatcagtttctgtacttgcttgatagttcctggaaaaactgagaagatcaaaagatagaagagctgtaaaaaactttgggagcatggggcatatgactcatccctcccacccctgaatatttaccttagaaaaatgaaaacatgttcactcaaaaacctgtacatgaatgtttacagctgctctattcataattatctgaaagtaactcaaatgtccttcaatagataaatggatcaactggtgcattcacataatggaatactactcagcaataagaaggaatgacctacagatacatgcaaaggcctggagatgaatctcaaaggcattatcataagtaaaaaagccagtctcaaaaggttatgtactacaggattccatttatatgacgttttagaaaaggcaaaactatgggatagagtggctggaggttaagagcaaagggagtgtgtgacttgaaaggagtggcaccagggagctttttgagaaatggaattgttttgtgtcttgattgtggcggtgactgcaagattccatacctggttaaaattcatgacaataaaagtcaataatttaaaagtactattaaaatataaaatagggtaatgacaataataacaggagggtgctgagtaggtaaaaatgtggtgtcttcagaattctgatgtgctgccacctcctcataattagcccaggcccaaagccattcacatctcctaagcctttcccactttttctcttgggtgcctggaagggctgagtggcatttgggcattgattctttttgtgatgcaaatgtaaaatcagaagtaatggaatgaatatttatgtgtaggattgtcaagctttgaagacaaaagcccccagattctatatctcatatggatggatccctgcaaataggatgtgcaatatccgcctctgcaaggtcacagcactggtttgtcctaatctgcatatgctgattggacacagactgaatgagtagagccatttttcagggaagccaactacccaagaaggcagttcctcaccatcctcttcattttaacagagctgctttcatttatgtgctgttattcaccggatctgactctgattattgtccttgggactgggtgacagctgatcaggagatggccttgactggtggtcagaacgaccactgctttgacaccatcagtatttaggacattcttggttttgttttcagaatctgctcctctcctggtgccaggaccttaaagacttctcaacaagtatgtttcttcattctcaccctggaagctaaccaggttggaggagtcttaaagcagagagttcctctggtgtaaattgatgttaacgccccatcgccacccttccaaagccaatccatcctccctgccagcttcaattcagcctccttctagaagcctttcaggaaatttatatgtcaatggcgtgcacctctgtggtcttgtatgttagctagtagtgtagggaaatatctgacaatgcgtctgttccttcttatccgactgtagcacccataccctcaccagagctcagggcctcttcagctcttgtctctccatcttactcctttcaacctgttctgcacaccagcacctggtgactttttctaacacaaaaacccaatcttgtcattctggcagagttcttcagttgcttccaatggcgatgatgaagatgatgatgacaatgatgatgatagtaataatgatagtaacaatagctaacatagtgtatttatcagccaggcactgtgccaatactttgcccagattgactggttgaatacttaaactttatgaggtaggtgctattagcagcccattgtacaaatgtagaaactggggcacagataagttaagtgagttgatcaaggtcacacagctatcaagtggcatagctgggatctgaatcaggcagcttaactccagaagctctgctgtttctcatcccttatattatgaactctaaactcctttgcacagaattcaactttctttgtgatccaggccctgcttccttcttcagctgtgtcaacctcctgtcaccatggccatacctgctaggctctggcaacaataagctgctcgtggtctctgatcatgcccaatctttctcaccaccttgtgtctttgaacagacactcgtctctatctagaaaccattttgctcctcttgtttaaatggttaagtcttagccccagtgcacaggctctgggacaccatcgagacagcccccttgttctgttctctcactgctgcatgggcacagctgctcatagcacccgccacattatttatagcccctggtcacaccaagcttgttcccccatgtcagaacctttgcatttgctgtttcctgagcctgatacattttcccccttgtctttgtatgtctggttcttcaacaggtctcggttcagatgccaccttctcagagaggccttttcaggacagccagtctaaacttgttctcctaccaatcactctttatcctattatgctgtttcaatttcttcctagcacttctttttcactatttgaaattatctgtgtttccgtcacctattgctacacagcaaactagcccaacacttagtggcttaaagcaagaatattttattatattttactggtttgtgggtcagatatttgggtagggcttgcctgagtgattcttctacttcatgtagcatgactgatattcagtgggaggctgggctggagagtccataatggctttactctaatgcctggctctgactggaatgggtagaagtccagggctcagttaggactggagatgggagcacctataggtggaatctccggcatggtggcctcagggtttttggacttctgacatggtgcaccgattctctcagagcgaggtttccaaaggccaaggtggaagctgcaaatcttcttatgcccttgtctcagcaatcccacagtgttacttctgtcaacttctactggttaagcaggtcacctaggtcagctaagaatcaaggtagggaggggacatggacctgtttgtcatagagtggcaaataatttctggcagactttagtcaaccgaatgggaggctgaggtaggaggattgcttgaggctgggagtttaataccaacttttacaacatggagataccttatctctacaaaagattgtttagaaattttaaaaataaaaaacaggcttactgtttgcctctcttctttataatgtgaactctttgaaggcaagatcatactcttctgcaatactgcatcttcagcacaggcatctcctctgtacacaataaacaccaacaaatacttgctgaatgcttatataaatgaatgaaatcaataaatacatgaaatgaaaaagtaaatggatgaaaaactgaatgaatgtttatgtttctgactctctgtaatgcaaactccttgaaaactgggtctgatttttttcatctttgtatctctgttcctaatacagtctcctgccctaatagatgctgggcaaatatttgccaaatgaatggatgtattttaattatcatagttaaaggagataatgtaacttatacccagtacatacataggtattgaataagagtggcaattattaatgacttacaatgcctaatacataggaaaatcaatttatatattaaaaatggaccagatccgtacttcccttacttgctcccctcttcctttctttctccagcaggctgtataagaagctctctagcggggaggtggcagccaaaacagcccaggaccctagtgtctgctcatctctgggtgggggccttgactcctggcccttgagcacctttctccttgcatggctgctgagactaattcactttgaggtcattaagatggaggctgagatgatctgaacagctcagagggctgaattctgattccctgctgctctccaggaggatcaaatgagattacagctcttttaacattctggcattgttttgcccttgtgcaagtgtgtgctcacaagcaattgctggaagccctgtgttaaatgcggtgggaaggatgggaattggcatttgatttgccacaaaaggaagatactctatgtggccccacttacagtgtgtggcttcactccctagtaggcagcagtaggactgttcagctagcatttcagctggcaaaaggaaggccatactcaggggtcaagtctcagcttgtcctccctctacactgtgtctactggaacgacttgatctcttcaggacttcggtttcctcatctatgaaatggggcctgtcctgtctgtgttattttcctatccaaatctatgtgttgataattccaatctgggtgactcctagaaaaagattccacattcaaggaagctctatgaccaaaggtgattaataaagagtactgagcccagcatggtggctctcgcctgtaaccctagcaccttgggaggccgagcagagcggatcgcttgaggccaggagttagaaaccagcctggccaacatggcgaaaccctgtctctactaaaagtacaaaaattagccaggtgtggttgctcacatgtgtagtctcagttacctgggaggctgaagtgggaggatcacctgagcctgggaggttgaagttgaggtttcagtgagccaagatcgcaacactgcactccagcctgggtgacagagtgagactctgtttcaaaaaaaaaaagaaaaaagaaaaaagaaaataaagagtactatacacatttccctactttgaaatcagactgagttttttaattcaattactgagctccctgatatattaggcttttaaatttgtttaaaaattattttttcagggtcctcactgttctattaatgttaagacattctggttcttgacagcgctaaatttttctcgttcccaaattgccactcaggctaagcaagtgccatataatgtcttacagcttggggtaagttttattacaagggcattttctggaagcatcaggatatttggaaattatttttccttcttccccacgggcctccctaaacagttctccatgaatgtgaattttagtacagttcaagttccaatgacagtataaaaaatctctgttttatgtaaacttcacagatctcaccaggctgggacaagaattttcaaaagaaaaggcaaactcactgctttggctaattctgaggcaatgttctctccctgttggcctccagactggcctagtttaaggaacaaattagagaataagaattttcaaacttagggaacattgccttacataggacaattttaaatgttagaacttcatctccatagaagcaactaagaattttaagactccatcatgtgccaggtattaagtattttttttacatattatcttattcattaaaataatacttccagaaaagagggtaggtccataaatttaaggaacttgcccatgttcatgcagctggcctgagacaaagctgaaatccaaatccaaattctctgcctccaaaccagcacttcccttcttcccagtactgactgcttggtttttctgattattttgattattattattattattattattgttgttatcattttggagacagggtcttgctctgtcacccaggctgaagtgcagtggcacaatcttgacttactgcaacctccacctcctgggctcaagcaatcctcacacctcagcctcccaggtagctgggactagaagcgcatgccaccacgcacggctaatttttatatttttggtagagatgggatttcaccatgtttcccaggctggcctcaaactcctgagctcaagcaatccacccactttggctttccaaagtgctgggattacaggcgtgagccactgcacccggcccgattattttcatttgaaggatgccttaactatataagtcttgctatgttattatctaattcctttagtgttttaatagctttaatttattttcaaatacttcttcccagtcggtggcttatcttttttatgattttaactgcatctttcaaaaagttcttatttttatgaactccaatttatcgtttaccttttttggtggattgtgcttttggtgttgtagctaagaaatctctgtctaactcaagattacaaatattttctcctatattttctataagttttataattctagtatttacattttagatatatgatccactttaagttctgtgtatcttatgaggtgtgaaatgaagttcctttttagcaaacagatgtctaattattccaacaccatttgttaaaggccatcctatctccactgaatggcccttgcaccatatatgtggggctctgttagtgggcactctatcctgttccaatgatctgactgtacgctaatgccacactctcgtgattactgtagctttataatgaatcttaaagtcaggtagtgtaaatcctttaacttttttttcctttttcaaagttatcttggctattctagaccctttatcatttctttagcttttatttattcagggatacaattacaaaacaggatttagaaatctaaaaataatttaaaattaaaaattactatataaagagctgtatgaaaactacctataatgtagcttcatcaggaagtgaggccctctgggcactggattccatttagttaccataaaatttagttgcagataccttgcatggattgccatttttttcagaaaaattaaagtgtaataatttataccagaattgtattggacatgattgcaattttcactgatgtttcagaaaataccttgggccctagagtatcttagtcattataaacatcagttgtcattgtcctagtattgtggggaattactgattaaaaggagttaattagttgtattgctatctaccatagttatttactctacttttgatttgaggaatatctttcttcaaacatctgaagtgttgtatttgatagtggtatgcaaagcattctggtgtctgtctcttccaataaagcatatccctatttactttaagcttgctatctgctggagacagtgaggagtgactattaattaggcgaattgagctctgatctgttagctatcaatgccactgtgtgatgtggagcaaattacttaccctctttgggtttcatcatttgtcaaatgaaaggtttgggctagttaaccctgagtggcccatttggctgtagatttttcttactcttttgtagtgtctttatccacttaaaaattataacccctttcaaaataatcaaacgaaaacttctaatgtcaaaaagccctgtgatgagtcagagagggagctttctcagtcaggaagtagtagttgtttggtgcatcacagattgcctaacaccacggcatgactctagttttaaccatggccagcactgagcaattaagatggcatttatggctcctggtgctgagatattttgtggcccatggaactcccatattctaagaaggaaaagaattacttctaatcccaggcaatcccaaggcttcagagttctcctgagttggcaggttagattttcaaatgtttctccaaagtaaatggtactattacttgaaaccaagaggacttcaaatatcttcattgtcgttccgatgccaaagcacagcacagctacaatgatcattgctgtactaatagaataagaagcttagagagcgggtttactaggaaatgcagaatagagacacaaattaaaaataatataagagaacatttattgggcacctactgtgtgccaggtgctgtgccaagcactttatttttgagacggagtctctctgtgtagcccaggctggagtgcaatggcatgatctcagctcactgcctgctctgcctcctgggttcatgccattctcctgcctcagcctccggagtagctgggactacaggtgcctgccaccacgctcggctagttttttgtatttttagtagagacggggtttcaccgtgttagccaggatggtctcgatctcctgacctcgtgatccgcccgcctcggcctcccaaagtgctgggattacaggcgtgagccaccgtgcccgaccgccaagcacttcttatgcattatattagttaatcctcacaacattcttgaaaattaggcattatcatctccttcttacaaatgaggacaggatgcacagagcgtttatgctacttgcccaaggttacacagtggtaagtggcggagctggtcttcaatccgtatctgtttcaatctagagtttaaactcttaatgatgacatcagagacgagctagcacatttagagagtaattgcatgtgtaggattacagtgatctaaacaaagaataacaggttctgatgggtcactttggggtagacttgatggaagaaagaattcacagaagatttcttgaagaaattgttttgagttttattttgaaacggatataaattggcctagagagacagatgagttggcactgaggagatggactatatgaggctgtgaagatacaaatgaacaaattttgtgttcaggaagcaacataaagacttacgcattgcagggtgatagccagaaataaagctgatgtcatagggatgaaaatccaagaggtttctctttattataatgggcactggagatgtactctcagtctcaagcaagaaagggaacataattaaaattgtctttgattgtacagtttatcctacaactcatgtgggataaatatgagctttcagtgcatcagggaaggtcaaaagaaaatttcttagcaaaacatatttgatactcaacaaattatcttcaggagtaccacatagctcacctcactaaggccctatggacaaaatagtgcaatgactgtgtatttaggcctttaagaggcctgaatacagattttacatatttttttagaaagaaaggtgactagcccactgcaattaagccaccagcacattcctttggcccatcaacactggtattgtgtagtgtacataaaaggaacatagaagggttatagattaaagtcagggttgggcaaatagaaatctctcagcaatatgtactaaattgaattgaattgaagtctgctttcagatagcaattgctgctcttgagtgagggctaatgtattcggtgaattatagttgggtcccttccattataaatccactaatgctaacttacttaatgtctcttcacattttctaaaatgacttttctctctctctctccctccatctcccgctctgtctctatctgtctttctctctccagttccagagacctaatgacttctcaccccctttccgctttgggaccgtgcccaacggcagcacagagagaaatattcgcaataactatgcagaaatgcatgcctacatgggaaagttcaaccagaggggtgtagatgatgcattgctctccctgaaaacagggtaagaactgcttccaagctcagagtccttgatctgtttctcacatttattaagcatactattgaatcacatgcactaggtataccatgcttggtatcataaaatgttaaagaagacttcatttgctctttatggatttccaagttaaatttgatcgtatcatttagaccagtgtacaacgattcctatgctattacttctatgtattttttttacaaattattttctagttgcactaatgtaaccatgaaataagagtgaaataaatgtagaagtaggagggcagagtgaaggataaggtatttgtgccgtgtatgtaataaagacctgttgtccaagaggtgaaaattatggttctggtgtcttatggacaagggagaaataaaagggggaaagtgtaaatgtttttagataattaacagtaagaatgcgttgactgatctccagtgccagcttgtgttaacatactctgtcctctagggagtgtttgtccattcataggagttcatgacctacacatgtgttggcttgcacagtcccagccacactggtccctttgttcatttggcctccacaagccacagctatggaagataatggataacagagcattatagatgttgggatttggaggtcaaggggtctcgtagctgattttctttgttgtatgatgactaacagcacttggaccttgtctcaatacccttgtagctccaggtctggaaaaggcacctagataaatggttacttaaaatactgttagattctattttatcaccataaatacagtcacagaagatttcagaagatggaatttgagcttgaaggtagggccactttgggtagtctgaccactgctacacccactgttctcattcatatcagggctttggttttttggtgttcccctttctatcgggtacctaacaaggtgacttaactaataaaaatgaagggaataatggtgttgcttttctttcttgcagacctctctattgcctgtaaggctatatctaaatttcttcctctacctttgatatgtttaaatgttggttttaaatattgattcatgccttcctgcccctacgcctggtcttattcccttttttatgtatttgtgccttgcaaagcacaaatacataaaatgaagttcttatatgtttaggaactatatgctgtaatttatgtatttgagagatctgaattcttctgtattttgccttctcttgtagtttcactcatctgctcttacacaagcctgtactgccaccacctcaacccctcacctctatccttgtgttgcacaacagaatactggaaccttcctgaccacaaaaatagcattgcacatctattgaaacacaaacacctacacttatccccactccagactgtaataaactgagaaatgaaaaatgttatataaatctaaccccatgctatttgttgctcgttgcagtggttacttttcattatttctgttattatttttattgatccctttttactccttcttcctttcagacacagtttatgagttggcttcaggcccaacttacattctcatcattcccagtgggaagaaaagaactcctcctttcaacccaaaagcacataaagaacagcctgggatttaggctttagattctggcagagttccaacttaaaccttactttgaaccaattctccacatagttttctggaaccctactgcttcatattaatggccccacaggtagttttgttctaaaattcctccattggatttgtttgcttttttcctgtacaggaaactggatgccttcatctatgatgcagcagtgctgaactatatggcaggcagagatgaaggctgcaagctggtgaccattggcagtgggaaggtctttgcttccactggctatggcattgccatccaaaaagattctgggtggaagcgccaggtggaccttgctatcctgcagctctttggagatggtgagttcaagaaagggaaagtgcccatttgtcctctactgatggccagtccaaaacatcaacctttccttttcttccatttctttaacctgtgcatttccggaaaagcatttcacagtatattgtgtagttttcgggtatatatttgtttcctattgctgccataacaaagtgccatgcactgagtgccttaaacaacagaaatgtcttgtctcacatttccagagactagacgtctgaaatcacagtgccagcagggtcaatctcttccggggtctgcaagggagaatctgtttcatgcctctcctatagtatctggtggtttgctgataattttggcattccttatcttgtagaagcatacccctgacctctgattcatgttcacatggtgttttaccagtgtgcatgttttccctctgcacatgtctgtgtctgaatttccctttttcttaagaatgccagtcatattagattaggggttcaccctactctgggatgatctcagcttaattatgtttgcaatgactctatttccaaataaagtcacatcccaaggtattgggggttaggacttcaacatatatattttagggggattctataacatctttcaacccataacaagctgaaagatggcagggagaggattgaagcagtttgtcaaggaggtctttttctgggttgcaggctataatcaaaccttcagggataaagtaggagaactgatattagatgtttcatccagtcatctcacatgtggccaaaataatagatggaactgtggaaggtctctgctctttatgtgcccagaggtagggcggagaaataaacttgcggccatctcttcattcttcctgctctcccatcttgctctttcagctggaagaggcagaaggcagggttagggtcctcagaggcagacaccatcagccactccccagtatcatcctggcagcagactgaaccaccaacttgagttgaaaaaaatctcatcttctgtttcattatattcctgtcttctgcatccctcttcactttattgtacaaagaaactactgtttctgttagcattacagaaactaactcagttgtggatgagcagccagacccttgttggcttcaccagccatcagccaagtggctatctcaattatgtctgcagctttgctgttaaggatgagatcagaagcagaagaccacaggtggatttttagaatccaggtgaagttgtctgctccactagttaggagaatcatagtttgatcaaaaaaataagggaaaagtgatttgattaacattggaaacaggaggatgttttagctggagtgttaccaagccattttggtataagagcttctgtaattttagtgtagctgtcactcaaaggcaataatggagactgtatccatgagaaagagatgatttgcaaaagttgccaaaactttagtcagattatgcaagcaaagttcaattttttagccaaagtagaactatgggaataggcaattttctccatgagatttttcagaattttgcttgtctagaattagatgcattctagggcacatggtttcttttactttccttttgtctgggacctcttcctacttccgcctacttcctagcatctggtgaagtggaaaaaggtcattgaaatctgacatgagttaaagtgatcaaagcaccgttaaacaatgtgtaaagaaggcaagtctgaatttgggggtcttattttatccaagcttactcctctttgctctttattttcttcaacaagagatcagtaaatctgaggggccctagggaatcaatcaatctctctgcccatctctctctgcttgtcttctccctacccaatctgctttgcacaattttaagggcaattttctgaatcactcgtttgattatgttattccccactgtctataatataaagtacagaatgcttaatctgatactcagatcttcagcactcttacatcactcttttttattcagcttcttttgcctactatacctttttctgtttgaactgttctgcatgcctttacttaaacaagccttgtgtgttcccaccgaccatactattcctgctgcctggagtgcctttttgtacaatgtaaattaaaattcatccatccagcatgcccacttccaactcctacttacttcacgaaaacccactggccatgccatccacagaattactgtcaccaatttggactcttgttacctgcagacagcttgtcattgtgattatttatatgccaatttatacaggctagataatggagagcgggagcaacgtctcatgtgttcatatcgcctgcggtactcatgtgaaatttttattgaatgcttactaagtacgttgatgaattaatatgtaatggcattaataagattactgttaactttattcatttcctttctttttgtctccttgtctctttttctgtcacgtatctttctctttcttgctcaatacccctctttctcccttttctctgctcctttcctgtctcctctttttatccattttccttctctgtcctttccccaggggagatggaagaactggaagctctctggctcactggcatttgtcacaatgagaagaatgaggtcatgagcagccagctggacattgacaacatggcaggggtcttctacatgttgggggcggccatggctctcagcctcatcaccttcatctgcgaacaccttttctattggcagttccgacattgctttatgggtgtctgttctggcaagcctggcatggtcttctccatcagcagagtaagtgttttgatttaaatgcctaaagcttgttagggacagcttagcctagcactgtgcaaagcagagagaaccaagaggacactatctccacccccatgttgctcaagcaagaaaccacatcatgtatgttttcttaggagtttgtgtgatatgattgcaagtggctcagaaaagtgggtgatactatatttccttcaagaaacagctttctgtgtgggatttgggcagttggttctctgtaagaactgacagatctgtcaaaatggaaaatttggctttttaccaaatgtctttcatcaccattagttggttctgtataaattgtattaactgtctaatcctttaaaaatgtacatttctatttaaataatcatatgtaacatctctctcttattttaacatacaaaggtatattattagttgtttcactctatgttttaaccatgtgttggttatggagagttgaagagcttaacagaacctttagaaataagctctgactcataagaaatttacattccagaaacttccctagttggagcaagagtaaaactcttaggtcattctttatttaggtctcctcttcattcctagtctaaaatgagacactaggaagacagttttatgtatgaacaggtcacagggagaagtttttttaaaaagtgagcttcttttggttttgttaataaagtggagagactaagtcatgagaggtgaactcaaatgtccttttagaatgaaggtctaggttccagatatggccaaccaactttgactcaaatggagttttgtattaatgagaaaattgatttctcgttaaattatttcatcttttcatcattttcctatagtattttactgatagagaacaatttctccgtgtcctttctggctgtgagttaattcaggccatcaggtgagctcagaacaggaggctggaacttggggtggtgatgatccctgagccatgttgcttccttggtagcccttccctaagatctcagataggggaacaccagaagccatgggagctggtgatgtgtaataaaaaccccatttataatcctttgacatgatcaatgcctctatagaggaaaaaaggcttggaattttctcttgagcttaatcaggaagggttagaagaactgggaaagtggaataaccttaccttgaagatcttccatcttgctgatgccctgtgagacaatgagacttaccttgtctaaacctttcttctttcccatttcgctacgattcttctaaccctctcccctctcattcccatccacggagacaacttccctttccaaattagtcccgttcattataatgacacaattcaaacaacctcttttcatatgctttccctagccagggagaaaagttccaagtttgtccacctttccaggcagggaacaagatgtgagaaggaggttggcttgactttagaatcaaacatactgagccctccaggaacccagcccgttgcctctcctgcacggtgtccttcaaagccctgtacaaagagctgtacacagggagctctcgatcaatactaatttgttaagatgttaattattgatgataatattaagtgagtgagaaagtataagaaggaaaacaggagctaaagagagaataaatgagagaattcaacaagggagttatttattcctatttagtactggctgtttttcccaattcttccctcccacagtgtagaacacagcaggagaaaaatccttctttgaccccagggcttgctaattctctctttctgtgaattttgttcatgcttggctcaagaagagaattgctcagctgttatttggtgaccaaaattctaaacctgcttaaaatttgtcagagctagaaaagagtgacagttgtaagctactgagctcccctgtgctttactgtcagccaggtgtggcccagccacagcagagcaacctcagtgtccatagaacatggccgtttatttccaggaggctgatgatattttttgctatgggttgatatcatggcctcatttttaagatgtgaaaatctaggcatagaaaaccacggtaagtcaacagtgaagctgaggcaaaaatgccatatcttatgattccagtccctttgctcaagttactgggtggggccatgcccccccctctgatggccaggtcactgacctcagctcaccacatgacagtcaccaaatttaggggtataaattaggcaaacttctagccacatctaatagtatattagactattcgcttcatgctttccctttttcttatccagttggagcaattattggtgggagagtgttttttgtggtcatttctagcctctctggagatctaacctgtccctccattcttgcttcagggtatctacagctgcatccatggggtggcgatcgaggagcgccagtctgtaatgaactcccccaccgcaaccatgaacaacacacactccaacatcctgcgcctgctgcgcacggccaagaacatggctaacctgtctggtgtgaatggctcaccgcagagcgccctggacttcatccgacgggagtcatccgtctatgacatctcagagcaccgccgcagcttcacgcattctgactgcaaatcctacaacaacccgccctgtgaggagaacctcttcagtgactacatcagtgaggtagagagaacgttcgggaacctgcagctgaaggacagcaacgtgtaccaagatcactaccaccatcaccaccggccccatagtattggcagtgccagctccatcgatgggctctacgactgtgacaacccacccttcaccacccagtccaggtccatcagcaagaagcccctggacatcggcctcccctcctccaagcacagccagctcagtgacctgtacggcaaattctccttcaagagcgaccgctacagtggccacgacgacttgatccgctccgatgtctctgacatctcaacccacaccgtcacctatgggaacatcgagggcaatgccgccaagaggcgtaagcagcaatataaggacagcctgaagaagcggcctgcctcggccaagtcccgcagggagtttgacgagatcgagctggcctaccgtcgccgaccgccccgctcccctgaccacaagcgctacttcagggacaaggaagggctacgggacttctacctggaccagttccgaacaaaggagaactcaccccactgggagcacgtagacctgaccgacatctacaaggagcggagtgatgactttaagcgcgactccgtcagcggaggagggccctgtaccaacaggtctcacatcaagcacgggacgggcgacaaacacggcgtggtcagcggggtacctgcaccttgggagaagaacctgaccaacgtggagtgggaggaccggtccgggggcaacttctgccgcagctgtccctccaagctgcacaactactccacgacggtgacgggtcagaactcgggcaggcaggcgtgcatccggtgtgaggcttgcaagaaagcaggcaacctgtatgacatcagtgaggacaactccctgcaggaactggaccagccggctgccccagtggcggtgacgtcaaacgcctccaccactaagtaccctcagagcccgactaattccaaggcccagaagaagaaccggaacaaactgcgccggcagcactcctacgacaccttcgtggacctgcagaaggaagaagccgccctggccccgcgcagcgtaagcctgaaagacaagggccgattcatggatgggagcccctacgcccacatgtttgagatgtcagctggcgagagcacctttgccaacaacaagtcctcagtgcccactgccggacatcaccaccacaacaaccccggcggcgggtacatgctcagcaagtcgctctaccctgaccgggtcacgcaaaaccctttcatccccacttttggggacgaccagtgcttgctccatggcagcaaatcctacttcttcaggcagcccacggtggcgggggcgtcgaaagccaggccggacttccgggcccttgtcaccaacaagccggtggtctcggcccttcatggggccgtgccagcccgtttccagaaggacatctgtatagggaaccagtccaacccctgtgtgcctaacaacaaaaaccccagggctttcaatggctccagcaatgggcatgtttatgagaaactttctagtattgagtctgatgtctgagtgagggaacagagaggttaaggtgggtacgggagggtaaggctgtgggtcgcgtgatgcgcatgtcacggagggtgacgggggtgaacttggttcccatttgctcctttcttgttttaatttatttatgggatcctggagttctggttcctactgggggcaaccctggtgaccagcaccatctctcctccttttcacagttctctccttcttccccccgctgtcagccattcctgttcccatgagatgatgccatgggccctctcagcaggggagggtagagcggagaaaggaagggctgcatgcgggcttcctcctggtgtggaagagctccttgatatcctctttgagtgaagctgggagaaccaaaaagaggctatgtgagcacaaaggtagcttttcccaaacggatcttttcatttaggtgaggaagcaaaagcatctatgtgagaccatttagcacactgcttgtgaaaggaaagaggctctggctaaattcatgctgcttagatgacatctgtctaggaatcatgtgccaagcagaggttgggaggccatttgtgtttatatataagccaaaaaatgcttgcttcaaccccatgagactcgatagtggtggtgaacagaacaaaaggtcattggtggcagagtggattcttgaacaaactggaaagtacgttatgatagtgtcccacggtgccttggggacaagagcaggtggattgtgcgtgcatgtgtgttcatgcacacttgcacccatgtgtagtcaggtgcctcaagagaaggcaaccttgactctttctattgtttctttcaatatccccaagcagtgtgattgtttggcttatatacagacagagatggccatgtattacctgaattttggctgtgtctcccttcatccttctggaataaggagaatgaaaattcttgataaagaagattctgtggtctaaacaaaaaaaggcggtgagcaatcctgcaagagcaaggtacataaacaagtcctcagtggttggcaattgtttcaaccagtttgaaccaagaactttccaggaaggctaaagggaaaccgaattttcacagccatgattcttttgcccacacttgggagcaaaagattctacaaagctcttttgagcatttagactctcgactggccaaggtttggggaagaacgaagccacctttgaagaagtaaggagtcgtgtatggtagggtaagtgagagagggggatgtttccaatgctttgatcccttcttacttaacctgaagctagacgagcaggcttcttccccccaaaactgattacaactgctacagagcagacagttaagagaaatgagcttgacctttaagagaaatgagctgcactccatgagtgcagctctggaggtacgaaaagaggggaagagacttggaaatgggagacgggggcagagagggaccctccaccacctctttgggcctggctccctgggaatgtgacttgagcccagagtgaacactcttggtagaagcccttctaccttcctgcaacaccttgtttccctctcagattgtaccattgaggaataaaaaaagatatacatgtataaaactccagggatgagggtaccggcagaactgatgctcccttcacttaacattggaaaattgagaagggaaatgaatatgtatcactgccggtcctgaaacttgcggtagggctatttattctatgggtcagttccactgtcctgccatcctcccctacacagggtggcatccagagagccccaggtctgtgtggaagcttgactgcaggatcgccatgttgcacacaggacacataaaccagaaaggtgctcatcctcctctggaaggaagctgccatgtctcttcaagtcactccctccagggctgctcttcgcccctgtttgccctcactcgtgacccttcctcatcccgcccttgactgctgtccccaaccctcctccttgatttttacctcagtatctttcattttaaagccaactgaaggccttgtaaagctttgttttctttctaaaatgaacatgggggcaaggggctgaacctctcacagatttggtgagaggagcacggagtgctttaccttagataacagaaaagactgagagaggacagagggcatgaggcacctccaggaggaagaaggcgaagggccacgtaaacactgcttcgccctgactctgtccaggggtcagggactcatcccctcatcttcctcttacctcacccctttcaaacaaaaaaaccaaaccaactaacctagcgaacagcaatctagaaccaagggagctctttcagtctccgctggcaacagaaatcaagatggtgtttatttcatatgtaaatattttgttttctaattttgtatagataaagtgttctcttgtgagtattcagggtgttgggctggagggagtggggtggtgatgggaatgagagggaaaaagtgttttgttatgggttttcatttcccattgggggaattgttttgtatggcttttttgcttcagggtgtctggaaaaagcgaatgctcatggaggccactatggtgaaaaagccaggggaaagtaattgtgtccatcccccccagaaaaccagtcttcttactggtttgtgagaaatgttcatgcactttggccagggttttacatagggttcaatttggctctaagcaaaccccaggtctgactcctatcttctaggtagaccctaggttaccacattccacacaaagacaggctggtggcaccatatttcctctgtcagtacctagggtaggaaagattcccaaaagggcttaaacagaattaaggtcaaattaacttcccattcttggcgtgactgaaaggtttcaggaagctcaatcctgagaaatctcccagcggcctcctctgatgctgaaacaatcgtctcagtcatctgagtcttttcttctttaggacctgggcgctgactcactccctgccccatctccaccctcagaaatcagcctggcaaacacacgtggaaaaatctccactaactctactttttgaagcatgtgatatctggtcacagagaggtagtgctggatatgtgtcttacaaatttgcatgcttttctagaaaagatgatgggatccactaaaaactcagtggtgagatgattcccttagcaagattgctgaagttaggtttagacgtgggagggtgggtatgtgagcaatggtgccaatagcggctctttatttgccttgtcctcattactgccatcaggaaggtgctactggcctcgagccaggtgttcataatctggccttgggttaaccagacaaatagaacttcttttcctagactgttggctttgtggaggttggcagcctctatcacaggataaaatttccaaatccatttacccagtatattcactacattttttcctatcctcccatcataaaagctgttagctggacaattttatttttctaaacttatttggccccagttggttgcttttcttcaactggatatttgcactgggactaagttactcatggtctgct

SEQ ID NO: 15475 - DNA, 39529 bp, Human
ctctgggaagggaagagagtctggcccagatgggtaaagacaagtgtgttggcatctggtagacagggccagtggcacacaacagtgaacagctctactgctgacagccaacagggacttcggggtttggctgctggagatggaggacctgggcaaaagagacgtgaggccaagagagcaggtctcagaatgtggagctcatggaaggagagagggagggctaatcagactgctcctatctggccagaagccatgccccacactcaccaggccctaccccttttcctctgaatctttagctcttagatcagaaataatcttacgtgtcttcaggcttgatcctggcctgacggacagcagcctctgtcgtgtagcctttggagctgatcatggcagtacccaggaaaagactgtctggagaggctgcaaaaaccatgctcactgttcccagtccccgtacagaccatgtcagaggaggactgagggaggctcctctctctctctctctgtcacacacacgcacacgcgcacacacacacacacagatacacgcgcacacacacacaccgttttgcctggcagaacagacttataacttgcataatactgcagcagcccacactgtacctcatctccatttgggttccacaacagaagggagctggaaggaaatcagcgacaatctaactccacatgacaacctggctggacaacgaaacatccagcggggagaaagacactggaaattacccatacctgagccccatcccaaaacacctgagtcagcttctctgaccatggcccaggctaggtcatttgcaaagctcttgagtgattctaaagaaccactgctgtgaaaaataaaaatgatttcagcaaagagagaaaggtgaaactattttattggcactggctgtgatgctggctgtgagcagatgctggctgtgggcagaacaggggagagggccattgagaggcccttgtgactggagagtccaatcaaacgtaaagtgtgtgacagggagggactcctccaaattctgcaggtctctccagactggggatccctaacacaagaggaagtcttatgccccaagtgccagaattccaggaaactcatgcaatgaaaccagtcctcttgtgtcagagtttgcagctagaagcggttcaagggatggaggactctctgggagctggagtggtacgctgcaaagaacctaaatatgccataacttcctttacttccctctccaagaatttccaattgctcttccagcctattctgcctgacaggttagaaagttttcaatagttttcaatagaggttcgtttacttgcattgaattatctcatgaaggtcagcttgatttgggcacattaaagacagagtcggaagaacacatttccctaagttttattctaatgtacaacacatgtgatcatttgcgatggggtctaggcagacaaggcaggtaacagggagtccttccaaccaggggttggaacaaaggaggcttgatttggtgactcttgagacatttggctcactgctgtgatgctgtgagagattagctgtgcaatgtttgggctccttaaaaggaagtttatttaaaataaaacttacctgcacgtatgtaacactgtagacacagatccttcccacagtatatttaatctctgcagaattcactgggaggggaggggagccagtgggacctcttggctattacacaggttggcacttccagagagaacagtcttggcatcacaggcttcaggcatactcaaagctcttctcccttctgattccagtttctccatgccctgcagggcctcttgggattattgtattctggaaagcaaacaaagttggacactgtctctttaaataatagaggctgagaacctctcaggccaccatgacatatcccagcattggaccagcccctgaataaactggaaagacgcctggtctggcttcagttacagggagcaccaccagggaacatctcggggagcctggttggaagctgcaggcttagtctgtcggctgcgggtctctgactgccctgtggggagggtcttgccttaacatcccttgcatttggctgcaaagaaatctgcttggaagaaggggttacgctgtttggccgggtgagttttattggcaaactgtgcctctgggtgatgtgtgcctatgctttacaagaattgcctaatttcccaccccctgcaagccgcaaatgaaaaggattgcaggagagatggtgcatttgtgttggaattgactggagattcagagggctttttatatccttggttaaaaggtggatatatactctggctggggaggtggggggccatctgagagcatctagaaaccctaatgcatccagattgaaaggaagaaaggaatctagatgctttttcccccatggaaaatagctgtgcacacacagctggcaggtggccttggtaagcaggttagggagaagctgccacctgtggcagagccttggccagccgggctctgggtgtggcaagcctggtcagcaggcactgagtagcacttcctctgccaccattgagaaccaggcaggaggccagaggcagtgagggacagatgggttgggtttacctgtctggcagtatatggtgtggctgtgacctgggtggttattgattaaactattgggttcaaaagaaaggaagaagcgagctgtagcacccaatatatgcacttttctgtatgtgtattagactttattaaaaagtttatttgaaaatcacaaaggaagggaaagaaaaccctgagttagatatgctcatatttctaaagtgcttacttagaacagtcctgagtatgttgtgatcacataagtgttggttaaataaataaatgtccaaatggcataaaacaaagtaataatttctagagcaaatctaacttataaaatgacctgtggaggaaagaaaacactgccatgtctttagacttttttttctacttgcatatgcactttcatttataaatctttatctatctatctatctatctatctatctatctatctatctatctacctacctacctacctacctacctatcagagttacaagctactttagtgcagaggtggtcaggtcttccctgaaaggttgatgtgagagttaaatgtgatataataatagtggtggcaatttgggcactgggcccttattatgttgcagacacgatgttaactgctttgtacatattgtctccttcaatcaccaccataaacctttaaagcaggcattactatttccttttgcacctgagaaaactgaagctcagtgaacttgagaaattgcccaaattcacaacaaaagtaagcagggtgattaggtttgttggagcccagagccagagtgcctaaccactgcaccatactgcctctcacagaccatgcatataaagtccaggcaaagtgcttggcatataacgggcactgtaaatgcagtgtttacaagtacacttcattttaatctgataacacgatagttttaaaaagatcattgtttgaagatctttttcaaatttatttttacttaccgtaagaatatacaattagctaaaatagcagctcctttcaaatcgtaaaataatatagaattatttgaatcattgagagtgatgagcttctatgacacagtacactagaggtagggaagtgtgtgtgtgtgtgtgtgtgtgtgcgcgcgcgtgcgtgaactgctgcattttcaggcagaaacctttaacatccacattcctgctccctgtcccgtgcctcaaggctggcctgcgcacgggagtctcagttgggcgcgcctctgccaagccgagactgaagggggctagcctctctccctgtaacgctgggcgggccacgttaggaggctatgaatcagctgatttccttggctgctccaaccccacctcaaatggccacctcgcacccgcccgccaaaccccatggccaggactccagccaaggctgacagccaagcccgactgctgcaggaacactttgcctagagcttattcggtggtagtctggttttgcctaggctaggaggagcccaatcccagaccatgctatccagtagtcggccggacttttcttcccctaattcgcacccaagaggagcccgctagatcaatccccgccaatcctaggaagctggcatgcttcgtaggtgcagacagtaatagcggggaccggcgcggggcaggtgtgtccggctaagacgccaggacagggcaggggctccaggacccgagaggagagggacttcttccagcgctcaagcgcccgctgccctctattagtgggaaaggaatccagcctcagccccgcgcgggcgcggtcggcgtcggcgggcccagaagcccagccctgggcatccgctgagctacatttggctgggtcttcccagagtgggctgaggagccagtttctcggtcaacactaggtctccacggggccaggggagaagggaggtgggaggtgagaaagctcagccgcctctggtttcgagtaaaagtcgccgcggttttgcagggaccgactttttcttgaggcgcatttaaggccaagtgactgtctcctgccctccctctctcctgccccctctcctccctgagtcccgccctcccgcacacgctgacccagggacacaccctactgcagcgacgcaaacagggcgttgttcccgttaaaggggaacgccaggagcctcccactgcccccttgcttcgcgcgcgcgcagccccgcagcgcagctttggcggcgccagcagcggagccaacgcacccgagtttgtgtttgaggccaccctgaggatcgggacagctgttcctttgggctgtaagtgatttggtggggagagtgaaggagatggaggagaaatgtgggcatcttccagtgagggtgccagaaagcgcagcgcaggcgcggggctttggccagctccctggggcttctgtttaggggcacagggtcccctgtgtgtcctgtttccctccaatgggtcttggagtaatacaacgaggagagcctttatggtctataagaccttacagggcaagggtgatggtgctggtgtctggatagcggataagggcggcccagttctcgccttgctgaagaggcgttgactctgggacacactggcaaaacagtccctgtggcggacatcccgagagtgttggactcctgtggttccccagttcccagcctcctgccatcggcttaattcaaaccctctgggagtcatcagaaatccttgtttatttcttccagtgcattccagagtttctttgaatgtgatgcttgtggagaggaacagaggggcctgggattgggtactttccaaactgggttattgaaacgttgtctccctggcccaagactctgcctaaaatggtccccagagtctcagccagatctttcacagccatgcatgtcctctaacaggtcatcccagccttcagttcccccaaagtttaaaatgaggggcgaggaccgcattacttgggataaatgtcctgccggctctgaccggctgaaattctcggactcagccttttaccctctgtctctctctcccgtccgctggacatctactcccttcggtccaggctcctgggctcctgtcccaccgcacccagaccggagctcaggcttgttggggttcgtgtcctggctttgagtgcctggggtgcagactggacccctaggcgagcacgtgggtctagcgcaagagcagaatgccccctgaccccaggggctgcctggggaagctcgcggtggacgggaagcgcagggtccgggcaaccctctcgagccattcttttctttccacactactctggctctgcaccacctctccggagccgccagagtctgcgcgaggctgagctggggccaggaccgttcctctacgctggcagagttgggtggaaacttggagacaaacggaatgcggagagcactggggtctgggaaaccagcctcctcgccgctgtctcccccaccgcatgccacggctgtctccaggtctcagacggaaatctgggcacctactcccctcacccctacctccaccccataggggaattcaccatctgaaccggggtctcggagaacgtgacctctcaccttccagggaggtcgccgggaggtgcttggggtgggtggaagcgtgcagtggcctctgctcatattttctggaaacccctccgttccctgggtggttttagacgtgcgaaccgcttgttttgtttccaaaagcaaaagatgttccgttgcaggcgggcccggctgggcgctgggcactgggcgctggtcctgcaggcggctgctgccccctctcggcggcaggcggcgcgaaggctcctgacccgcgcgggcggtcgggctgcgggcgctgggccaggccgggccttccgctagtgcgcgggaccctccctctgcgcgcgcctccgtcgctcggcccagtgcgttcggcctcacgcccagcgctctcctcgcaggcagaaactccgctgagcagaacttgccgccagaatgctcctcctgttgctgagtatcatcgtcctccacgtcgcggtgctggtgctgctgttcgtctccacgatcgtcagcgtgagtgcctggcggggaggctccctgcgcggcccgcccttccccatctgggttcccagcccgtgctcctgctggttcaggactgtgttatttgcagacagttggaagtctcagacgtcccagggaagtttctggcaatctgcccccttccagttgctttgagaaaacgagagcagattcagtgataggaaccaagcgagcgctgggctgggttagctgcgcaggtctctatttaagccaagtaacttcagagccgatctagggtccccgaccttcatttgacaagattgtttaacttttttttttcttgatgcagcctcgttgaagaagaggagtatttatgatttttttttctccaaaccatagtcagatgggtgaattaatttataaaacacccttttaggacttgaaattggaaagttaaaatgggcttttctggaaaagagttcacaggtcccatgtcggctttatggcatgaacacaacacattgttagtaaagcttccactggtaggaacaggccatcagagtaacttctgttacaaaactgtccagcccattagatcttaaagttattttcttggcgatgaagatgagcagacattcaggcagttttccagtggtggctttcacttcttaatttaaggcacattgtaagcatgattttctttttcgttttcttttcttttcttttcttttttttttttttttgagatggagtctccagcctgtcacccgggctggagtgcagtgccatgatcttggcttactgcaacctctgccttccgggttcaagccattctcctgcctcagcctgggattacaggtgcccgccaccacgcctggctaattttttttttttttgtatttttagtagagacggggtttcactatgttggccaggcttgtctcaaactcctgacctcatgatccgcccacctctgcctcccaaagtgctgggattacaggtgtgagccaccgtgcccggcctgtaagcatgattttctagtctctgtgagaaataattatgttggggatttgtgacttagtttaacatttacaagcatcttcacagtatctccattgtgcctggtgatgatgatatcagactgataggagctataaacaaggaaatagactgagagaggcgggcttggggaatgatcccgagatgctgggaggagagaaggcttgaatgcaggtgtctaaggttgagttcatggctccttctactatagtaaacatctctgcacataatcgtttctgtgtgcatgtggaacttctccatttacaaggtgcttttaagtcataaaacgttggctcttaccatgcaggggtgggcggtgtggctaggtggatgcgggtgcttttcgccatccctgggcctttctccttccccttttccttcactcctccctccctccctgactcaggatatctatctgattctctctagcaatggatcgtgggcaatggacacgcaactgatctctggcagaactgtagcacctcttcctcaggaaatgtccaccactgtttctcatcatcaccaaacggtgaggctggttttgtgctccatgagcttgtcctcagacgcctgtaacacgtttctcagcccagagctggaaacgcttattggaagacacaagccagaatgtcgttgctggggtggggtgggatgtgacagggagccatgagtccagggaaaatgggaggggtggtgatctcgctggggaagctgagatcctgggcatcattgtgattcactctacctagagacatgcccttagtgccctcctgatcacttaggataatgctttttgtgattgaaaaaaatatcgacctgggagctgtgaaggtggtatgatagctaagcctttggcagacccccttgggacattggatcaaacgtgtatctttggtttggtggctgtctctattcagaaatgtcctgcccctttctgctgcagtgacagtggggctagctcactgcaccgtcagttacatggacacaagactggctgcctttccaggtcttgggcctcagtgatgccacctagcatcaaaacctttgaatgtttccttgttgcaagatggggacttgaagctatttgcaaaaccctaagctaagccttggggtccttaatccagaagatcgtatttctcctctgtcctcagcatctttgcttgtgagatatggaagccaggcttcatgagggtcaaattaagggataattggcagcagaagcaccaactaggtacccaaggcacccagagggaaaggaacacccagccaggagccctgtgtgtttggatgcagacaggtggaggtaaacaggatgagctgttttggtggctgggtaggccatagcgattgatgttaagagcccgtggacctggatccacatgatcttttgttccagaagatgtgtcctcaggctggaaggacctagagatacagcagagctttcctaacatcctgggtttaaaaggccacggaaatacagctttaaatgttgctggagctactcatagatccagtatatatgttcaagatgctacaccagacgagagaaaccagtttagatccagttcagtaaaacaggcagtgaagtggcctttggtcctggctttgcataatccagttgctttgctggactttccctcttacagctcagtacccagtaatacccaagcatgtccccagctgaagcattataaaccaaattccttgaaccacagtacaaatagaaactgctaaaataataatttggtaatttacatggagaagatacgcaaggagtagaaaaccctgctttatgtttttaccttctgggttggggagggagcagagaaaaggtcccagtcctattggagtgagaacagtgcttaatcttgtctctgagtgtgtgaaaggcattgaattaaagccatcccagaaattacgtggtgggtttgcatggtgagttggcaactgagtaaatgaaatactcatgagtgcctgagaatgtgaccgtagcactgcttgtccccaaagccacagcatccggtttctccccctttagggtctggctgaagttcccggagcactccggatgggagtctccgtactcgctactgacacctggtggttacaagtagtgactcagcccgaaaagggcaggctttggtgctcacaggcgccatccccaagtggcatctggccacgcggcttggcacagaatcctggactcttgggcccggaagggggcagttttggcaggcgtgttaaaacccggcgaagtttcagcagaaacgaggcggcagaggagttgctaagttgtgcttaaaccatctgcaggaaagaaagcaatattgacctgtagcatgttacagattgacatttggtgtcttctgccgttggaaatagctgtcagttggtgctagaagcagatctcaaagaggcactagggttattttaatcaggaaacttcttatctctcaacttgttccttctgtgccaagctcatgttcttgagttcatttacaatgcctccttagtgtgggtttcaaatctgcctcgttgctttccgtgaggaccccagagtgtctgttttccacatctcccttctcagctctcacaatcagggcattttgaaaacatctggacactgcacctgaacatgctgggtttgttttcacgccactcaggcttaatctaaatttgaaatttccatttacacttccccagtagtggttatctctgccgctatcttccccaacgtggcagcacttgctacgacttcagccttaagtggcgaatcctccagggcctctttgattgagtttaacaattgtggctgcagacaataagctgaaaaaaatgtgtactttttaaaacattatactgtctttacaaatgaactatgctcattgcgaaccatttaacttgtctgtatttgctcttagaaagtatatttgaaaaaaaatacttgttaagtaatcaaaagtaatttgttattgacatcgatttgtgaagaatatgttgcaagtgtgaaaaaataaatagtggtgcaatctcggctgactacaacctccacctcctgggttcaagcgattttcctgcctcagcctcccgagtagctgggattataggcgcccaacaccacgcctggctaatttttgtatttttagtagagaggggtttcatcatgttgggcaggctggtctcgaactcctgacctcaggagatccacccacctcacctcccaaagtgctgggattagaggtgtgagccactgcgccatgtgacttggtatttttttctgaaaggactcatttttctggtgcatgaccatgacacttcacctctctctgggggttgccactcatgttgttttctacatgaatggggcctcctggcatcgtgccatgaggcagtctaacatctaggttgtgtagtttgaaagagacacaccagatcttgcccccaggctacatcttaatattagaaatagttttagatttttaactaactgactttgactccgcctgccttctcgtttttctaaatgtgtttgtatactttctggcaccccctccttatctgcctcgtgtgggcagaggtaagagaggcttagtgtggggatattcgttatgatattgtatccagtgcctctccggcccagggaatacaaggatctggaatgcatgggccttgccttgatggtcccgagcctggtcgaagagtcaggagatagatatggaagggtgaatcactcccttggaaggcagagcaggccaggtgcccaaagggaggcaggcagacagcgtctgagttcagggaggaagcggatgggaaatctctggtgggaggtagaatctgatccatcctccaaaggatgggcaggatttaagtcaatacaggcaacggggaggagaatattccctgtgacctaaggtaagggtagaacaaggcaggggatggggtagactggttggctagtgttctggttaggattaggattgattgtgtataagagaacatcttcaaatgataggggcttaagtaagatcatttatttttctctcttttcaaagaagtctggaagtaggtagcctgagagaggtatggaggttccatgaaattgtcagagatgcagacactttctagctcatttctttgccatctcttgggtttggctgtcatctttaggaaacaaaaggctgctagagctccagccatctcatccatgattcaagcagtagggtggagaaaggaggtggggaagaatgaatctccttttcttttaatgaaatgtgacatggtcacacctacacctatttacaagagaggctgagaaatatagtcattcggccttgggggaagcatggcttttcaaatcatagaaacctggcagcaaatacctctctgtaagcctggtgtggaatactttccttgagggtttgaccatcccctcccatacccaatcatactcttttgcaatagctcagttgggccctatgcagttccataagtcccagttatttcagcattcttcaaagagtccatctctgctgcatcctgggctctgtcagccaccccaccattctcacatgggctcttctcagaaactttaggacctgttgaggcttctctctctctatttctaccacctctccaggtataagtaagtcttattattattattgagacagagtttcactcttgttgcccaggctggagttcagtggcgccatcttggctcactgcaacctccgcttcccgggttcaagcaattctcctgcctcagcctcccgggtagctgggattacaggcatgcgccaccacgcttggctaattttttgtatttttagtagagacgggctttctccatgttggtcaggctggtctcgaactcccgacctcaggtgatccacctgcctcagcctcccaaagtgctgagattacaagcgtgagccaccatgcctggccatcttattattatttaatgaatccagacctctcttctgaatcccagacctgtttatccagctgtctcctggccacttcccttgggatatctaagagaggcccccaagtcactaggccagagacagtccttatcttcctccgccaattcaacccctctgtcactttctagtattttagtgaatgctgcttcaccagccagcaagccaaacatctagagtctgccttgacttgacgcgtttccttctttctcttctcagcattgtcacgggtccctcaggccaccccattgttccaatgcctgttgcccacctgtggtcacgctgcttcctcgtttgtcagaggcgccagggcagcctcctaactagtttgcctgaaccctttcttgctcctctgtgactcatttttcatatggaatccaggctgatatttaaaaaagcacaaacctaattatatcactcctcattttgaaacctttcagaggccgttcattggtcttaatcttcagatgaaaatctttaacaaggcccatcggaatctacctgaatgatccactcctgcttctgttaagtctcacctcccatctctcttcccctcatcttggaatttcagcgttttctcacgtcctgaaatgtgaacttcccacttcgggagtctctccatttctcttctgatctttcatgcaggactatttcttgaacaactctcgtgtaccagagactattgcaggtgctaaggttacaagagtgaacaagagcttatgttttactggacaaaccagtcagtaaacatggagaatttgggggcaatggtaagaactatataagacagggtaatgggataaagagggattgcagtggtgaaggaaggtctccttgaggagtggccaggagccagccatatgaacatctcggggaggttccatacagaaggaccgtcaagtgcaagatcgctggggagggaaggagcttggcgtagttgagggacagagggcagggcagactagtgggaacagagagtgaggggtaagtagaatcacagaccatctcaaaggtaccccccacccccactaggaaggagttgggtgcacatggatgcatttctaatctttgtgatttccttagacctgctgtcttccacgggtttctcagtggtccatttgattccaagttggagtgacagtccagaagcctctataaggcagaatatatcagaaattgtacaaggtagaaatgcatcggtatattttcagtgattattttgggtgacgggattcttatcactttggctgttttctttcttttgctgccttacctgttttcctcattgagatcttttattttcacaatcagaaaataactgtgaacattttatgttagaaaattggttttgagtagtaagtaggttccctctgccttgattaagagagtggagccctggggcatggcacgcagggtccatggcgtcgctttgaatgaggccagttcctggagctttagtttgcaaactcatacaatctggaaggctctggtgagggggaggggtgtgccaagcctcctccccaagaccctatgggtgagtttaaaatctactgacccaaaggattcaggcaaaacatttgccctgctattgaatgaaccagtgctttttgttttgaagtctccaagatccaaatatcaagtccaagttctcacaagcattcccctgctttttgtttaatttgtgtggacctgacgtgtagcagaatgggtcagaatactggaattaagccacaggcggcttgggagcccaagagctagaagggcacagtcctggcttgccctggcccctggctggtcttcatcagcttcagtgatgaggcaggacccaggcagtttgtcttcagtaaaatctgtctctcagggcctgtccctgctcacaaagtcctctcttgtctcagaagaaaaggtagttgataaactttttcatgctgaggtgttaggcacaaaaaatgtgcccctttttgaatcacttttgtttttaaaaaggaggccagtgctcaacaccaaagcatgaagggaattgttgagctttcctgtaatctgtccccaaacgtccttggccacctccattgtctaagggcagtacctgcagcccctcatttcccagtgacaacaggtgggtctgctctgccacagtgtgtgggcgggaccagcaccagacgctgagaagatgaccacttactactcttcttttccatttaaacagcagcagcagcagcagcagcagcaacagcaaactcatgactatcaataggttgtgtgaggaattagatcaatgctttgggttgaaaattagagaaactaaatcttgccagtctcagcagcccccaacctgagcccttggtggtctcctatcatcgctgtcttcaaaacgatcccagacttgtttatcaatttggtgacactgtcattttggcaaggacaccagacaatttccttgtctgtggctcagcttttggccagattttagaaaacacgggagaccttctgcatttatgggttcatgttttacattttaaaatctttgtggctccctcagccaacccataatctctacccaaggaatggctctggattttacaggctcttatgagatgctgagaccctggtggtacaagggaggtacagaggacggaatgtgttgtcagcatgccaggatttcaacccttagggtttctctgatgccaatacccaggaattagtatgaaatgtttgtttgaacctgtgtctgaactgtatgacctggaatctatagtctttgctttaaaaaaacttcaattgtatccccaagatttcaccagcaccaagaaaacatcccttgcatttcaggagcagggactggccatggtgcagcctgaggttgtggatgttgatctttggtgcccgagagaaggctgtctgggatgaagccttctgactgtggtcaggtccctgccagtgctgggggccacatgagtgtgcagtcatccacacacaagtggcccccaacactggcagggacccggagtcatctggcccatccctccttcctatcccatcgagccacagacccctctgcaatatgcctaccacatgttcatcctaccactgatggggaacttattaccttcaagagagcctcttttgtttttgaagagctaatagtgagatccattcatgtgttcttcaactctattgagcctgtcctatgtactgggcactgttctagaaatggggtgcacagagatgaacaagaaagagcaggtccctgccattgtgcagctcacaaggagttggaggaaacaggcaatacacaatacatgcatcactatgggtagtggaacatgctctgcaggaaacaaatagggtgatccaatggaaagtcatcactggaggaatgagctgctcagggaaggcctcttccttccatagtgatgtggtctgagatttagaagacagggaaggaccagttataggaagaaccatgggaagaaaattctaggaggtaaagggaagaaccaaggccctgagttagctgaagaaaggagggtggggaatgcgggagagagggatgggagcaggatcgctggtgcctcacaggctgtggtactgagaaggacagttgggacatcattgaagggttttaagcagaagagtgtcatgatttgattcatgttttgtaagctcattctggctgttgagaatgaattctggggagaggcaagagtggaaactggggaccagtgaggagtttgtggtcatagtccagactggacatgatgatgacactgagatgacaatgatgacaatgacaatgatgttaagaatacaaacagctcacgtaagtgccaggcattctttgaaaagcaatgcatttaatcctcacaagaactctaggaggtagctggtggcttagctagggaggggaagtagagaagaaaacaggtctcatgacagggtttgctgatgggttagatgtagggagttagggaagaatgattctagatgactctacgttttgggcttgagcaactggtgtgtaactgaatcttggactgagatggggagactggaggaggaacagaagatttgcgggaaggtgtagaaatcaggatttatattttgaccatcagagaggtcagcaaatcacttcaatttagaagtctttggcttaggggagaggtctgggctggaaattcaaagtcaagagtcattcctctataccgaagggtattcaatgttgtggtgctgaatacagttacttggggaggagttgagagcagaaggcagaaaaggggaacagggttcagagctaagtcttgggcatgccaggggttaacgagggtacaggaaggagaggagactggggatgaacagccagtgatgagggaggaatgccaggagatattgtcacttaagaaattacctcggctgggcgcggtggctcacgcctataatcccagcactttgggaggctgaggcgggcggattacaaggtcaggagattgagaccatcctggctaacacggtgaaaccctgtctctactaaaaatacaaaacaaaattagccgggcgtggtggccggtgcctgtagtcccagctactcgggaggctgaggcaggagaatggcgtgaacccgggaggcggagcttgcagtgagccgagatcgcaccactgcacgccagcctgagcgacagagtgagactccgtctcaaaaaaagaaattaccttgttaaacccaacactgcccctcttttgtccattcacttctagttgccttcattcttgcctgatgtgctggacttgggttttatcaagttgcttggcacgtccttaaagaatttaaatctccacagtgcctcctggacaatgactgcagggtgacccctgtctctcctctacacgatgactcttcaaacagttgacgattgcagtttttctttccttccttctttcagtggcttctctggtgctggtcccagctgcataagcagggcctcttcttgcccttctgaagtttggtcagtggtttggcttggcaggctgatgagcagagaataagggaagccgctctctctttgccacaccattctccttccaccctctctagtttttgtggattctaagtctgaagaatggtggtagaataatttaattcattagattgcaagcatatcattgacttctctgcacccccagtgtgttgtagtggaaaaactagtagtctgggcatcagggaatccttgtttttctgcaccgggtctgcctgtaacaaattaggtaacctggggcaggtaccctggtttcctaaaagcagagcaggcattgaggtaggacctgaagttgaggtaggacctgcacattgcatgggtcccggagcctctgttcatgttcaggatgtaattgtggcatcgagggatcctaaaaggaggtggcctctgagctgggccttggcaatggggtagaattgcagtaggcagagggagcagagatgggttttgtgcttgtaaacgggcattggtttactgtcactggtgggggtagcagctcttttgttctagctcttcatttccataatgcgtgttcttttttcatactttaggggaaagaaggaggagaactctattatttctatggggagaattcctcctaaacctgaagatcttaaaactaagcgaattattccctgttcattctccactgatgcagttcatgactgcaattgcaactgcctttcccgtcattttctatggccaaactcagtgtttttaagtgagctcttcttttaaaaaacaaaaacaaaaacaagtctcctgataaatccgtttgaaagacactaagttttgaaagttaagcaggctttgatcattcatggtacattgtgaattaccaaggagggagattgatatccttcatcgtacaatgcactcccctcctttttcttttgtatctggtggagtaagtcttccaagagcaattcttagagaaacaaagcctactctgtttccctgtttctagagttttccaacaagggtataaaaaagcctcagacagcttactattatccagtaacctcaggtacctcagtggctgcgtgttattccctttagaagtccaaaaactcactagcagagcaagaatatggatgtcaaagtgcagaactagaccctgacaaactagctctgtgcctgccacaaagcctcttaattaggaatgcagttcattgaataactgtatcaaagttagctggaataccttgacatgaagattccttccacttactgagcagtttgtgcccactagtggccagacacaggctttgctctagctaaaatacccccaggattacctgttgagagagccgcccacgtcaccttcatcgcctttgtgagctccatgctggcacatagttgtctccatctgttttgctttccgcatgaatcataggcaaagttagcctgaccagcaagcccatttcaaagccaccagctgggggagaagttgaagcccagggggcaagacccacgctgggctttgggcatgtttgagctggtgggcgaagcatatgggcaaaggccacattgtttaggatggaggcctttcagagactcagctatttctggaatgacattcatactgagaaataaggaaaatggcgatctgtgtgatggttgtgggttgggaggtttgggcgtgggagtcctggtcttggggtcatgtgttttgaaaacagtctagcactatgcaaatgggaggtgttaataactctttgcctctgtgatttaccctctcatggctttttctctcttggcctctccaaggtctcttctgactcttgcaactgtccttcctttcactttcaacaaaacctgttctcttgagtcagaacagttttatgaattgcccagagtgggacttgatatggggcagggttggttccatgctggtaatgaaagatgcacataaactgttacattgaaaagtgcttcatactttctgagcccttaactcactaggttgtaggccctgggctaagaatatagctgagggggctgatgtatttccttcattgctcagctgctcctacagcaggaatctgaccttgaaatgagctttgatctttgtgcaactcgagcttcccactatctgctgggggagctaggtctgggtgctgccacggcccatgtcagaaagctgtcagcagctcttataccggacactctcagaacaggaggcctgcaaagagctttagctttagttttgttgttgttgttgtttttgagacagtctcgctctgtcgcccaggctggagtgcagtggcgccatctcggctcactgcaagctccacctcccgggttcacaccattctcctgcctcagcctcccaagtagttgggactacaggtgcccgccaccacgcccagctaattttttgtatttttagtagagacgaggtttcaccgtgttagccaggatggtctcaatctcctgacctcgtgatccacccgccttggcctcccaaagtgctgggattacaggtgtgagccacggcgcccggcctttttttttttttttttttgagacgagtcttgctctgtttccaggctggagtgcagtggtgtgatctcggctcactgcagtctccgccttccgggttcaagtgattctcctgctccagcctcccaaatagctgggattacaggcacatgccaccacacccagctaatttttgtatttttagtagagacggggtttcaccatgttggccagtatgatctcgatctcctgaccttgtgatccacccgctttggcctcccaaagtgctgggattacaggcatgagccaccacgcccggccagagctttagtttttaattccagtgctcagcaccaaggttggatattggcttaaaacttccactggaaactccacaaatgtttagcaggcctccactttgcaccaggaactgagtgtggcctggaggacagcaggtactcaacataagttctactatttattgcatacttgcaaattgggtggggcgtggggaagagtatcgccacactggggcttgtgttaatctatagtttagccacttgggatgttggtgtcacactaggtttgatctaaatagaacaggtttgtaattgacagcattttcacttgcattatatttctctgaactcgaatcattattttctgtacagctgacttgttttgctgtagcagagtttggcagataatagcttgcatgtcgaatccaacctgcttttgtaaataagattttattggataaatggctattgaaggaatgggtcacacccactcatttacatcttgtccatggctatggctgattttgtgatacaaaggcagaattgagtagttgttaagaagaccgtatgacctgcaaagcctaaagtatttgctctctgattctttatagatagtttgctatctgtgcagatatttgcactctgactctgtagcacccttatgctggagaggagatatgaattgataccaaagttgtatcaaaacacttttggagttctggccaatgtgctaataacctggcttgtgtgaacattgtggctctcattttcttttttcttttttttttttttgagacgagtcttgctctgtcgcccaggctggagtgcagtggcgcagtggcgcgatctcggctcactgcaagctccgcctccagggttcacgccattctcctgcctcagcctccagagtagctgggactacaggcgcccgccaccacgcccggctaatttttttttttttgtatttttagtagagacgggttttcactgtgttagccagcatggtctcgatctcctgacctcgtgatctgccctcctgggcctcccaagtgctgggattacaggcgtgacccactgcgcccggcctgtggctcccattttcatactgcttggtgtgacccagatggaaatgctccagaacctggcccctcaataacagcctgtaaatgcttgtttaccctgttttctcacatcagccttttaggtggggttatttgcactatcctttaacagcgcttcaataacaactcttttgtttgatcattatgacaacccaataaaatatattagtgcctcaagtacgtaaagcagaattcaaggccaaaaaaatgtatgtggcaagttaggtgggcggtcagaagaacttggcaacagagcccagccctgcctgggctgtcctaaccagagcacataaatgctggagagagtcaggctttgcacgtgctcacacgggacccttaccttggacaggatcaaagccctgtcatttctggagtgtgtgatatctgctgtctcttactgcgctggttgttacctgtctattccagttctgatgaatggctctgattggggagcagcatcatctgagcttagaaatgtcctcagggccctgtggggttccctttgagcaacaacgagagctcttgaatcttgcaccagccttttggagctggaatggagtttgctttctcctgggctgggctctgttttttttcctctcgctgtccttgtgtagcttttgatcaatggcactggaggaaaggaaaatcccttgttgttttcctgggcatgtggaagcccagtcctgcccagaattccactagccctttgagttttggaatcctgactcttagtaagtcaatagagtgctgcatctgtttttacctttgtaatcttttaaattggttttaattatttaagtaatacaagtattataatacatgaaaatatcctcaactgaaaggcttcttgaccaaactcttcttcgttgcaacagtagttcctgggggaacccactgacatcaatttgacacaactttggctctttctctacgaatatttgcatgcctgtggatgtctatacgcaattacatagttttttggtgtttgttttcataatgatgacatgttgtgtgtgcaccttactcttttcattgtcttggagacctttcaaagactcttcattttctaactcatgatttttttaactgctgcaaaatatttcattgtgaggatataccataatttattttccctcatagaaatgctacaatcaatgtccttatttattttcctctgagtatatgttcactgtttttccaggatatagtagataagcacttgaacacatatagtgtcattacgctagaggtgttacaatttttaaactacttttaatggcaaaaattacaattacttttgtatcaacctaatatattctgccacaaaatggctggtcacaaaaggattataataataatattattattattcctgtgaatggtgtctgcaggtagctatcacttatttgttctgctgatattatccattttttttgaattttgcctattggctggatgaaaattggtgtcaccctcctcatgggtttctcttgcatttccttggttgctagtgaggttgggcaccttttacgatgtttattggctgttcatatttctcctttgctaatcacatggcttttcaattttatacttagctgttttctctttgttctgtctgtaatttaattttgttaatgatgcgaactagagatttaattttatgttttaccaaatgaatagccaacactatgtattgtctgttgtatttttccccactggtttatatgatgttgtgtattatctaccaaatttacatgtatgcttccaaagtcttattccatcccattcttttatttttctttcatgattaacaccatatttttgaattgctaaaactttataatataaatataagctttgtatgtctataaataaaatacattttattaattataattatatgttatataattataatataagcacttgaacatatatacttctataattatatattatataattatatatcatacttctatgatatgttctataattatatattgtatatatcatagttctatgatatgttctataattatatattataaagttacaattaattgtatatttaatttataccatatactgtaataagcaaaatatagaaatatgttttaaatctggtaggtggtatcttgactcattggttttatatgtttttctgattttctttttgttcatttgttcgttttggtttttagttgctgttgtgtttacttcaaattttttcttatctgtcattgctcattgttttttagatgaatttttaattgatttttttccagttccagttgcaatatggattaggacagcattgaatttgtagattattttggatgaaattggcatctttataactttgagtgtttctatccaggaacttagtatgtttctttagtacttcttttatgtacttgaataaaatttgtctaacttgttgatgtatccccaaagaaccagacatttttattaaatgtattttaatatttttttctgtctcattagtctgtgcttttatccatattaagtcaattaatttttggacttatttcattgttttttttctggcttcttgagttgaaagtgtagttcactctttttaaggatttttctagcaaatgcttagaagtgtatacattgtcctctgagaactgctttggttacaacccacaggtgtgccatgtggctctctatataattccttgctgaagaagtttttacttttcatcttgttttttttaatccgaggaattatctggaacactgtttttaaatttccaaatttattttggctagtttgtttttaatgtctaatttctgtttgcctttaggtatatgttgagcctacatcatttctgcttctatatttattgagatattctttgttgcccttatagtcagtttgaaaagctgtcccatgtgtgtttgaaaataactttgctatatagacacaagttttctatacatctattaggacagatttgttaatcctcttatgtaatctatattctttcttctttttggtctacctgacatctattttgaggaaggaagctaaagtcttctactgttattgtgattttaacaatttcttctcatattttgattactttttgattttaactttttcaggccatgttattatatgcataatgatttattttcttcagtcatagatcatgtaaaccagaagtaaagatcaaataaaccaaatctttcctctatgaaacaaccaaacaactctctggccacttttatcctttcaacataagttctattttttattattaatttatcttctttcttttttgttaacatttgcctgaagcttcttttcagaatcttttttgtttttgactgttgcttgttttaggtgtatctattatattagaatatagctacaatgtctctcttttttttttttttttttttttttgagacagagtctctctctgtgcccaggctggagtgcagtggtgtgatcttggctcactacaacctccacctcctgagttcaagcgattctctgcctcaacctcccaagtagctgggactataggtgtccaccagcacacctggccaatttttttgtatttttcgtagagatggggttttggcatgttggccaggctggtcttgaactcctggcctcaagtgatctacctgcctcagcctcccaaaatgtcttaatcaaagataaaattccatatcttatgagtgccttgaacccattcacatataatgtggttgatgatagacttactatcttaatgcatgtgttttatttattgggcttatggttgaaaaccatcttcttcatctctggatcatcagagtcaaccagagggcttggctcaaagcagtaggtattcaacaaatgctcattgaataaaaatgtccttgatcctctaattctgatttgattcgagaaataacttatggcaaagagctcaattgtaatggggttgggactaaaattcaagttaatgttgaaagatgtttcaagaagtatttaggttatattattaaatattagacactttctgtttatatagatttaacatataaagattttaagttttctgtgtatgtgaggtctcgtagtagtttctgctgaaaatgacaggggcgcggggttaagggtgaagacagtatctcaggattggagaaggaaatctaagatattgtctccaccagccatactcctcatgaacatgcacatggaaggacatttcccagccaaagtgaatccctttatttgttttagtttcagatttgagtctcagatttctttgtaattccagctgcatctaccaaagtgctagataatttttttattttaagcaaacaatattatgagaacattatctttattgcaaagtgctcctccagaagaacctctatgctggataaagacaaacatttgattaaggttatgtaagagtgaaatcaggatggctcacaacccattagccgtcattttcttactttaattgacaaagaaattgaaaaaatgaaagaagcatatgttgtgcttgaatgtgaagagtgctagactagaatcaaaggcctcttagatttggctgtgtcatttgggctcatgaaaacacctctggaaatctctttcagtgcaaaggagctggactagttgatctctcaggtttcttccaactctaaaatatctccagtctgtgccttggaaacatcttaggtgaaaatctaggaacagttaacctaatttgcacccttaaaattctgccatgagctgcttacaactcaaaacaagtttatcttactcagttactaattataaaccatccagatttcagagctgtgagtactgggtgaagcattgaaggtatgcttttgaagccattacatatggcagttactgagctgaaaggattaaatgctgcagcttccccagttgcccttcctccatgagagcagtgcctgcccccagcattctgtggcacttggaagacaagacagaggccaaatgcagatttttaccctgggcttccctctacagtgtggaactcaggttgtttcttctttcctccctgaaatgacatgagtttgcagcggatggtgaactgaagaaaccataggaggctctgtcttcttgcctgaatttcagttggaagcttggagatttggggttcaacagagataaggaagtgtaagccttcatcccgtctggtggttggcgatcacacaccgctctgtgctgaggctaatggccatgatcagagttgaccaaaaaaaaaaaaaaaaaaaaatacgggttgtccaagcaaattgatttccatacctatagagagcatacctttcttcatcagtattttcttccattcttccaaaaaattactttgggctctaacagccattcccgtgatctttacctctccttggggaatgcagataatttgaatagtggttttaagctatttttcttggaatacagaagttctgataagcccttcaaagacccctgagggcaagaagagggaaggtagtaggcagggctcaggccctctttaacacagacacatgtacataagtaacacatttgcaccaacactggaaggaaattcaatatattttaaaatgactttaactcctagtgatggaactatagatatttttttacagcccttccctgaatgttcacatgtgttttttatatatatgtgtgtgtcacgtatttgtatatgtgtatatacacatatatatagaaacacgtacatatttgtatgcatatttgtacatataggtatatatgtatgtaatgtgtacatattggcacatgtgtgtgtttgtatatgtatatatcagtacatatagatgtatgtatatatgtatatattttttcctccaaaataaacaataaagaatgtcttcttagattgcaaaagtgaattgtctgagttctgctaaggaaaaaggacttctgcttctgctgcctgtgaggactgtgctgtcagcagtcatggcccttcaggccctgcacctcgaggcagagccctcccccggccatggccagctctcctaaccaagtgtctctttcccccagaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtaagttgtggatggtaaagtccatgtggaagcggggtgcatccaagtctgcggaatgattagtttagtagaaggatgtggcctcagaatgactgatgttcatgagtctccccactggatgctttccataaagtgagggtgggtgcttgtatgtgtgggtgtgtacctgtatgtgtcttagaacttgggacttagaactctccccttctccctggaatgagatgcatatgaaagagaacttagaggatctggaaggaaggtccccacccaagccaggcgtatcaacaggaatgaaactgcaatctggacacataatcagaggtgaatactgaggctatctgtagagcaaaggtcaggcttgagagctgtttctgtagattacattatgcctccagaaaatggccctgatgtgctaagaactagcaaagtagttatcaggtatgtgtcttccaccaataggtagtgatgaagccacactgacaaattctcaccttccttgcttccagttcctagattctactgggctttgattgactgttgtcatcctctggtgtcttcattttgacactcttgtgtcacatattgtcatttccaaacatggggctatgacaacacatgaaaacacatgagaggtctccttaatctcctgcctaaactgtcttcaagttccctctttaaatacgttattaatatgcatagtgtgcagagtcctagaaacttctgttacacagggtgacatcttccaactttgtctctggattctgcctagcatcttacatgcttacatcttacatcttacatcttacatcttgcattctgcctagcatcttacattagctcttacatgtctgtctgttgacttactgttgactgaaccagcagggcattggagagaagtaagagctagatgtagtggtggattctgtggtccaaattcatagatcacaaacttcatatgtaccagagtatgtctaggtactgggagatgttctcaattctgaccctctgagagggcaaaggatgtagcatctcttctctgagttggttgtcagaatgcccatggtaccatttcaccactctgtccccaggagcagtcattggaaggttgacgtaaatagggttgtatgggaagacacagcccaaggttagatgttggtgaccttgtctagaagacagagagttcccctttcctgaaaaaaggaagtaaatgattaaccacttctcattaaacactcaaatacaacatttcaatactcatggttttgagatttcaaaaccagacagtgctttgctacttacacatgtcttatgacaccaagccaagctcctggatggttgctggctctgttaaatgactaattatgcaaggagatatcatttctaggtacgttaaagtgaagagttacccttactcaattttcagttggaataaaaacaactgtaacatattctggggtttctttttttttttctcactcgttttagtttgatatcaaatcaaataatgatcatatccattgcatcagtggatatgccctcaagataatatggatttagaaccagaactttcataatgtatttctattgaaatgttagtttcataagcgatgattgggttttcatgcccatgtgtgagatgtgcctcgctcaaaccttgttatgatttggcacgttacccatctgatgtgaaaaaaattacattttatttgtacaggctcgttattttactgatgaataatttgagcccaccagaggataaatgaatgaccaaggtcacccagctcatgacagggacggttgagtgttacactgaatatagtgaggtacttcttatattttaaagacagaatgcaccaaaaaatttaaagaacacaaaatccaaggcagaagctctgccttttatattatcttttattggaactgatttacaatggaaggtaaatgcaaatttgcaccatgtattattctgaagttccaaacatctgtgatgaatacaagcctgtactataagacccagtcacattgaaaatatggagctgagaagaggtaagctgctgttgaatgggctccttgggatagccagtaccttcatcttcattcatcctgctgagctgtttcggctttaagttctttaacaatgtctttttagcaacatcattacatcattttaggccaaaactcaaagtccagagataagaacccttaagtcactcatgtaactgcactgtgtgttaaaagtatttcagttcagccaaacactcttctcctaggtattgcgatttaagtatatttactaatccactcttgcttcactattttcattctcctccaaagtcaatacaagatgtttagaactgtgctggaagtgcagaattccgaatgtaaaagcgcatgactttgtcctctttatcccctttacatctagctgcttacgtctcatgaaactgaattttcagttatctgttggtccacatttgaataagaaattatcttgaatttgaaatgctgagctgtaatagcagttgtaatttgtaagtcctgagagtgtcctgtcctccgttgttaatcccagtcaagatcatctgagagttggtctccagggaacctcagatctctaggatgttgcactggaaatggctgcaggatctttccactaattctgagaactgaaagagttaggaactctatttggagagttcctggttcccttatcgtgtgacagttctaagtcaattttgtcatgtggttttctgactcacagactagtaagaagttagtaattagagagctaagtagattagggttgttggagatgagaaacccacgttttgggaaaacctggcaagtgacaacttaacatcaaggaagtagtcagaaaagctaaaactgacaaacagaaggtagaagaaagtagctccacactcatgggatgtgaaatctacaagcgtgcatgcccggcaaatgcctctccaatgcactggagcgttttaagtggaaaccactagaatctctgtgtagtctccggaagtggctgtgagggctgcattatctctgcacagcttcctcttggtgggcccagctgtgatctttatggatggcacacatcagctttcaggaaaagcacatgaaaggtgctagggctcttggagctgactgtaggtttgggagttgtctgtctccttgctctagattacagctctgtgtgttgtgtggggtctccatggtttgccaaattatctcttcctcacttagccacaaggctgacagttaggaactatctcttcttgattgcattaggttggctgcttcctgaatgcatatcaaaaggctccttcctttagttcagtgctttcaacctgagctgtgcatcagaatcacctgaggtcctttaaaaaaaaaaaaaagacagtgggcggggcgcagtggctcacgcctgtaatcccagcactttgggaggctgaggtgggcagatcacttgaggtcaggagttcaagaccagcccggccaacatggtgaaaccctgtctctactaaaaataaaaataaaaaaatagccaggcgtggtggtgcgtgcctgtagtcccagctacttgggaaactgaggcagagaagaatcacttgaacctaggaggtggaggttgcagtgagccaagatcatgccactgcactccagcctgggggtgacagagtaagactgtctcaaaaaaaaagaaaaaagaaaagaaaaaagacagtattcaggtctcatccctggagactctcatttaatagttgtgggatggatccactgcctaggtgactctgatgtgcatttagggttgggaaccactgacatagccattaaactgtccctaatcccactgtaaggttttctaggatattttcccagaaataactaaaccaccttcttagagaaggaacatcctgatcctgcgtctggactttggagtcattcttattttcagaacctatagccatctattccttgacaagatctgttgggttgggttgcactagactggaaaacatcaagaaattaatctagacacagacctaaaaggaagatttgcacgttttgatttattttactgcttacacccagcatcaagctccatgtggggcacatagaggagcctgaataaaactattattggttggatgattagataattgtgtttcctcggcagaatcaaactcaagtcaaatgtgtggttaccgggattaagaacagaaagaatagaggggactcctgagtgagtttcactttctctctctttttgttattgttgttcatttgttttgttaatagaaagatcaatatagctatagagcatttaaaataaaaggatttgggccaggtgtggtggcgaatgcctgtaatcccaacactttgaaagactgaggtgagaggattgcttaaagccaggagttcaagaccagcctgggcaacaaagcgagatgccatctctacaaaaaatgatttaaaaattagtggggtgccttggagcacgcctgtggtcccagctattcaggaggctgaggcaggaggattgcttgaggctgagaggtcaagactacagtgaactatgatcaggcccctgcacttgctccagcctggtgacagagtgagaccctgcctctctaggaaaaaaaaaaaaagaatttggtggggggggattaataaaagttcagtgccatcctgttcagagtgattcaaaggtggcttaagtcaaataccacatttagaaatttttgttagggacggatgattatggatgtctcactggccatgcccaaatcagagtcaatgctatgggtggctttctaggcagcaatggtcatttggatactgaaaatgtaaaaggagtgggcttcaatcacagaaacacagagaagtctcttgctttcagaggaacaggcctcacagccccttcctgccctcccttgttgccctgaggatgaagtgggagggagaaaaaggcacccactcatcaacccaacatcatagctgcaccttccagtgaccaccctggtggtctcactgacatccctttccagccaacttctctctgacttctgccccaggctctcaaatgaaagtgcttttgcgaggttaccaaagtacactttgaagtctttaatttgttggatcactctgctcctttcaatactgttagctacttactctttgaagctctattcccctggcttctgagacatcgctgtgttcccacttgcctgagtgaacacaccaggcggtcatgctggcctctcctctctccctcaccccacagccagccttctactgaatcctgcatttgggtagcatcctccgtaggcattacgcccatttctttgtcttgactcactaaccccagtgcagctatgcaaaggcctcctcatgcaccttccagctacctgccttgtccctgcccctgaatccattttctgcaccatggccagagtgatcattctaaaacgtgcgtctgatcatgtttctcctctgctgaagtttcctcagaggcttctcatcacagcttccttaacatgtcatgtaaggccctctctttcctgacccttagtgagctaatcagcctattatatgagagtccgtgtggcttctccagttctccagtttggactcagcgcccgtctatgctcttggggcatctggtgcatttccttccctctctcgaaattccatcgaactatattgaaattatatgcaaatgtctgtcttctagacacacagtccttaaggtaggagccatgtctcacttatcttggtacatctagagcagcagctagaacagggcccgcatgcaataggcactcattaaatgttcactgaaccaaagggaatggagatgataaggatgtactgggaattccctcagctacttcctttgaccttggccccttgggtgcttccttccagaggctctgggctctaatcactctcatggggttgcagtcactgttaaaggagcttaagactttctcttcaaaagggctttaggcagaacttgcaggaagttgttgcagacctacccatcctgagacagggagaaactcttgtaagttgaatgctcagcacatttgtattgtctggacagggtcagtgtccttctgcttaaagatgacctatgctcccagactcaggcccctaccagggagtcccggtcattgccaaagagcagaacatctgcctgtgcctcagggcctcacttacccttgccacagggacctggtgatacatctccacctactggttgctgagaaagtgagtcacagtccacttactaggggtatttggcttttggagatgactactggatgacattaactgtcttgggttgcagacagagggaacccagccaaagaatcatccttttctctatttcagggtacatctattgctttacatgcagacaatcttgtaataatatattccctaaaacatcagtctcatgacaacaatcatataaagtgtgtatcctctctttggctttgtagatatctaagtttactgcttatcacggttaagcttagagtcattcacttctgagattctactaagatgaaagtcatacacattaagctgtgtagttagtcgctgcacttctctatactgcctctttctatccctcttgttcaaggatggaatctggtatctcctcttagtcagtgaaatcggggagtagctggtccactcagctcctgaggcatttctcatgccagatctggttagacagcccatttgggagccctgcctgcatgatgataagtgttgtcctgccctgctagcactctgttaacacctttctctctgccaaggtcatgtttccttttttatagccctgccttcattagataagtcagacagagcccaagagacaacttcagtatttcttaaagacaagagttagcactttggagatgcaagccgtggaagagtggggcaagataattaaggatcctggacctcaaggcaaataaagtgtgtccccagcagatcaaaactgctgttttctgcaatcaacaattaacccgcaatgatttcgctcctgacatggccatctttgctgtcttctgaacttcctgtaggtggcaggtcctggatgctgtcccattttggttccaagactattgtgtggctctcttgacaggggccagtcaagtggcagttttctcctctgagttgcaggaggacaggcttaacagggtggttcatgtggcgtattcccacttctgcactgtcttcaaacaaagttgcagtgtccagtaaaacagcagcccaaatagcagtgaggttagatgtaggtggccgggcggtgggggggcgcgggtgcattgggaactctggaactgcatgaatcccacacggcatactggatttataatagagtcactcagagcttctcaaagaccctgttttcagggaggaaacagaccaggctttgtgcagctccaggctggggtgctgacatcactggacccctccttgtggggggacgctgtctgtcacgtgagctggggccatcagtttgagcgtggctgctccacagggcccaagatggaggcttttcttctctttccaacaccgaagggctgcattggtgggccagggagggtggcctgacccacctgcatatccagtgccctttagccttctttgggcttcaaatgcaaccttggggcacccagggaaatggagcttgcctttgatcatcttccccctctgcagcgtggcttcccagtcatactgtcggctgcatccttattcctcactttctttttccctctccacacatttctttgtctgtttggcagtgcccataggcattgcttgcttcacctggtatgtggcaactctgttagggggaccataggcccctgtggtctgcatggagcttaatccttttaccatggcgtgactccaataatggtaaaatgtcacttcacttccattggctttaggtaatgccaccactcacttgtagagtggcatatagatttccaggggtttccatacccaaccacccttggaaagagacaggtaggtttttcttgcagcctgaatgcctgctggccatgtagtgtggcctgggaattggtgacagtgaaagaaagagaaatagggcagaaaatgtaaagaaaaccctcaggtattaaggcctaggtggccaagattggaaatagagagcaagttgttttccttgttcccatatttttgtgctacctcctttcaattctggacctggaagcagatttccttccagaggtagaaatgttcttcctacccagcaattgtcagcatccggggtggcggagagggggccgctctgccatggactctccgtcacccagcttgtccctctccttccccaggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactcactggtctctcttgagtttttgtgggaacttgggtgtgggtacaaggtgcctgttggagcaggatgaagagcttcagtggaaagcaaagttgagctggagatttgggttacaagatggtgctaaggcaccaaaatcatagctgttttacaagctacagggagcacatgatgccttcatgatgtctgtgcaaaggtttgctaattggagacagttgggaattgcagctgaaatggaggctgtaaatggactggaaggcacttgagtattcatttagttcaaccctctctggtgctctgttgtttgatgacccacatggaaaacatggaggcatgtcatgagctgccctgatatactgggaatgttggcagaagcatctcagatccctcaccctgaggtatgatatggtgaaaggtctgaatgatggtgacttgaggccacacttgcagataaaacattggttggcaccaactaagctcctaatgccatcctgaaggagagaaaaggccaccattgtcacccagctcagggtttctgagttgtgtctcatgcgtccatatttttacccgtcgaccttttgttgtgtgtctgcaaaataacaagcaaatgatgtggttgatagtccttaatatttattgtgcaactattttgaattgggtaccaaagataaagaagtaatgacatatatcttaacatcgaaaggtcacattttagtgagaggtacaagtaaacaagtgactatattataataaggttaagagcatagaaatgagagcctgggtttgagcctgtcctttgctgcttaccagccataggggcctgaaaaggttacgtaaacactaagattcagttttctcatctataaaatggggatgccaataacaagggtatagggctgaggggatttcaaggaagttatatggataaagtgttcagcatagtgactagtacctagaaagactctatagattagagtggttatcacatatgttacaacagaggtatatttgaaagagcatgtaggagagacattgactgttatgcaggattctcagtatcagtctgcacactggaatctcccatgcaggaattcccattagagatttggattccctgtttccatgatgggacccacccatcatggtttaaagaacacttctggtgattacagcatgcaactggggatgacacctctgagctagtgcaggaggtctcatacttcaacatgctagtgaatcacctgggaatctgatagcatgcagattctgaaactttaggcccaggtggggattgagattctgcatttccaattagtgcctgggtgaggtggatgctgcttgtccaccgaccacactttgagtagcaagggcctagcataaagccaccttcaggtaccttgtgctcttctgtccttgggtgtctgtgacggaaggacttctcttttctgaggttttcagtagtgactgctactctgcttttgactcagatagttttaaggtggcacaggtggccatgagatgcatgtgagattaagaaaactaggaattttatttcacgagctggtactttgaaaacatacacttttatttcataaacttttctaacatttcattaaaaattaatagggataagaataaagaagaaaagcaaaaacggcccctaaatctccctacccaggtaacactcttggcatttaaaaaaaaaccatatatctaggattataacatcctatcttgtatctagagggaaaaatacaatctgaaagcctctttcccacctacccatagtcttttgccaaaggtaaccgtaagacatagtttcttatgacttcttccaggaaagaaaattgcccacatatgtacatccatctatgtattttttaaacgtacacaaaagtgatcatactactcacttctgcaccttttcatttaatgataaaaatttgagatcattctataccattctataccagcatatacctcatgctttttagtgaacactat

SEQ ID NO: 15476 - DNA, 25419 bp, Human
acatgttggaggacccagactctcccagccccgggctcgcactgtgaaatgacaaacctcacccagcctactggggggcactcctgatcgggacttgctgatgtggccctgggacatgggcaggctggagcaggacagccaccttcgtgtctggggtgtgtggtgagggtgcatgggaccagatataccagtcccctctggtcccaaatggagggcagagatggaagtaggactaggggtggctaagaggagtggggccatggagtatgggatgtgcctttcaccagctgtgtgactttgagaagctcacataacctctcagagcctcagtttccccatctgtaaaatggggagcacaatctctccctctgggctcatgatgagtttccaggaataccacctagtaggccctcattcccaggagcctcctcatgcctacatcttggaggaggttctcaagatgtctccagagcgaaggaagaattggctcagccttactgagcatctgggcctggcatggcaggtggttgggggtggggggagtcacttggttccctacattgatgtcagcgcctcctgggaaatcgccttctcacctctcctgggcctaaaatagagcggggggtgggggtgtcacaagctagaggcagttccctcatccccagcagaggccctgggtccttgcggaagcagaggacccaggaaggggtttcctgcctccaatcttgttcttcagcaacctgtggtcccctagcatgggtaccaaaaaggtcagggtggggactcagcggcccacccaccatgccctaccacaccccacaccatctcaggtatctggccttcagcacccctagcagaagtctgaggtcccagccctggtattgggacccaacatccccaggagctgggtggagggcacagctgggaatgtaggttgggaggtcaagtattttgcagacagggcagcctagtctgaccagagagggaatgctggggggctccagaggtgtcttctgctcctaaggattgggactagcaagggagggggagccatggggcatgctagcagcatataagtgacctggctagtttatattttatctaggaggaaggacaggacgcctgtgagagactcaggaacccagacggacatgccagcccttcctgatggttggagtgacagcgatccctgaagccctcctggaggccggggcatctttggcggggagaaggagccgatgggaaggggtctgtaccgcgggcgtgagaggactccgcagtgacacgacccgtagcgaaggtgcaagaaatcccagaggcgtagagcccggcgttcgccaagagcctctgcccaccccaaccccagcttccacagcctggggtcaagcggggcgctccaagctggggctggggcagcctctctggggtaccacgacagaggggcgaacgtgggcgccgcagccacgcccctgcccccgggccccagacaggcagtcgccgggtcgaccccgggggtaccccgtcccctgcttccctcccctacaaatctacgagtcctcggagatgctcaggcagaggtggccgaggagaggccgcgggataagtacgcggagcgccaccgccccgcacctgccgaggagacttcgaggtgcgaggagggaccccggggcggcgcctcttttgtcctgccgcggcggcggcccgggccctgcggggctgggggggccggggggcggcgggagagcggagggcgggccctgggctcacgtgctcgctgctcagctcttaaacccggccccgccgccccgccgggatggccgcggccggagcgcgctgagccccggcgccgtccctgccgcccccacctctccgcgacccccgcccggccccgcgcccccgccccggctccgcagctggcgcctccccacccccgtccctgctcccgccctccccgcgccgctggcagccgcagcccccggaccgggaggaatgagcgagccatgaggctgctgcggcgctgggcgttcgcggctctgctgctgtcgctgctccccacgcccggtgagtgacccccgcccggccccggcgccccctccctgcccccgccccgggatgtgcggcgcttgctgctgcagccaccttttcctgcagtgctcggggtgacagccggtccggagcgcgggagggtaggggagcgggagaggagggaaggtgcgtccacccacctgtccccagctggccgggcccaccgcgtccctgcccctgccgccgaccggccagctctgcaggtctctgcgggtttgggcggatgggggggcagtcgtgacggttgggcgggagtgaagctcctggccccctccccgcgggctcttgcctctgcagggcagccagatcctcccacccggatcgccctagggctccaggggccacaccagagtgggggatgaggcatgcccaccccattcccaagtcttctgccccagggtgggcagctgcctgcagccatggccttgtttccccaggtcttgggacccaaggtcctgctggagctctgcgatgggggggcttaccccagctgggaggcccaggagcccctgaggtcacggaacccagccgtctggttagggagagctccgggggagaggtccgaaagcagcagctggacacaagggtccgccaggagccaccagggggcccggtgagtggggctgggtggtgaggccaggggctgaagcaggcctcagagccccaggaagcccacggggtaaccagggttggagtccccctcagcagctgccccgcagggtccccttctgtacagtgggctatccggtgggtgctggagcccactggtggggagcaccaggcctgcccagccccagggccccctcccattattgtagggtcccctgtcctcagtgtacagggaccactaatgcctaggtctcaggtctgctttgggtcagccttccaatggccccctgctctgctctggccaaagctagttgttctgttcaaaacagggcttggatggggcaagttgggggcagggagaggcagcccagattccagtcagggattagggctctcaggttctcaccacagccaccttagtgggctttcttggaacaacttagtgcttgctcctgcctcagtttccacacagtgcccagataggcttgttgttcttcctgtcctggctgaaggtggggccttggaaaataacttgaggccccaagccagctctacctgcctgcccactgtccctttcagctgccaggcccctcctgcctcccagaggaaggttaggcatgaaggagattaattgcaattaataattaattaatatcatgtgaataataatcacccagatggaatattcattcagcacaccccagcgctccaagagctggagctgaaagtgagccaggccaacagggcagcagagggcaggttggctggcaaaggcccggcacaaacaggaggtataggggggagacccagaagaggggtacaactgaggcctgggaagttttggcagcggggagtggtgggaggtaaattgggctgggcagagggaggaaggagggaaacggaggctaacattacggacatctgtcagactggcatctggccctgcctaatgtacttggttaaaagcccttaagggaggggagcagagggggatgcggggtggtgcaggggtggagaatactgatgaaatggatggagcaggaagggagcatgcataatagatggaccatcactcagggccgtgcagaggggcagggggagggggctaatggtccaaggcccgcagtcactgggggtggggtggggggtggaagctgccttcagcaactgcccaggctccctgggaggtgtgcagtcctagggccggggatggggtgtcctggccgctgagtctggctgtcttgcctggtgtcactccctacctgtgaactgtgcaccccgtggttacactgtgggggaactgatggtctgcccgactgctgggactctggcttatgctttaagggatgtgcagattgagtcatggagggatgtcaccgcagggaaaggggacagagttgaggaaaagcctggagtcaggtagggatgaaaagtcaggtattccaactgggcaggttgctccttcagcctgaccctttccgaacagagacagaggtggcaaagggtaggaggttctgggctgtggtggtgtctgcagctgcgtgggaaggtcaggatgggtgcagttgaactgcttgggttgggggtctctgtgttgttctgcaggtgagtgagtgcatgtgaggtgtgtatgtgatccaccgattccagatacttctgaggggtgtctgagagcctgcggggagggaatggagttccatggatctgccgggcagtgattatctccaattttggggtctctctgagactgagacttcctagggccctcatggcgacctcctcaagggacttgtttggggccctctcttatctgtgcctcagtttcccctgaggtaccaaagctgtggacttctatgggccactctgccaagctttgtatgcactctacatcacttatttctcacaactctgtaaggcttgtaacttttgtgtgtttatgtgtgtgtgtgatggagttttgctcttgttgcccaggctggagtgcaatggcgtgatctctgctcaccctaacctccacctcccgggttcaagcaattctactgcctcagcctcccgagtagctgggattacagacgtgcgccaccatgcctggctaattttttgtatttttagtagagatggggtttctccatgttgctcaggctggtctcgaacttccgacctcaggtgatctgcccacctcggcctcccaaagtgctgggattacaagcgtgagccactgcgcctggcagcttgtaacttttgtcagccccattttacagatgagcaaactgaggctcagagggatgaagtaaattgcccaaagtcaatcagatcttaagcagtggaggtgggagttttctccacaccagggcacttcccagttctgcctccagggctctctggatttgggtccaggaggcagtctcccaactctgcccagagcaaggagacaaaaagacacatccagaatattttccccaacggtaaggagatatggcaaaccctcaatctcctgcctggcatttctccctggggttagagcgcttttggcctcagagccatggggtctgatggtggatccagtgtggacttgagcccgtgtgtgtcctagccagaagtaccccagctgggcattgcttggtttttgccttaacttactgccctggtttggaacttcaagcctagccggtgtggagctggcagcaagatctctggtcatgtgtcgagtccaggggcacatgctggctggcagggcctggggcgctgagctgctgtggctttgggcaggtcgtttgacttttctgagccccagtttcctgttccctaaaatcaggatggtaacatatctcagtcccacctactaccaggaggtggtgatgggaaagagctttacgtgctgaggattcctggcttgacaggggcaagggtgggggtgcgactgggacaggggaagagatatagcggccaagaaggaattagaagctggagaaattagactgggtgcattggctcacagtggccaaggtcaggggattgcttgagaccaggagtttgagactagcctgggcaccatagtgagactcccgtctctaccaaaaaaaaaaaaaaaaattacccaagcatggtgctgcgcacctgtagtcccagctacttgggaggctgaggctgcaggatcgcttgagtccaagagttcaaggctgcagtgagctatggttgcaccactgcactccaacctaggctacagagtgagatcctgtctcacacaatacaacaacaacaacaaaagaacaaggtagagaaattacaattatttactaggcctttttggggcaggcactcctttacgtggaattatttaatcttcatcacagctcccagaggtggggctgttattcccatctcgcagatggagaaacaggcacagagaggcaacgtaactgccccaagtgacacagcacttgagcacagagtcaagactgatcctcaaagcagggctctcacccagcacgctgccacctcttgctcagggctgaagggaaaagagacacagatgcacccttgccctctctttgctactgcactcaaccccctcacttctgtccagcctggaagcaggctaggcctgaggcccagagaagtgagggagcttctgggagtgcagaaacctgtggttccagggagcctgcagccgaggggtggtgcaggtcaggcaagactaccgtgtccagttgggctggttgttcactccactagggtgactgggcaagcagtaagtgagctgaatgcaatctgtgggcttatggggccacatgcgttctgacttgcagggggatcttgttttctttctttttttttttttaagacagagtctcactctgtcacccaggctggagtgcagcagcatgatctcggctcactgcagcctctgcctcccgggttcaagtgattcttgtgcctcagcctcccgagtagctgggattacaggcgtgcaccaccacttccagctaatttttgtatttttagtagagatggggtttcaccatgctggccaaactggtctcgaactcctgatctcaagtgatccacccgccttggcctcccaaagtgctggaattacaggtgtgagccacctcacccggtcttgggacccctttttctaatttgcaccaagctgctgtatgggttatgcctgcccctggggagacccagactccttgggaacaaggagagggcaggacatggggaggtgactagggtcaggggtgaggaggtcgcagacctggtacatagaagctcatctgagccagctaggggaggggtgcctcagtctctgggctaagctcttgtgagagatgcccaggccagcatttactggaagcaccaccccagaagccctccacggtgggtgtgtgctgcaacagtgtttgtgttttcgtcctgcagaaaggcggagggcagttgagtaaggctcacccccagctcttgaagatgggagtcatggacatggtgccacaggggggccagggtctgtgcctggggccctggtaccccactagagccaaggccatgctatagtctgtgtggctgaagttgcggctctctcctgggttggggcagatggctagaagccagggctaggattttgctgggcccagcttgttcccaggggtgaggtgggggcatgaactgagctctgccatgccagagagttcagcaggcttagttttggtgtgagaggctgcacgctgtggctttgaggtggcacagccttagtgcaggtcctgctcccctgcttctgactgtgtgacctgagccagtcatgcagccccctgaacaccaccttcctcattcataaaatggggatgctcatagtctccacctctcaggctgctgcgaggacttgagatgatgaatgtcaggtgtccagcccaagatctggcagaagagccgatggtcaacatctctgagtgtccggacagggtgctgggccctggtgctggcatgagggctgggtgtcagaaacaggagccaggatatttaggggttacttgtcaggctcggggtggggtccaggggagaaaccacatgagcaggactctggcctgtgggcttggcctcacccaagcaacctcctggctgcctagaggaacccagctgtccagagtctgtccccagagggactgatgaccctgtaaaaggaggtggctctgttctcaaaaatgtaggtcaaatcccatcattggaaatttgtctggctgttctcattgcctgggaatcccgctgccctcttgataaatggagcacccaacacattgccgggggtgggtggggggagctggcaggtgggtgggtgggtggggggtttctcccagctgggacatactcccaggtggagctcctgcctctctggctcctccccactctgcagccacctggcccacaaggtggtggtgtctccttgcgggaggggattccagaaagatgtcctcaggtgagacacctgacaggtaaatcacaccatccacccagatctggagcataaggctaccattctggcatgtccctgtcacagtaggtgatccaaaggagtcgtttatgcagttcctcaaagccctgttcagctggaacatttacacttccttctcgttattattattattgacccttatgataccacatttaaaagggcttttatttaatcctcacagcaatcctggtttttcttttcttttctctttttttttttttttttttttttttgtagagacagagtgttttgctgtgttgcccaggctggagtgcagtggcacgatcttggctcactgcaacctccgcctcccgggttcaagcaattcccctgcctcagcctctcgagtaactgggattacaggcacatgccaccacacccggctaatttcttttttgtttgagtagagacagggtttcaccatgttacccaggctggtctcaaactcctgagctcaggcaatccgcccaccttggcctcctaggattacaggcgtaagccactgctcctggcccaacaattctgttttaccgaggggaaaactgaggccgggggcatgaagcagcttatctcaggccttgcgatacatttccattcaacgtgagtgttgagctcgtgggcagggaaaaaaagcaggcatcgcccttgctccagggaactaaaggtcgcccacctgaaaagccaaatcagtgatcaaagaagtgtatgtctactgtgtgcttaaaggcccagaggtggagggcgccagagccctgcatgggttggcaggtgcaggctgtgcagatgagggtggggaggagagggaggtccgggcaggagttccgggtcagcgtgtgaagggccgtgtctggaagtggtggggagcaatggtctcccttctcgaatttcctggagaatttgagaatcctaaggctccttagtctctcccttcctaagactgtgtgtctgtaggtctggggcagagcccaggcacctgtatttgtgcttctgggtctttggcagaatctttgcctttttctgtctgcaccccgcatctggtacagagaggacaaggcacagtcgctctgaagcagatgtctaggagagtgggtgggccagccagagaggagcctcgggtggaaggggtggtcacccctgccaggcagtcacagctgctgtggcgacacgaactccagccccagggtgagatccagccccacacctccccagccacccagccatgaccctgggccagtcacctccaggtgtctccctgagcctcatcctggcatttgtaaaatgaggaccagacagcctgggcacgttgagatcaaatgagctggagcatgtgagagcctgggcagccgggggagcaagagacaagtgcagggcacagggtcagctgagggctggcatgacctcaagaccaaaggcccctcccaccagggatggagggacaatgggatgaggtcagaggcagggcaggggcagaaagcagggccaggcagggagcacagtttggctttgatagagcactggcttaggctggacatggaggctcaagtctgtaatcctagcactttgggaggctgaggcgggaggatggtctgagcccaggagttcaagatcagcctgggcaacacagtgagatcccatctcttaaaaaattaattaattaattttaaaaaaagaacattcgctgggcatggtggctcacatttgcaatcccagcactttgggatgccaagggtggatcacaaggtcaggagttcaagacaagcctggccaagatggtgaaaccctgtctctactaaaaatacaaaaaaattagccgggcgtggtggtaggcacctacaatcccagctcctcgggaggctgaggcagagaattgcttgaactcaggaggcagaggttgcagtgagctgagattgcaccactgcactacagcctgggtgatagagtgagactccatctcaaaaaaaaaaaaaaaaaaaaaaagaacattggcctaatgctgggcgggcttggggcggtcttgggactctgtgccagcaggagtcccctccccactccccaggtgccagggccacagagattctggggactgagataggtttgtgtgacccatctcttccctcagaccagggacagggttgtgtccccgcatggggccaggccaggcaaacaccccttggtatgtggtctctttctttctcctaccgcctttgggggctctcccagccccctcctgggccacctccagccaggcccagcccccagccccagctgccccggcactgccccaggggcttatctggtctgagccctgtgtcctgctgggctcagctgcaccagatggggaagtggtgagagctcagcaggtggcaggaggtggtggacaaggaggctcttaaggtatctggccttcatcccccatcagctggggctttccccagagtggggactggcttggcctctgcagagaggaagcaggcttgatggggtggctcgcagacctcctgagtgagggagattctgttggtgccagggcagactctgctggaatctccaggcccaggatggtaccaatacgtagccaacctcctggcctcgcatctgggctcatctgaccattttcagtgggaaaatctgaggcacagagaggttgctgggtcatccctggggctgcacggtcagagagcagcattggggcaaggggtctggcaggctgctcctctaggcagctgtggagggggctggcataggggcttgttggtgggaggcagatagaacaagcaggaacagtcccaggggcaggggaaggccaggatggttcaggccatgggccgggaagaggatgtggcgactccttgtccttgactttctatttcgggctgatcaatgctctaggggctcaggatggaattgggagccttggtcagcctggaatagggtgagtcggtgtccttggggcgcaaaggtcagcccacccaggccctggccgttggtgccccccttgctcctctcccaggacctctcatggacactgggccctcttccattttactccacctttggggtgagacagccctagaagcagactccctagcttcaccactttttagctgtgtgaccttgggcaagttagtcagccccactgtgcctgtctcctttcagatgggaatggcagtaatctatcccatagggttgctgcgaagatcaaacagggcaatactcttagtgtttagaccagggcccggcacacaagaagtgctcggtaaagattagcagtgatgaggtggttgaggaggaagccgacaaggcacaggctatggatttcatgaccacaaccttggggctctcttccttcctgcaacctgccgtccccaccacaaaggccaggcagcgaacaaaagcctcccatttgcagggcagagtgggtgaccctcatgttggggtctggagtcagtcttctggaatgaacaaggggtgtggagaaggccccagccctgagtcctctcagcccttcctgggccctgcggttgctgtgatccaggcgtcctcaagcgcccaggcctggggggccgccatcttgctctggcgtggtgtgttgctgtggcaacctggagcctccagccccactgcactctgaaaaatttatcaggaaaacttccatgtttaaaaattaaccatgggattgaaatattaaagatgagctgctttgggtgaggcagagggcaatggatttgggggtagaggagccaagtccttactcccaacaggatggcacctgcccgtcgcccagtttccaggggcctagccatccattcccacccattcgcccctgtccgaggcctcctatgtagatggaggctggggccagggtagggggacaggcagcgagggtcctgcctcccatttcctgtttgtccctttcccatgatactcctggggccctcccgttactctgcctgatggtggggtgcccctcaccagccaggagggcataatgaggcagagggctggccgggctgcccctctccatcccagctgcacctgcagcccagccccagagaggatgcacaggtgcccgggcccagagggcagaaagggggctgtgcccagggctgagcactcctgcctctgcccactagtaaaggagcagggtcgtggaggaagaggagcttggacaaagcatcttgcccccaaatcaatggtcccctcagctgctagggctggccaccccttccccagggctactgttgctcccgggatccccccgactcccaccttcaggcctccctgggttgactccccctctgccctccccccacccagcctgtccatctggcccaggtgagtttcgtcatcccagccttcaactcaaacttcaccctggacctggagctgaaccagtgagtgtggccttgagcccaagaggaagggcagtggtggggcgggggagacatggctagggcctggctgctgggggtctgggggttgggcctgggcagaggggacctgggtcctgacctgaggcgagcctcaagcccgacctcacctcgcccgtgaccccccttcctgctgccccctctgtctcagccacctcctctcctcgcaatacgtggagcgccacttcagccgggaggggacaacccagcacagcaccgtgagtgccactgcaggggaccggggccggggatggaagggaggtgctgtttctgtggttctgtggtcacaggtgtagggacaggtggccactggagatggggtcctgggcctggcccctcagcaccttccctctctcccgacccaggaggctctgagggtggacagtgggcagcttgagtgcatagggccctgaagtcccctcacttggccccagagctctgacccccagccagcccacgtggggcctacagggacactcgttccgagcaggctgccaggaatccccctctccagactcttctgagagggacagctgaggaaaggcccttcttactcaatatcaaggccccgaaaatcccagctgcctgggacactagggtcccagccctgaaggctctagagcctgaaaatgaatgagtgtctataaatagcctgtctcccccccccccgcccccactgcctgttcagtaactggagcacaagtaattctgcaggaggcagagctggagcgggagggtgccactggtccccccagccccaacccatgagtctggccaggaggacacatgctgcccatcactcctcagccaaccacaggcccaggggtgtcctgggaggcagtgcatgaggttgtgtgtgatgttaggggcgagtacatgattaaatgaggtaatatatggttagtgccagagcagtgctgggtacatggtaggtgctaaataaatgttgcctgttattctcaaaggagtctgatcccttccccagccccagcaaatggctaagaacccttgctgtacgctgggctcctataatcccatcactgggaggctgaggtgggcggatcacgtgaggtcaggagtttgagatcagcctggccaacatggtgaaacaccatctctactaaaaatacaaaattaaccaggcatggtggtgcatgcctgtaatcccagctacttgggaggctgaggcagaagaattgtttgaacccgggaggcggaggttgcagtgagctgagatcatgccattgctctccagcctgggcaacaagagcgaaactccgtctcaaaaaataaataaataaataaatacaaaaattagctatgtgtggtggcacatgcctgtaatcccagctactcgggaggctgaggctaaggcatgagaatggcttgaacccaggaggcagagggtgcagtgagccaagatcacaccactgcactccagcttgagcgacagcaagaccctgtctcaaaaaaaaaaaaaaaaaaccattgctacagtccagcttcctcattttatagatgacgtgaaggaggcccagaggttcctaaccccagagggctaggaacttgcccagggtggcacggcaaattaggagcaccagccatctagaaacaggctccagagccccaggcatacccagggattgtggccacctgcacacagggcagcttcagtgtcccccaaaaagccttgaggcccattggctgcccccggcctcatgccagcgttctgctcactgttctgctccttcagggggctggagaccactgctactaccaggggaagctccgggggaacccgcactccttcgccgccctctccacctgccaggggctgcagtgagtatggggaggggccgggcagctgggagaagcctctggcccaggcctggggacggaggggagctgcgcctctctctccacagtggggtcttctctgatgggaacttgacttacatcgtggagccccaagaggtggctggaccttggggagcccctcaggtaagccccacacaaccccttgccatcctctctggtggccctgccaagcttgtcccaacagctgttgctgccacctcttcctcctccggctcctccctcagtaaccccagcctcactgccctcttcagtgaccccagctctggttccctccctcctgtgccccagctccccctgtgcccccagctccaatgtcccatctgtcccataagtgacctcccattgggctccaatgtcctttgcccctgtctctcagggtgcccccaggtcttgaccccggaatctgagcatctgggagatcagatccgacatgggagctgtggccagttctgggtcaccccagggtggggtggaggcgagggctggatctggcccccgccaagtgggcctggagcaggcccagttggcaccccaagaactaatttcccctcattgcagggaccccttccccacctcatttaccggacccctctcctcccagatcccctcggatgcagggaaccaggtaagggagggaagggggggtggggaggggccggctgtgcccccctcacctgcccctccccacaggctgcctgtttgctgtgcctgcccagtcggctcctccaaaccggccgaggctgagaaggaaaaggcaggtacgggggcccgcacagacctcgggctgcagagacctcgggctgcagagagacctcaggccgtggcccagagcaggagggcaccctcatctatggctggggcgaaggaaggctcagatggatgtggctgggggccagggaccgtgtctgggagaagcccccaccccttccctaatgctggcatctacagaggccccatcctgggcaaaccgaggctgcctgccctcattccaaagctgaggaaggacaggaccctctgccagtggggagctggcactgtccctggctggagtccagacccccccatccccaccgagtctgttcctggcttggccatgagatcagtcagacatggaagggactgattccaagtgcccacccaccccccaggtccgccggggccaccctacagtgcacagtgaaaccaagtatgtggagctaattgtgatcaacgaccaccagctggtgagtgccagggcagggacagggcgtgacactgggaggcccctgaggagcctggccctcctcccattcttctctctcccagttcgagcagatgcgacagtcggtggtcctcaccagcaactttgccaagtccgtggtgaacctggccgatgtggtaagcagctctccctccctcccttccctcctcctcatgccccccaccccaccacacacattagggggcactgtcagcccctggctcccacttcctggagagaacagacaggccctcctccagccctggccccaacacccactcccaccctccagccccctcatcttctccccagatatacaaggagcagctcaacactcgcatcgtcctggttgccatggaaacatgggcagatggggacaagatccaggtgcaggatgacctcctggagaccctggcccggctcatggtctaccgacgggagggtctgcctgagcccagtgatgccacccacctcttctcgtgagtcccccaccctgcacctcctgccagcctctgctagttgctacagtgcttgggattacttaacacctgccctgtgctggctgctcctctcagagtctggggactgggctcaccttgcacctgccacctacccccagccacatgcaacagctgggcatcatcccctgaatctgaggttgatgcccttgtcttagccctggtggtcctcttctgcctctcacctccccttagttctgtctttcccctttcaaactgtcccagcatcccttcctcagggacccagtgccctagtagggaaaaaaatctaataaaagggccttgcaactagagatggtctactgggagcctctcctttgccttatgggcaaaagagcccaaggaggggccaggcgtggtggctcatgcctgtaatctcagcactttgggaggccaaggcgggtagatcatttcaggttacgagtttaagaccagcctggccaacatggtgaaaccccatctcaaaatacaaaaattagccaggcgtggtggtgtgcacctgtagtcccagctactcgggaggctgaggcaggagaatcgtttgaacccaggaggtggagattgcagtgagctgagatggtgccactgcactccaacctggaccacaagagtgaaactctgtctcaaaagaaaaaagaaaaaaagaaagaaaaaaaagaacccaaggagggggggaagggtcttgcctggggtcaccaaggctgatgtaaagggccaggctcacctcctgaggaaggactctagtgtgaggggctccccaaggccccaccaccacccggggagccacaggggagggcaggaggccatcctgacagcgcactcccttccaggggcaggaccttccagagcacgagcagcggggcagcctacgtggggggcatatgctccctgtcccacggcgggggtgtgaacgaggtgagcagtggggggacatggctggggtggcggctgagggaaaggggcttcaggggcacgacgtgcctgttggaagatgtagacatctgtgccccatcttccccacccccagtacggcaacatgggggcgatggccgtgacccttgcccagacgctgggacagaacctgggcatgatgtggaacaaacaccggagctcggcaggtatcctcccccagaggcccccgtgtggcccacgcccagcagctctggaacgggagggtgacagtgggaggggtggtccttggcctccctcatatccgcctggctcacccctcaggggactgcaagtgtccagacatctggctgggctgcatcatggaggacactgggtgagttcttggggacaaaccgggggaaggtcttgggcgaggggagtcttagagcgagcattgtttggcagtctggaccagggggctcaagaggcccagctcacagaaccactcaggatcccaagaagcccagttttccgcaaacactgccccgggagacccagatttccctgctgggacaccaaaaccggccaggctgcagtgcgcatcgtggccactgggcgccgcccaagcctcgcatggagacaccttccctccagcgcggctgcgagtccccaggttcagcggaggggatgggagcgacagggacaggcgggaggattctggtgcaatcccggggcagatcctccgcctcctcgcgatggtgacgaagtcccccagtgtaccccctccccagccttgagaggggtgagggtgggttggaggggagcagccagcagcacctcccctcgccctatccaggttctacctgccccgcaagttctctcgctgcagcatcgacgagtacaaccagtttctgcaggagggtggtggcagctgcctcttcaacaagcccctcaaggtaccagccccgcggcggggagcatgggagcgggccctgggcggggtccgggccagactcccgacctgtcctcccggtccagctcctggaccccccagagtgcgggaacggcttcgtggaggcaggggaggagtgcgactgcggctcggtgcaggtgagcggtggtgcgggcgccaggtggggaaccgggatgcgggggtgggcacgagggagcgtctgagtgggaggattagggctcgcccgcctccttcccctcctcccgcgtccctcaggagtgcagccgcgcaggtggcaactgctgcaagaaatgcaccctgactcacgacgccatgtgcagcgacgggctctgctgtcgccgctgcaaggtaagcaggaccggccgggaggcggggccaggacgcaggaggagcgattggaggccttcatataaggggtgggagctagggagggaagcggagccttcggggacgaaggcctctggggcagggcttgatgcgaagacagcgccaatggggagcaaggggcggggctgaaggatgttgaaggcggggctacgaggagcgggaagggaaggctgcccagaatcaaggaggggcgggaaggtgggcgggcttgggggcggtgctgagtgcgctgggagcgaggtggggagcgttcaagaggtggtgggagcagggaaataagaacaggcctgaaacggggccctggggagctggagggcccggggatgtgggggtccagagagcgaggggcctggggagggcagggccgaggcatccatcctgcctgactcgaggagcgcgtctcttccctagtacgaaccacggggtgtgtcctgccgagaggccgtgaacgagtgcgacatcgcggagacctgcaccggggactctagccaggtccgcccggccccgccgtcttgtggagccctgggcgaggcaacccctacccttgtcgatttggttttcccggacgagtgctcagcactcccctcctctccacagctggcatcgacctccactgatcagactgttttcttatctgagaaaggggttcttcatgctcctggccttgttccttcaatcattaaaccagaatgtatcgtctggctggtattcccagcgcctggcccggtgcctggtgtaggttagggatcagagtagacgataatattagttaacatctattacaacctaattacatgccaggcatttatctcccagccctacgagggagggaggctggagcggctctggggcttgcaaatccgtgtggtctgggtccagaaccagacagatcgcttgtcctaggcgtggaagagccctgtggcatgagcccccaatggggggcacttggtaccccagcattcctccctggggcagccctcagctccagtcctgggactgctccgctcaaccccacccctctctccacagtgcccgcctaacctgcacaagctggacggttactactgtgaccatgagcaggtatgatggctgccccctgagcctgggattcagggcagtctcttgtctccactctgaccactcagcatctccatcccttgcctcttaattcttggactctcagggccgctgctacggaggtcgctgcaaaacccgggaccggcagtgccaggttctttggggccatggtgagtctggctagggctgggagtggggactccggaggacccagagctgagaagctggggagagtgggttccagctgaacaggcccccaagtgtgtagctccccaggatctcagggacccaggcagagtgtgggagatgcaggcctgaggtcttggggtgggtcctggggcgcgtggggtcacttggcatcctctccccacagcggctgctgatcgcttctgctacgagaagctgaatgtggaggggacggagcgtgggagctgtgggcgcaagggatccggctgggtccagtgcagtaagcagtgagtactgaggctcccagagggcctctcagctccagggcaggtgtgagacttttcagagatggggcagcaggttctcccaggaggagcctgtcagtcccaatgggcgggcacgtggcaaatgaggtggcagggtgcagggtgagggcagattagagttcagtagttgagtctgaggtcaaacttggggctcactgtctctatatgccccaacagggacgtgctgtgtggcttcctcctctgtgtcaacatctctggagctcctcggctaggggacctggtgggagacatcagtagtgtcaccttctaccaccagggcaaggagctggactgcaggtgctggccaggaccaagactagggaggggaggttgcagctgtgctgggggttaggagacagggggctgaggctggctgtgtcacttccccaggggaggccacgtgcagctggcggacggctctgacctgagctatgtggaggatggcacagcctgcgggcctaacatgttgtgcctggaccatcgctgcctgccagcttctgccttcaacttcagcacctgccccggcagtggggagcgccggatttgctcccaccacggggtgactgcctggagcccgggatggcgggagaagcttacaagaggggacaggcccctgctcacctctcctggccctgccctgcctctaggtctgcagcaatgaagggaagtgcatctgtcagccagactggacaggcaaagactgcagtatccataaccccctgcccacgtccccacccacgggggagacggagagatataaaggtgaggctggagctggccgaggggggtctgtctgtcccgctctctatgcctgtccttgccagctaagccctgccatcctccccaggtcccagcggcaccaacatcatcattggctccattgctggggctgtcctggttgcagccatcgtcctgggcggcacgggctggggatttaagtaagagacacacacaccctgtgccccctggcatccttgaggggggatcagaatccctactggtggagctgagggggccctccctgaaagcccaactgaaccagagctcacacgtcataggtccaagtagcctgcagggcttaacatttagaaactaggagattttaggctagatgaggtggctcacgcctgtaatcccagcactttgggaggccaaggcaggcggatcacctgaggtcaggaattcaagaccagtctggccaacatggtgaaaccccgtctctattaaaaatacaaaaattagccagccatggtggtgcgcacctgtaatcccagctacttgcgaggctgaggcagagaattgcttgaacccgggaggtggaggttgcagtgagctgagatcgcaccattgcactccagcctgggtgacagagcaagactgcgtcaaaaaaaaaaaaaaaaaaaaaaaaaaggaaagaaagagagaaagaaaagaaaagagaaaagaaatcaggagattttacactagcaattcggatttccagctctggaaacatgaaaaggttgagccccagcgtgcctctaagcatccccaaatagccacagagtggagctgggcaggggccacccaagccaggcatgtgtcctccagtctccagtccccacccagcctataatgctttgtgcgtgtctaagtttggggtccttgtgctggtctaacccccttaatgtgcagaggaggaacccacggcccaaggtcacatgattgagttagtagcagagtcagagctggaaccgggacgcatttttgtgggtgccctgggtaattctccctggcccttacattagtgtccaggccccggggaccccggccccgctctggggcaaggggtcgcatggcagccaaaggcccctccctgagagaagcaaaaggtcagatgtctccttttcctctccccttccaccatcctccccctgcagaaacattcgccgaggaaggtacgacccgacccagcagggggcagtgtgatgccggccacgtcatccctcccgctgtccttgtctcctccatctcattcgtcaccccgcgttctgttgatggggagcgggggctgattcccccacccctgctgccaggctgtcccggcaggggtgggagagcctcgctcagggaagaaggtcccagctgccctcgccctcgcccgctcaggccacgtccttctcgactgccctgctgcggccaggccctcccctgccaccaggtggaactggagctgcgcccctggcagtccccatccccgggagggccctccctgtgcgtcccatctgttttgtcttccatatcaccactgtctgacctcccgcagatcccttccctggccagcctgtgacttgccgcctgcctccagggcccagcactgagctccggggccctgctggggggctctccccgtggcccctgctcacgtcctcccctgatgccccctctccgttccaggtccggaggggcctaagtgccaccctcctccctccaagcctggcacccaccgtctcggccctgaaccacgaggctgcccccatccagccacggagggaggcaccatgcaaatgtcttccaggtccaaacccttcaactcctggctccgcaggggtttgggtgggggctgtggccctgcccttggcaccaccagggtggaccaggcctggagggcacttcctccacagtcccccacccacctcctgcggctcagccttgcacacccactgccccgtgtgaatgtagcttccacctcatggattgccacagctcaactcgggggcgcctggagggatgcccccaggcagccaccagtggacctagcctggatggcccctccttgcaaccaggcagctgagaccagggtcttacctctctgggacctagggggacggggctgacatctacattttttaaaactgaatcttaatcgatgaatgtaaactcgggggtgctggggccagggcagatgtggggatgttttgacatttacaggagggcccggagaaactgaggtatggccatgccctagaccctccccaaggatgaccacacccgaagtcctgtcactgagcacagtcaggggctgggcatcccagcttgcccccgcttagccccgctgagcttggaggaagtatgagtgctgattcaaaccaaagctgcctgtgccatgcccaaggcctaggttatgggtacggcaaccacatgtcccagatcgtctccaattcgaaaacaaccgtcctgctgtccctgtcaggacacatggattttggcagggcgggggggggttctagaaaatatagttcctataataaaatggcaccttccccctttcaagaagggtgattctggggccgactcagggtttaggtgccccctggtgtggcctagatgtccccacctgggccatctttctggggaggactctcccaggtagggaaggccagaggtggcccagtgcctggagggttagggtctctgcctgggatatgcaagaggaagtaggaaagggaggtctcatggatgatcctaggctgctagaagtccttaaggccccatctagtccattccactccctacccccattccagagccgagtagtaagtttacagatgtttcccccattacgtacccccacccatccctgctgcagcgagcctgagagccaggtagagccaggcacagctcctcagtcttctcacacagtcctgccggtggccttccctcatgacccttgcttgggagggtggagcactggctccttgaccctaaaaggtagctggcaggggcaagatgggggccagctacctaatggatgaaagccacaagtgaatacagttcttgtcaccagggttgccctgccctcactcggcagggagttctgacaccccagggcccgtgagctacctgcttgagcccctgtttctggggcaccttcgaggaggcgttgtggagggcatcgccccctgtttattcacaacaccctcaggggcaaacaggcctgggacccgctgacaccattttgggtagctggatgcacccgacagcagtggggtccacacactgagctccagctggcactgcccactcaagggctgagtggaggggcccctccggccagctctgctccaccagccctgcaagctgatgcagggcgggggaagggctgggtgttgcactattgctgcgctgccttaaggcatctgtcctctggtggtgcacccgtgcacacaggtacagtgcatctgggcacagcttttggatccacacctctgcacaagtgtgaatacctctgcacatatgggcgtatctgtgtgtgctcgtgtatatggggtggggaacatgagacttcctgtgaccagtccaccctggctcccagctgtctgtatcctcctgccccgccctggcgagtgcctaccctggcagaacccagggaggagtggaggctgcctctgcctgggcctccacacagcatcctgtacatacgccacctgggctgggggtggggaggcagggccaggagcatcgattaaagatcacatcctggggcttccagggagctcacaccaaccttgcgtttctctcctgtctgtgaatggccatgctgtgacttgtcccctctggctcaggagggagcatgataactggggtgctggaggcgggaagggagcgcccaggaccagctccattcatggtgaggaaacagggtggaggcctggccctcccgcttccgcttcctcgcttcctcggctcttccaacaaagacagttgtgcccctcctctggctccagcaaagcaggaggccaggcgagtaggaaagcattttcccaaaagtctggagacccaacttcccttttatggctgaagccaaagaagcctctcctcacctcccaaaagattccagaacgctggacaaaaccattagcctgtctggtcccagggcaccgtgttcctgggctcttttcccacccctgtgctctctggccgagcctggggcaggaggggactgagcaaggctagtgctgggagtccctcccctggctggggctgcgtctgagccaggagcctgtaatgattattcctgtcttcccctgcagagtgcttgggcctggaggtattcgcagacttggggggccgggaggaagaactgggggaggatccatcgggctctggaagtcccgcttgttaagggaaaagataaaagaagcagttgggggcagggaaacaaatgaaaggctagaaaaagatggagaaagaaatagcagcaccaagcaggggcctgggaagaattggcagctagaagctttgggatcatagccccccattcctgaacag

SEQ ID NO: 15477 - DNA, 25419 bp, Human; identical to SEQ ID NO: 15476

SEQ ID NO: 15478 - DNA, 9455 bp, Human
aatttgtttagatgcacataactagacaaggaataagtactgatctttgagtgaaaaaagcaaaaaatagaagtgtgtatagtatactgcaatttatgtttgaaagggatgtatatgatatgtgcatatccacagactatctgaaaaatatgaggaaaaattgttgcttcaaacataagggattttagatactggagaacagaagtaggaggaaaatttactttttactagatatcctttgctactcaataacagtttacacatctgtcacccccactaagagtacaaactccttgatggtaaggcccaccagccatattatattcatcttagtaatccaaaatgggcctagcaactgtttcttcattttttccagggaaaaaatgatttgttagtgtatttagaaaaattgtaaagcttgaattttgtgatagggattcattttaaatattttattaggtgttttattaaccaatccttttgtagcctgtatacactcttggcattaccctggaataggatattgcaaaatcaacgcacattttctaagaagtagaaaactatgatccagaattaagtaaggcaaaagcaaagaaaacaactctcaagaagatggaaattgaattatttacagacagaagtttcttcaaagttttccagaagatacttacattaaaaattgtgagaaatttgccacttctctctctctctctccagcattatgatgacatgtcccttaagattcaaattttcattaagtccctttatacattgtgagcatggagttcgtgtatgcccagcattagaactacagagggcagggagtgggcaggcagaatattgaacagacctaagtgtgtatcacacttgccctctagtgtgcatttgccaacaatgcacttctctgggctgtctggttttaagcctagggcgtttccaaacagaggtcttttcaagctggtttttataaacagataagccccatttatattaattctgtttactgctaatttgtaaagagtgctattaatgggcttagaagcagcgtattcttattaatagttaaacatctccctcttattcatacaactcttgctttgtaaactttctttcacaaaaggacaaagatagactttaatggtccaattaaccaatttctaaactaatgaattcatagtattttaatacaagaaataaaggtgcataattatgatagtgatttttaaaatatttcatactattacatgaagaagcattttctcttcaactcagaagacttctgcaggctttgttcctgtttgctctttacatttacatttatttgtgactacatcaaagcagccctcatctggcagatgaaaaatctctactgtagcataaagcctataaattatcaactgtttccatttagaatataattttggcacttattaacaaagcctaaccaggactgaggtttattctagctcgttttatcattctctgtgcactgcattcgcctcatggtccaagatgtgtggtctgtttccagtaacatatcagcaatccagccagaaggaaggaggaaggggaagacatatccactcctttttaggattcttcctggaaggtacacccatgacaactatacacaattggcaagaatggctgaaatggccctgcctggctgaaatgtcttcattctgggctgctctattcccaggtgaagacgggaaaacagggcaagaaaggcagaatcgatatgggggacaaccagtagtctctcccatagtctatgttcctaccaattgcctttatttgacagattccactattctctattttttgtttgtttgttttctatagaaagtagcattttccttttcatttgacttctatcatgaagttctgatgttaaagactgtttcccttttttttccccattctatctctaaataaactcaagtcacttggccttgcagagtttcaccaagttggtgcattggttcctcccacaggtgatggctgtgctgcctggccctctgcagctgctgggagtgctgcttaccatttccctgagttccatcaggctcattcaggctggtgcctactatgggatcaagccgctgccacctcaaattcctcctcagatgccaccacaaattccacaataccagcccctgggtcagcaagtacctcacatgcctttggccaaagatggccttgccatgggcaaggagatgccccacttgcagtatggcaaagagtatccacacctaccccaatatatgaaggaaattcaaccggcgccaagaatgggcaaggaagccgtacccaagaaaggcaaaggtaacatcatactcccaggctgttataaaacaacagctttccaaatctctaaattatgggatcagagggggaagataaattttagaagctttagttttagaatttgttactggcatttttaaaatgcctactgtgttctaaccatattcttgaaaacttcaagccttaaagacacagataagactaccatttatgttttgctttattattttaactagcatcagatgaaataaaatatattaaatcacaaatagtctatccccttattgtttatttattcaaacattcagcaactatctatagtgagcacctatttgtgtcaggctctgggccagatgctgggagctaaagcagtgaaaaaaaagaaaggtgacaagtcagtcttctgaactaagagagcaatgttgtaaggacctgctgtgttaaaagaaaagtcacaggaaagcattttgcgaactaagtattagacaggtgcaagtgttcttaatactactctaattacatatgtcaatcaatagatcaacagaaggaaactaagagtatagactgcatctagggatgacacctgaaaatctctcctgttgctttcttggcgtatttatttagcaccaacaaaatgcccctcagtgtgacagacacttgacgataaattcatttggtttgtctggagttctcagaaacctagtacttgctgcatcagagcagcaattacctttgaggaagtggagccagtcccactagtccctacaatggcaggaagctccacctctggagaactactggatttggaacttagaggcctagatgcctggatgccagaaatgagagagacctagtcatttgacctttcagagcctatttttcttcatttgtaaaataagattgttgagagaatcagtgacatacatagtaagtaaagtgctgagtaaatgctaaagcaccataggaaattggagttgctacaactgctcattcaacaaatcctcagtaagaacagagtgtgttccaggctctgtgctagacaccagggattcctgattcatctctcctactcttccccaaataactcctcaatacagtaactacacaattcgctggttagaaatagcatgcctgaatagtactataatcatatctattcatgtaaagaaagtattcctgactttcttctctttaggagctagtattatacttagaagattatctcagacatttcttttccttcctttattgaatggcttgccttgcctttggcacttcttgtacttactctgatggatcctcatatctcgaaatgagttctctgtttgtattttattctctgacagtagctcagcaaaaagtacaatggtcaggattaaggtgctactagtgacataagtattatgccaagaagatattgggaccatatatttcatttctccatgttatccattagtcccagcagcatgggagatccagagttgtgttcatctgaaaggcacagcatgttcattataacagcacgtgctgtgtatttcaataacaatttgagaaacggtgacacctttcacatctattctctaatcttgtagtgtggctgtattattcttattcttgctgtacagataggcaagcagagatgctgacagcttaagggacccagtcacaatctcacgccaagaccagaaagataagcagagcttcttgttcctaagtcaagctctcgacttcatccatactgtttatcattctaaaatatcttattcatctctcctacttaaaagccagatttgtatatgagaaattatttgttaaattaatgaactaatatttgaggcttaggaaatcccacagcaccttcaagaaattaagcaaatctactaattctaaaggagagatgtggaaagatgttattgaaccacacaaaaaataactctattctttcctatttcacatcatactgtatttaagcataagaggaaatatcttggccataaattattatatttaaaaactttgccaggcacaggaagaaaaatcctgcatattctctcttaaatgtggaatctaaaacaatcgaactcatagaaacccagaggagaatggtggttaccagaggccttggggtggggcaggagggagagaatggagagatgatgatgaaaggtttaaagcctcagttaggcaggagaaataagttgttttttggatatctattgcatagaatagcgagtatagttaataataatgtattacacacttcaaaatcactgaaagagtaaatttcaaatttctcacgagataaaaataagtatttgaagtgatagatatatttagcttgatttaattattccacattgtattcatgaatcatagtatcactttgtaccccataaataaaatacaactataatttggataacaactccaatattgtttaaaatacacacacacacacacacacacagatagaacaaatgagatgaaaatatatatacatgttaagtggttatctctgagtagtgggcttataggcaaatttgatttttctttatacatctttgaatcttccaaattcactataataaacacaccataatatctccaagttttatacttggaaaaatgtttcttcttcattactttttagcttctttacttaaccaatgttgatacaagcagcttcacatatcagttatcaaaaaaatacctcaaatacataaaaaaaaattgtcagcttgatttttctttcttatttatttatttttttccttttggagatggagtttcgctctttcacccaggctggagtgcagtggtgtgatctcagctcactgcaacctctgcctcccgggttcaagtgattctcctgcctcagcctcccaagtagctgggactacaggcatgtgccaccacacccggctaatttttgtatttttagtagagacgcggtttcactgtgttggccaagctggtctcgaactcctgacttcaggtgatgcatctgcctgggcctcccaaagttgtaggattacaggcacgagccaccatgccaggcctgatttttaaggtctagaagatgagcatattattcctagtcttttctcttgataagtattaggcaaatgtgtcagaactaaataatggttgtcagtacttcattgatgtgagagacaatctactaatcaatctctctctctccccccataccccttctctctcttctcttcccagtagaaataccattagccagtttacgaggggaacaaggtccccgtggagagcctggcccaagaggaccacctgggccccctggtttgccaggtcatgggatacctggaattaaaggaaaaccagggccacagggatatccaggagttggaaagccaggtatgcctggaatgccagggaagccaggagccatgggcatgcctggggcaaaaggagaaattggacagaaaggggaaattgggcctatggggatcccaggaccacaaggacctccagggcctcatggacttcctggcattgggaagccaggtgggccagggttaccagggcaaccaggaccaaagggtgatcgaggacccaaaggactaccaggacctcaaggccttcggggtcctaaaggagacaagggcttcgggatgccaggtgcgccaggtgtaaaggggcctccagggatgcacggccctcccggccctgttggactgccaggagtgggcaaaccaggagtgacaggcttccctgggccccagggccccctgggaaagccaggggctccaggagaacctgggccacaaggccctattggggtaccgggggttcaaggacctcctgggatacccggaattggaaagccaggccaggatgggatcccaggccagccaggatttccaggtggcaaaggggagcaaggactgccagggctaccaggacccccaggccttccagggattgggaaaccaggcttcccaggacccaaaggtgaccggggcatgggaggtgttcctggggctcttggaccaagaggggagaaaggaccaataggtgccccaggaatagggggtcctccaggagagccaggcctgcctggaatcccaggtcctatgggccctccaggtgctattggttttcctggacccaaaggagaaggtgggattgtagggccacaggggccaccaggtcccaagggtgagccagggcttcaaggcttcccaggaaagccaggtttccttggtgaagtagggcctcctggcatgaggggtttgccaggtcccatagggcccaagggggaagctgggcaaaaaggtgtaccaggactccctggtgttccagggcttctcggacctaagggagagccaggaatcccaggggatcagggtttacagggccccccaggtatcccagggattgggggccctagtggccccattggaccacctgggattccaggccccaaaggggagccgggcctcccagggccccctgggttccctggtatagggaaacccggagtggcaggacttcatggccccccagggaagcctggtgcccttggtcctcaaggccagcctggccttccaggacccccaggccctccaggacctccaggacccccagctgtgatgccccctacaccaccaccccagggagagtatctgccagatatggggctgggaattgatggcgtgaaacccccccatgcctacggggctaagaaaggcaagaatggagggccagcctatgagatgcctgcatttaccgccgagctaaccgcacctttcccaccggtgggggccccagtgaagtttaacaaactgctgtataacggcagacagaactacaacccgcagacaggcatcttcacctgtgaggtccctggtgtctactactttgcataccacgttcactgcaaggggggcaacgtgtgggttgctctattcaagaacaacgagcccgtgatgtacacgtacgacgagtacaaaaagggcttcctggaccaggcatctgggagtgcagtgctgctgctcaggcccggagaccgggtgttcctccagatgccctcagaacaggctgcaggactgtatgccgggcagtatgtccactcctccttttcaggatatttattgtatcccatgtaaaaacaaaaaaacaaaaaacaaagaaaagaaagagattttatagaagaaaatgacacaccaaaaaatccaaatgaaaaacataattgcttcaaaacacttacacagttggaaagttatatgtaagtgaaaatttggaccattgtgtacaaataaaaactaagatgcatgtttaatactccacacagcagcctgtaattgcgaatgatgggatagagttatgtatcaagtactgacacttggttgtacccactggaatcatattagctgttttatgttatatgcttccacagtaacctgcttattcagatcagtcaaaatatatcagtatgaaagatcatagctaatgaaaggcactcactcatattgtttactttaaaatatttataaatatgccttaaagaaatacaaatgataacaattacataccgtatttacttgcttaatttcctctgtatttgtgtagatactttgacatggaatatatggtggggagacccgtagtgttaccgccccagtgggagggggccctggggaccctggtaatgctttagtcaaagggatatctctcttgtatcagaggctgtgtcttttagtaacaggagtcctcgtcagaattgcgtgtctgttgtctctaaaagaatgggtgaaccaatcggcctttgtgaatttattcagtgccttctctgtaccaagcactgggtaaggcacttttgtggagcattagacagtaaccctcaaggagctagagaaccggatgggagacatgagcggtaattaactcacttgttccccagagtttctatttgttttgattttctttttctgtgacttattttcctattttctttcctccatgtaattttcactatggcccaactaatataaacacctggaaattacaaggaaaaaaaattcttcctctaataactttccaaatttgtggaatatttatttgtaatagcagttatcagttatgcttatatagcattaaaaattctcctcctttgactacacacacaaccacagtgtggttctaatcatggagatatcagtaatttttagtaactgaattttgaggacatttctctgtttagcatgtatgcaaactgatatgtaatctgaggttccaaagtcaatttttttcttttttttttgagatggagtcttactctgtcacccaggctggagtgcagtagcacgatcttggcttactgcaacctctacctcctaggttcaagcaattgtcctgtctcagcctcccgagtactgggactactgtcttgcgccaccatgcctggctaatttttgtatatttagtaaagatgggttttcgccatgttggccaggctggtctcaaactcctggcctcaagtgatgcacctgcctcagccttccaaagtgctgggattacaggcatgagccaccgtgcccggccaaagtcagctttcaaaatccaagccataattggtgaggggggagtttcagaattacatagaaaaattaatatttgaaaaaataattctgaaatttcgaatttaaaaacagatgtgctgcttctgggtgtaggtagtaaaagtataggaaaagaactgtttccttagaagcggactgtggaagggctatgtagaatgtcaaagggcaacaagagcctgtgtttttaatgtcatcctgtactcggcacaaatcaaaggccaatacaagtctgaaaagcagaaataaatatttttccaggtttttgcttgggcacatactaactgctttgggcattctaatctggtctccaaacaccaaagacccatttcgagcctgctattagcctgctgctgactctatcacttggagcaataatgtggggttatggtggtggaatcttgtatatttttgtcaaaaataaaaccttgagttaaggggatagatatagatggaaaaatacacaaataaatacggtatgaaaacacatggaaatgtgtctttgtcaaatctgaatcattattaccatca

SEQ ID NO: 15479 - DNA, 21177 bp, Human
agaaagaaaagaaaaatatctaacttggaaaacaaaacataaacctcatttggtgactttggtggtttcacagcagtaataaaagtgataaggtctataagggataacactgtaggcgccttctggcactaaagtttcatgggtccttgccatcaggctcaggtgttactagcaattcatccaaaatgcagttataaaacacctactttgagccaggaactatattttatatttattttatttattttttagaggcagagtcttgctttgttgcccagactggaaggcagtggcccgatcacagctcactgcagcttcaaactcctaggctccagtgacccactcacctcagcctcccaaagtgatgggattacaggcgtgagccaccacatctggccccaagaactgttttcaatgatagcattttatttaatattataaaattaatatgaagaagttgctactaaaagaagcactttagcaaataaaatttaatagatcaggtagaaacactgacttcaatcttaatttgggtggctgatcaggtaacctacaattgggcaatcagagatgaacaataattttgtatgctatctgcctgactacacaaggtacttttatgtctttttgtcaattacaagaaaaaattatccctgggcaaacaaatacacaaagataaaagagcaaaaatcctacccacaggcaactataagatagaaaaaaatagtttgattaacgacttgaagtgctgaacaaacatttaagaactttggcagaaatttctgaaaattctagtccaaccgcgaatcaagaaacacaggtaacactatgttccgttactgggttagagaacagaacagttggctagtttggctaactcatagaaaacaagcaaaccaaccatgctctggtccaacaatcatcagagcacgagtttctcctactcagagtcggtcccatgggggaaaaaaaagccacacaggagcgggatctgtagttaaggaagataattagaggacgattttcctttttttatttctctgtattttgtaaagcaaccaccgaggtaggggcggggagggagtggttaatattgcggatattaagatataaataaaggcagatgaaatgaagttagactttcacaaagaacgaaaaacctacgaatgctcttggcctcattaacaaggaacataagcagttccagatgaggaacccataacaaacttcaaataacgaaactgtagggagcaagggagtccgtgagagtattttaagaaactgggacccaggaagactaagttaacggatgggatatcatgctgtctatatttctttacacactgctatgctttattaattaggttacattataatgttaaataactagaagcgctgggcatttaaagttcttccagaccgccctaaccactcaaattatcctaattagcaattttttttaagttaaagactatttcaatcgcaatgggtcggtttctatttcaaagatgtaaaggagtcaacattctggcacttcctcttggccggcaggacgaggttgacaaagtcggccagacaaggtagggttatgggggctgcccagtcccgtgggtctctaggcagtgtgttctctcttccgaggtgggggtgtccccggcgcgaggagctagctgtggtcaccgaagcccacgaccaaagcggggcgcccccagcgcttggggccgccttgcctcggcccagccgcgcacctggacccctaaggcagcccccttcccggcgctccgctgtcccgcggccccgcagcaccgcccagcccgcgccagacccgcctccagccgcagggaactacctaccgtgcgccggcccctgggctgaaaggcctctgactacgggctatgtaacagcgccaccaacgagcgggacggacagagcgactccttccgacttccggaggaagcggaacgctaccggaaatcgcggggagggtcaaaggagacccggtctccgaggctcatggcgatgctggtcctagtacccggacgagttatgcggcctctgggtggccaactttggcgcttcttgcctcgcggactcgagttttggggcccagccgaggggactgcgagagtcttgctgaggcagttctgcgcgcggcaagcggaggcgtggcgtgcctcggggcgccctggctattgcctgggaacccggcccctcagcactgcgaggccgccacccccgtggtcgcagaagggccccggagactccacgcgcccctcgaagcccggggtgagtgcacacctggaacccttctggtgctcgtcgcggctgtcggccagcccagcggccacatcccacttggtcgtaacctcagacactactccgcctcccctaaagttgtccttagcttgcgcgccttacctgggtcatggaatttcatcctacatttcccgtgccttgcgggtagtcccagttctccacagagaacttgagactttacaccctctccacgtggctggatgccccgacttggattttatgttagcgtttccatcaaaaaaaaaaaaaaaattaagtttcaggttttcttaagggtatgaacctaaagtttaccgtgattgagaagtcagaggacttttataatttgtcacttgagccccatccagagttccatgtatacgttgaaattgaaacaaaaagtggaacttagttatgtgtggatctgcctttttcttggggttctctcgagttctaattctgacccagaaataacttgagagccactaccctgtggtaagagaagtgggtttttggagctacgggaaggttaatgagttaggcctagtctagttggccaacatcatcttcatttggggagttgaataagggtacaaagaaataatgggtgtaatttgcaagaagctccacttttagattcctcttctactttggcattgttacttctggaagccagagttaagttaacctcccaaatttcgtttggtctatttatctcagtatcagcataagcagataattgttttttgtgtgtgtgtttttggattttggtttttgttttgagacggagttttgctcttttgcccaggctggagtgcagtggccctatctcggcccactgcaacgtccgcctcccgggttcaagcgattctcctgcctcagcctcccgtgtagctgggtttagaggggtccgctaccacgcccggctaatttttgtattttcagtggagatggggtttcaccatgttggccatgctggtctcaaactcccgacctcaggtgatccacccgcctccgcctcccaaagtgctgggattacaggcgtgacccaccgcgcccggccataattggttttaaagtcattactggagctagggtcacacatagtaacaatcgtggtacttgagcttttttttttttttttttttttttttatttacatgaagagaactgacttagggaactttcccctggagatgaatgcctttgtagttcagatcccagacctaactgcatccacagaaactttgagcattttctcatccctgaaacattttgcacatttaacatcatggcctgtgtgtatgtatattaaaaactactttaataagtttgtatggttaaatgtttgcatcttactagaatttttatgtttgaaatccctgccccagtagcctgtttcctggaagtctttagcaatcacatttgctattggaggagctttactggctggaatgaagcacgtcaagaaagaaaaggcagagagtaagtagattatcatctgctcagccctgtataaaggtcttcctggctatggactagcaccttttttgttgttttttagctttttgttttgaaacaactttagatttaccaaaaaattgcaaagatagcataggttctacatacctttcacccagcttcccctaatattaacatcttgtataaccatgacacatttttcatgactaagaaattttaaatggcacacaactattaaattacagattgtatttggatttcacttgtttttctatcaatgtcttttatttgttccaggatccaagctaggataccactgcataacaatgttaaaagatatactgtggatagatttgactgggcaagatgaaatctggagggtacgaagatgagtaagatgtagtcgagcctttgaggtgcacacggaagggaaacagacacagaagtaaagtattttactagatgcgattctgccaggccagaaggaagcttaccatgttgtgagagcaaaagcaagtcccagccttgagatttgagaaggcttcctagagatcaggcaaggagcatagtgcgagtagatactgcatgccctctgtggatgagggggaggtgaaaagagcctggtcaggaaatgccaggaactgctctggattagcatcttgaaatatttagaaattatttataagaactttgcattttagtgaatatcctaggacttttaagatttggtttagaggttttaggtaaatctttaaagtattgcttaaatctttccattctttggagtctcttttgataacattatatacaaaggttaatgattaaatctgggaattcataggctttaggaacttagcagtgttaagttttgtactgacatacatatatatgagactctttggcataataagtagtattgggtaagattttcatagtctaataagcagtaagtttctttagtttcacaaagaaacagctaggaaagttgtggcgggaaaattctagaatatggaagctttttttgactttagtttggaatttcaagtgcaattctaacgtttgttttatttaaaaaatgtattattaaataatctgaaaagtcttcctaaataatttgagagtatttatttgctgacatgttgcgtcattagctccaaacactttttggtgtatttcctacaaacaaggaccttttctagcataaccacaatacaaccatcaaaattagaaaattgacgctgataattttgctgctgttcagtgttcagataatcttcagggtattgtttatttgtttgttttttgagacagagtttcactcctgttgcccaggctggattacagttcagtcttccaagttttgccacttgatgtctttcagagcaaaaggatctgtttcagaaccataccaccttgtatctagttgtttaccttagcctccttcatctgtaacagtttcccaggctttaactgactcccacaaccttgacagctttgacagttacaggagagttattttgtagaatgccccttagcttggatttgtctgatgtttcctcattcaggtcattcgggttgtgtacctttggcaggaatatcacaaaagtgatgctgtattctccgtgcatctggtcagataccacatagtaccagttgtcccattactgataatgtccagtttgatcacttgattaatgtgtgtctaacaggttttctactgaaaagttactcatgtaattaatggtgtttcatgatttgtattgacatacgtatacttacatattctgttccccatcccactatcaatgtattcatttatttatatctgtggacttgtttcctatatattcattcagtttaaatccatattctctttattttgatgcccaagttgtcccagattgatcagcgggagcccccttggagcaggcttctgtgtctttgacacgtctccaatattctctaagttctgctttccttctgccacaacaagaggttccagcctcattttacactttctttgccgcaaccctggtatcagccatttctccaaaaagctgtttccttttagtgaagaatgatatttagaagtcaggttctgggctcatggttcttggagtgtgtctgctccctggtcctctcagtggacatggtgagaaaatagatatatttatgtacatctatatttatttatatctatatagatagaagttcacactagtacctgcagtgtatttgcagtactgcagggttcagcctagctctctttctctccatagttgactcttgtttcctattgtaactctcttctctttaatatactcatttatttcatcaatttcctgtgtgtaactaaggtcccgtcaccactatcacctccccacccagctgccctccttagcaccctcaggatcagactccctatgccaggccacccaccgcaccccacttgtttagacattcagctctaggccactgcagcccctccctgcccccagcatggacacagctaatggcttaggactgaattgttcctgaaaaagaagaaatattttttccttttttacaacataccatagcatttcatttgattttgttttaatgttttgtgcttatttttctgaaaagatttttttagcttcttgaaaactgaaactgttttttccacattttgtgcccccaccatgagtagcatagtacgggccatatgtcaggtatttgagtacctctggttaaattgactttttttttggtgtcgatatgtttttgtctccttaagagttagagaaggaacggcagcgacacatcggcaagcctttacttgggggaccgttttccctcacaactcatactggggagcgtaaaactgacaaggactacttgggtcagtggttattgatttattttggcttcactcattgccctgatgtctgtccagaagaactagaaaagatgattcaagtcgtggatgaaataggtaagaaagccatcactaactaaacaaagtatatgtttacttcatgttaccaggtttttcacacccttgtattattgttaggtggggttttgcaattatgtgatttgtaagaacataaaatctcagcatttggcttgtttgttgctttgaatcttgtgaccttattctccactgaaagaagcttgttttgatgttaaatgttagatcacttaaaaatgtcagtgtggtctcccttaactctacttttgtgtcccttcctttgcatcactgatgctgccattgcctcttccccactgattgtgacaattaaattaggaaatctttgcaatggtctgcagtctgtggcattttactagtactagtaagaaggaagggtgcctcctccatacagtgaattatttcaggatattcagctcttattaacaatttaccttcttgcccttgagatatggtgggagtgaaaaaaactacagatactggagtggattcagagataagatagccacatgacattatccaggggaagaacatttatgtgctggtgcaggcatttgataggatatgtaaccttgtattatccaccacagataatactactgtatatgggtctcctcctcctaaaggccatcccttctccatccccttccccgtcctcttcctcttcacctgaatgttaagatgtccatctgcttccaaaacacctagctgtccagcacgtcctatactctcctgttattgctggttttctttgtcttttcccttagggtgtgaatacggactaattggaactctctttcagatagcattacaactctgccagatctaactccacttttcatcagcattgacccagagagggacacaaaagaagccatcgcaaattatgtgaaaggtatttttttaaataatactttacatttatttagccttaaagtttttggaatatcagttcatttgaaccttacagtgccttgtgaaataggacaaatggtattatcaccagttttatgggtgaataaaaaggtgaagctaggaattgttatggatagttagtgcgtaagtaagaaatgggtttctcaattcctgatgcagtgctctttatattttgtcacagagaaaggatttgaacttggccttcatgtatcaactaagttaatcgagccttgaattgagagtaaggacacattgcttctaactccagcgctgtaactcattctctgcattgtaaaatcagaacaaacatatattctggaagtatgttcattggtagattaaagatgaataattaaatacaaacatattttgaactcagtgcatgttttataaatttaaaacatttactgtaacaggccgggcatggtgggcctgtaatcccagcactttgggagaccaaagtgggtggatcacctgaggtcaggagtttgagaccagcctggccaacatggtgaagccccgtctctactaaaaatacaaaaattagccaggcacggtggtgcacacctataatcccagatattcgggaggctgaggcaggagaattcgcgtgaacctggcaggcggaggtagcagtgagctgacatcacgccactgatcttcagcctgggcaacagagctagactctgtcttaaagataaataaaacatttactatgacaaagtaactgttgtttaattgacacataacagttgtacatatttatggggtacagagtccctatcctccccaaccctttccagcctctagtatccacagttcttctctctacttctgtgagatcaacttttttagtttccacgtatgaatatgcagtatttatctttctgtgcctgacttttttcatttaacatattaatagtatcctccaggctcatctccattgccacaaatgacaggatttcattctttaatatggctgggtagtattccatgacgtatgtatactgcattttctttatccattcacctgttgatgagtactgttggatttcatatcttggctattgtgattagtgctgtggtaaacataggaatgcagacgcctcttcaatatactgttttcatctcctttggatatatacccagtagtgagattcctggattgtattgcagttctgtttttacttttctgaggaacctccatactgctatccacaatggttatactaatttacatttccatcaatggtgtgtgtgaggtatctttgttctgaatcattgtcagcatttgttatttttttgtatttttggtgatagtcattcaaattgggatgagatacctaattgtggttttgatttgcatttcccttgtgattggtgatgttgagcattttttcatatacttgttggccatctgtatgccttctattgagaaatgtctatttagatcatttgccctttttaaaaatgttatttgtctttttggtgttgagatgattgagtacattctggatattaactccctagtctgatgaatagtttgcacatattttctcccattctccaggttgtctcttcattctgtttattgtttcctgtgctgtgcagaagctttttattttgatataaccccatttgcctatttttgcttttgttgcctgtgctcttgaggccttatctatcaaattttttcccagactaatgtcctgaagtgtttcccctatgttttcttctactaattttatagttgcagatcttccatttgtctttcctacatttatatttgatttttgtatatgataaaaatagggatctagtttcattctactatgtagggatatcccgttttcctagtgccgtttcttgaggagactgtcctttccccagcgtatgtttttggtgtctttgtcagaaatcagttggcttaatttctcggtcctctattctgttccattggtctgtgtgtctgtttttatgccagtaccatgctgttgtggttactatggctttgtactatgttttgaagtcaggtagtgtgatcctaccagctttgttctttttgcttaagattgccttggctattaggggtctgttgtggtttcataggaattttaggattgttttttctgcttctaaggaaggtattactttcaatggaggaatttcaatcaaacacctctgtatgctagttaaaagctgttaggcacttttaaagactacagattatagtagaattgagagtggatgcttaggttctaattcatctgtgaaaatgggcaagtttaatttctctagactcaagtttcttcagcatatgtgcttaaaaatcaggaatctgaattttaattatggtaacattgatttaataactggttaaaagcactaaagaatagttttatatttatattatatgacacattcaaatacatatcttctaaactttgaggttatttaaaaatatgttttatgaaggatctgctgtatgtgtaattacttttaacacatttattaaggtataattgacatgcaataaagtatagatatttgaagtatataatttgttgccttttgtaactgaaaccatcccacagtcaagaaaatgaacatacctgttaccctgaaaagttttcctttgcctttgttagtccctccctttttccctccccaatctcccatctgcagaactgctttcttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgctaccacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgcagaactgctttctattgataaagattagtctgcactttctgtgtatcatagttcattcctttttgttgctgactaatagttcacctatagacatttgagttttttgcatttattggctgttacagataaagctgctaagaacatttatgtacatgtttttgtgtggacacatgctttcatttcttttgagtaaataggataggaatggttagatcatatagtaggtgtattttaactttctaagacactgagaacctgttttccaaaatggtatatttctgcattcctgccagcagtatatgagagtcccagctcctccacagcatcaccactcttggtgtggccagtctttttaattttagccactctagtaggtgcttagtgatatctcattgtggttttggcatacattttcttaatgactgttaatgttaagcttctttttatgctcttatttgccatctgtattacctttagtgaagtgtctgttcatatcttttgaccgctttttatggagttctttgttttcacattatgtgtatatgtattatttatattctggatacaagttaggtgtgtgatttgcaaatattttctgccagtctgtggctcgtcatttcagtctcttaacagtgcctttcaaacagcagttttcagttttaatgaagtccaaatttatcagtttgtccttttaatatagtgcttttggtttggtatataagaaatctttgactaacctaaggttacgaaggtttatgttttcttcttgaagtttagagtttttactacgtatacttaagcataatttatatctacagtttataggtttgtcagaaatttgggcaatagtatagtcatttcatgaagcaatgaaaaacagatatttatgaactcattgagttatgcacagtcttcaatttaaacatgtgttatattggcaaaaatcacatattactaaccaaaccataatatccccaaatgagtagacattcgagttgctgtacctaaccaaaacaccagactttatggtaattttcaacagaacatagcgattgatgatgtagtcattactagttgcattttggggagatttttaaaactttaatttggtatttagaaaaaaatgcagtttcagcaatttagttttaaaaaaagtttgaatgtgcagctaactcaggcttcattcacctttctctttatttactcagagtggaaaaagaaagcctgtcttttcagaatctgaacaatgtctcatttagaatgatgagttcatccaaggaacaaaaattggcttctgtacctttagaaaaaggaactgctgttaaatgttgggctgtcatttcagtagtttgatgaatccagttgttttaagtgacctctaccggttcacttacatgaattccaaaaacttaatagcagatacacgctgtgaatgatttgcccttatttcagaactttgttaagattgcgttttggggatgactagtattaattaaccagtttttttaaatcagaagtaaagagtagaacttgataccagtgttgaaattatttgcaggaaaataagacacaggtattttgacctgatatgaacttagttatgaagcaaatttttttccccatatgatgccatgaaaagttatagtatttaatttatgataataattttaagctttagtatatctgagaactacatgtgactactccttaaaaatcaatttaaaatgtgatacaagtgattagaaaatattccctccaggtctttactagatagtcataaaaagatttgacttatatattacaaaggagaattttcatttgttctttgtgaatttcttctccttttcctttgaatcgtgaagaaatgtttggagactcacaggaagaaagtggcagtagagctgctttacaactgatacattttttgaagtagagatggttgttttactggcttctcatttttcactgtctctctcattttttatttagaattttctcccaaactggttggcttgactggcacgagagaagaggtcgatcaagtggccagagcatacagagtgtattacagccctggccccaaggacgaagatgaagactacatagtgagtaaatgttccagttttaacccatggaccagctcccagatcccaaatagtcataaggctttcaatgactgactagcttctgagaagagagaatacctaagattattgcaaagtccttaggaatttttttttttttttttttgagatggagtctcattctgtcatccaggctggagtgcagtggcacaatcttcgctcactgcaacctccgcctcccagattcaagcaattctcctatgtcagcctcccgagtagctgggattacaggtgcgcgccaccacacctggctacttttttatattttttggtagagacggggtttcaccacgttggccaggctggtctcgaactcctgaccttacccgcctcagcctcccaaagtactgggattacagacgtgagccaccgcatccagcctccttaggaattttgaatatttgaaaggataatagaagcatgttttttactttttatttattttcgagacggagtctcactccgtcagccaggctggagtgcagtggtgcgatcttggctcacttcgacctccgcctcccggattcaagcaattctcctccctcagcctctcgcgtagctgggattacaggcatgtgctcccacgcctggctagtttttgtatttttagtagagaaggagttttgccatgttggccaggcgaggccagggggtctcgaattcctgacctcaggtggtctgccctgcccacctcagcctcccaaagtgctgggattacaggcctgagccactgcgcccagccagaagcagttttttaaaagatgattgtttgatttatattcactgttctcataattcaattgcctgtttttctcttatagtggcatataggattttagggcagtttaaaaccagatacttgggtgccatgttggaaataaagagaagccatcatttggaacaacacttattttaaaaagattgtgttggttctcactgtgtccccagtagaggtatcagaaattgctcttctggagaaccagttttaggccatggagaactgcatttttaggttgaatgagaattctgaaaagcaaaagatgaaaggtttatttgcccattgactatatgccttggacagttaggcgttaaatatgtgctttttaatgataaggaacagaaattctgttgtacttgtgtagctcttaaattaactatcttcatattcatcagcactgccccagaagccttaaggtcatgcccaagttactgtgtttcttttcttgtcagtggtttcacagtgaagcaccaaaaggcattagcaccaccactatccaccaattttcctctcaatttggacatttttctcctatcatatgaagagtcggcgttgtattttagcattatttcagtatttttcttagttgtcatactctgttttttctataatattgtttgggcagagtaatcctaagagcctttctagctgtgaagctgtctttgtagaaagaaagatggccaagaccctgagtcactgatccagcagctccccatggcccatcccaagagttgagatgcagaggggatgggatgtctcactgcagtgctttgtctcaacagccaactatgatttctttgtccctttgaacctggaacgtgtgtgcccctggagcctacagcctgaattaaaagcaaggttctggcctgtttgccttaattaagcctacacagtaatcctgtcttccagatgtggtgcctcgtagaattagggaaacttggattccttggagtaaaagatgagaaaaatgagcacttttctttaagccttaattgtaaggaaagtagagggaccctcctctgttttcctcttgctgcttctctagcagaatgagagaagagcagagagccacagtggccaaaagaggaaaccataggaaaaggactttccggacttctgtctttatagagagttgtattaactggttttgagtttatccgatgatgacagcaggaatagatgagctcatcagtctgatttccagcattaaatgagttatattaaattgtttaaatgtatacagtcctaaactaggtaacactccatagtcttgatgcttagaactcataactcagagtcagaaagtcaaatcagaaagcagttgtacaaataaacccaaacagcctgcaaaacttaaattgaaaacattcagttacattgacaagagattttgctgaaaccaaagtgctgctcagggcaagaagggagggggttttggtcagactgctatcacatacccaactctactcaactgcccctctgcattttctatttaaaatactttgaaacctttaatcgtgtagcctgccttgcctggttagtgttgatttggcaagaatgtatcatattcatgtctgcctgtaacagcagtgggcagctaggtgccagtgagatcatggagcaaacacaagcctgggcactgaaatttatactcacaacacagataatccagaatatggatattaatgtttttaattacaaatgaaaacaaaaatatgtaagtcttatggaaacttcttggaccttgtagaatgtatctttggccccattttgagaaatactggcctactgccataagaatttgacttttgatgagattcgatgaggaattcatgctgtacatttgctaaatcatccaatagggggagacattcttcagcttcttaggtttttcattagtatgacttcagtcccttgaggtcacagattttcatccataggatggtttgggaaacttctgttatcatttaaggacctgcaggaagtaagggggtacctttaaggttaatgttgagatgtaatggaatgaagttttcttaatcccaaacgacagcaacaacaggcaagcttctggcttttgagtggactcttcagagtgatcgaactgggtataccaaatatttggaattccatagaaagctggatctgcacattattgtattatatatatataatactatattattatatagatattagttagaaaatacttttgaaaaaagaatacaaatagctttcaaacctaaatgtgcagtttcataataaaagaaatgtgaattgtataatgaggtaacatttttctcttggctcagcagtggtcagaaaatctgaaaatatattgtcgaaattggaaaagcaggaaataaactgcaggagtgaatttggaacagcaggcacactcatgcattgttgataggaattaaactcatacaccctcttcagagggcagtttaacagtatttctcacatttaaagttatatactttttatgcaagagattctactttttggactttatcctataaatataccctatggcattgtttttaaagagaaaaaactgaaaatccagtaaccattttttaactactgtgtataatctaacgtagaacaatgtccaatatattgttaaatgagaaagcaagtactgtagaatatattgttacttgtgtataaaaaaaataagtggtagtggatatatacacatagtagatgcagagaatttcttcggaaggatacagaaggaactgatggcattggttcactctaaggggaactgaggcactctgggtgtgaagagggggagggacattttcattgtatacattaactggatattcgttttctatgtgcatatattaccttttcaaaaaataattcacactaaaacgtaacttgcacactagaaaaactgagttgctgctctccattagaattggagctagaggcaacgtggtgataaaagtttgtggactttgaaactggacagattctaggttttaaagttaggcctggcacttaccaattatataatttactctctccagcctgtgatatcatttgaagaggaggagaatacctgtttcatggcttaagatgacatgtgaaagaatttgtcagttaatgctagtgtcctttttctatacaaggaagtactagaacttggaagacctctgtagacctctgtattagaataaatgtcaatgtgctctgtcacaacccaaaggaatattgaggagtgacctctgacaagttcgacagatacagataaaataatatttttgttgtgtactacaaggtaatttatattaagaacactcagaaaataagtcccacatactgtagtttgttttttttaacagagaatagagaaaaggaagaaatagggagaaagagtgatgtaagctacagagtaaggcttgaagagagaactggagacttaattctgatttctgtatcaaatatgtggagaaacgtagccccccgtcttgctcctgcggtgaactatcccacagcacttggaatccagttgttggcgctcttttggtgtacattctttccttatgtgggtaggcaagtgctctttccatttgctatcttaagaatgtgtgtataaaaaataataccctcacagacatatagtgcgtgctggggtatgtttgggaggtgtctccagtttggtatttgtagtcacattcctgtctttctttgtcttgccaaatagcagtcaagcctgcaataaattccaaggactctaagtgccaaatctcacttaaaattggattttatggaagtgtctaactaaaaaatctgatgactaatctaagttaaagttagagctgggaccattttaggactttgctgggaaaatggatgctgagtttacgatgactctctggttaggggggcagcatttatgctcccgaggatttgctttccaggtgatggattgatttcagataggattattcagtggaggagacaaaaatttccttggggagaaaaatgtttcttttcctgtttctgtttgaattactaatattaaaactaaatattgttcaaatttatagattatttaaactaatgattagttttctgatttcttctcataaagcgtggtaagcagaattttggcagtaatgaatgacaaccagttctttctaaaacatgaataaacccaagaacttactaaagaaagcagtttttcaccaacacttaattccatgtgatgtctgtttgtaacatgtttagggtctgaggagatatcttactcaaaaatgaaggtatttttcaacaagcattgctattccacaaacattgactgctttatgaaagcctgcagcagctatttcttagaaggtgaattcttttctcagagtgtgtgggtaaatatgttaaggattaaaccaaaagaatttcaggttctagctgatgtgacaagcaataaccagtgcagatgtttaggacacaaaagattttagacaatttttgttaggaatttgctatgatagacttaagcctattccataaataatagatgctgtaaaggttatttaagcattaatgtaaagttctcttatcttgcagcatacattcagtaaaataagcagcttattttggtaatctttgtcacactctccccccttttctctgcaggtggatcacacaataataatgtacttgattggaccagatggtgagtttctagattattttggccagaacaagaggaagggagaaatagctgcttcaattgccacacacatgaggccatacagaaaaaagagctagccaaagcagtgttgctggatgcagtattctcttgctaagaggaaggaaactgtctcgcataggagcctatataaatataaacatatatacgtgcactctacagaatggccttcataccatgagaacatttctgttttggatggggatgttacccttgcgttcaaccaaaattgattcttggaactgtaaagattacaacccaaagtctcccaggaagctgtggggagaccagaggatcaagctgaagtgaagccagtgaagagcccacctgtggaaggacatggcggggcgaggcacagccagtgcattcctgcctgcgaacaggccctcccagcagctttgccgcctctccatcgtcttgggcccttgctcaaatagctgtgggactgaatttcacagaaaagaatataatttccatagtgctcttgcttgcctcttcttgagttctttgctcttctgagttcttggtggctaataacagtcagattagggtctctgccattcagagttgatgcttgaaaactttagttttccttattaatgaatatcactatcagatttgactaatgaagaggaaatctattgtttgggggaaaaaaaacatcagtttgatttctctaggggttcttttatgtgatttttagctaagtggtgtgccaggttttcagtgacataccaaatggaaataagaggatattgatcacgagtgtgatgctgagtacctttctgcatatactggattgtactttgtgtaaagtaaacatactcagttttgctgttcagacaagcgtgatctttttcatgggtgatgagtgggtacatagatggctgcacacagttctcaggaaagagacccacaggctccagcgggcaggtgggtgggacgcttgctgaagtgcagttccccagacccagagctgaattcactgaatctgcagtatgatgcagagacctgcttccatgacagataccccaggtgactcggatgctggcggactgggaccatcccttaagaaagtgttttttggggaaataacttgcctggcacaatggctaatgcctataatcccaaaactttgggaggccagggcctgaggattgctagaggttaggtattcaagacaagcctgggcaacatagtgagaccccccccccccgcccccatctctacagaagatttttttggcatggtggcacatgcctgtagtcctggctactcaggagactgaaatggagtatcacttgagcccaggaattcaaggcttcagtgagctataatcacaccactgcattccagcctgggcaacagagtgagaccctctagatatatctatgtagagatacagaaattaaaatgaatttaaaaataaataaatttgacccttcttttggtgtgtcagccattgaagaaaatgattattgagtgatagaatgaatcttggcttttgtttctaaatttaactgccctagaatcctgggtttggcctttttctgccagaagctgctgccctaggggcaaagttctccaaaagtttttcagtaaatcctaagatgcaacaaatataatgcctagatagacaacagattctttttacatgatatgtttctacacgcacatgatagaggtcttttggtttttaaattctcaatacttaaacctaaatatatcaaagtaaaagtatgtgaaaaaaaactatgctagttataggttgaataatgtcccccaaaatttatacattgaagccctaatctcagtacttcagaatgtgactgtaattggagatagggtctttagagagatagttaaattaaaatgaggctgctaggttggccctaattctatatgactggtgttcttaaaataatagattagctgggcacagtggcttatgcctgtaatcccagcactttgggaggccgaggcgtgcagatcacctaaggtcaggagttcgagaccagcctggccaacatggtgaaacgtcgtctctctcctaaaaatacaaaaattagccgggcatggtagcgggtgcctgtaatctcagttactccggaggctgaggcaggagaatcgcttgaacccaggaggcagaggtggcagtgaggcaagattgcgccatcgtactccagcctgggcgacagagcaagactccgtctcaaaaagaataggagacacagtgagacgaccatgagaagccagagagaaaacagccatcttacaagccaagagagaagttgtgagaaaaaaaaaaaaaaacaaaccctgctgactccttgatttttgccttccaagctccagaactgtgaggaaataaatgtctgttgttttagccaccaaacctggtaaggcagtcctagcaagctaatacaatagcctgttccttaataaacaactgcaagatttagtttatagaaaccagctcggaagcagttggtttagaatgactttcctaggaatctggtcaagaaaggaacttactaaaagactattctcatttaacaaaagagatattaagtatctcaaaggccaaatctttaaaaagattatctgttttaagccacaaaacatttgtgtggatccctttgcagcaagtttgctcttagataagattcagtcttcgttctcagctgttgcaggttaaggcttgtgaaatgatccaaaaagggaacagcagcttttggagaaaacttttatttgttcttcattctagtgtcaagtttaaaggcttgaagtcagaatgttagaagtggggaaggggaccttagaggtgacgtcttcca

SEQ ID NO: 15480 - DNA, 14086 bp, Human
aaccccgctaaacagccgggactagctgggactacaggcgcgcgccaccacgctgggctgctttctttgtattttgagagagacggggtttcgccatgttggccaggctggtgattcgctcgcctcggcctcccaaagtgctaggattacaggcgtgagccaccgcgcccagccgccacaaaacttttaaaagttattacttcgctaaaaataacagcgtagaagccattgtgcagcgccacgcgatctcggctcactgcagcctcgacctcccaggctcaagcgatcctcccatcttagcctcgcaggtagctggggccacaggcgcacgacaccacgctgggctattttttaaaataaaataaaaatcttcgccaggctggtctcgaactcctaggctcgacagatcctctcgcctcagcatcccaaagtgttgtgattacaggcgtgagccaccgcttccatttttagagttctattctgaggactaacgccgttcaacaagttggtgtgaatttgtttgcatttttcaaaaccccaaagccggcctgggcgccatccccatttgccccgggcctctcaggaccccgaccacaggcaggaccccgaccacaggcagcgccccgactccaggcagcgccccgactccaggcagggctacctccaactcccagcctccccaggccgggcccccgcccggctcccgacaggctcctctccccgtggcggggcccctcgcccaggcagcacaccctctcaacccgaccgggcccccaccactctaggagggccggcgttgggggagggcgccgggacgtgcccgagggtgacactcgggcttgggacagggcgtgctgccgcgggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcggtgagtgcgcgcccagtgggtgccccagcgaaccggtcccgggcccccagcggcgcccagttggggtggggggctccccggggccttgggaccgctgctctgctccccgcggggctcaaaggtggacgggacgcgggggtgatggtccgagaccccccgctcgcctcgcggcttccaggtcctggctgggtaggggcggtctgctgaacccgcgctttcgacccttgcctttgtgcgttgaggcttctttcctgccaacagatttagggcgattgctatcgaatgtcccttggcctgcttgggtggttgtgggaaaacaatatttgtcgaagggacattatcgaaagggaaacgcgttagaaaaccgcattttttttttgacggagtctcgctctgtcgcccaggctggagtgcagtgacgccatctaggctcactgcaacctccgcctcccgggttcaagcgattctcctgcctcagcctccagagcagctgggataacaggcgcccgccaccacgcccggctaatttttgtatttttagaagagacggggtttcaccacgttggtcaggctggtcttgaactcctgacatcaagcagtccacccccctcggcctcccaaagtgctgggattacaggcgtgagccaccgcgtccggcttggctagcatttttgttaacagatactcggagaaacaagagaagtatgtcaacaactttacttctccctcctgagtattgcaagtttacacataagctctgaaactttgcctcaaaagagggagtggggttgtgtgggtgtgggtctttcaggagggggacctggagagctggagagaggaaagaagtgcaggagactacagggagctcaccctgcatttttctctacttgtaatcagcatttgcttgggttggggaatgaatttgggagagtcttatcccagtgttctgaaataagtctcttttctgcagatttctttctccaggaagaaaaatggcatccgttgcagttgatccacaaccggtatgaattttgagtagcctttgtctactttctctccttttgtgttttgagagattaataagcataccctccctactttgattgcagagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaagtgagttctgatttttcaagatgcaagtcaagggactggtcagtggcgagcccctgagctcacagcagtaacatctggaactcctcagcccttcctggggcatacactgcctttacctagaaactttcaggtgaccctcattaccgtaagaggactgtttcttttcttttctttcctttttttttttttttgagatggagtctcactctatcactcaggctggagttcagtggcgcagtcttggctcactgcaacctctgcctgctgggttcaagtgattctcctgcctcagcctcccgagtagctgggactacaggctcccaccaccatgcccagctaatttttgtatttttagtagagacgcggtttcacaatattggccaggcttaactcctgactttgtgatccacccacctctgcctcccaaagtgctgggattacaggcgtgagccaccgcgcctgtccacagaaggcctgtttcatagctttggcagatgtttatgatcctttaattaaaaatcccccagaggatgggcacggtggcctgcacctgtaatcctagcactttgggaggtctagatgggaggatcgcttgaggcctggaatttgagactgctcactgcagtctctgcctctcgggctcaggtgattgtcctgcctcagctccctgagtagttgggattacaggcatacaccaccatgcccagctaattttgtatttttagtagagacagggttttgccatgttggccaggctggtcaggaactcctgaccccaggtgatccgcccgcctcggcctcccaaagtgctaggactacaggtgtgagccaccatgcctggccatgaatgagttttagaaatggatagtggtgatggttgtataatgttgtaaatggacttaatgccactgaattgcacagttaaaaatggttgaaatggtgaaatttgttatgtatattttaccgaaataaagaatagaaatgtcatactccatgagaaatctcatactctcatacttagtagtcactccccatttcctaacaaccaccctgaggcagctactcatctactttgtctttatagatttgcctatgctggatatttcttataaatgaaatcataaaatgtgtgggtttttttgtgattggcttctttcgttaagcataatgttttcaaagttaatctgtcttgtcacatcatatcagtacttcatctctttttattgttgaatagtaatttactgtctagacagacaatatttattcattcttcaactgatggatgtttgggttcgttctacttttggagattatgtataatgcttctgtgaacatttgtatacaagtttttgtgtggacatgttttcaggtttttttggtatatacccaggcgtggaattgctgggttatataataactgtttaagcttttgaggagctgccagactgttttccaaatcagctgtaccattttacattcccaccaacactgtatggaggctccaatttctccacatcatgaactgcttttgaataaagatttaaatcattctttcaaatggttaagccagggacttttaggattataaggagcctttagagaccagccattccaactctgctacttcctaaatgaatttggtactagtacttggtttggtattcttagtgggaagctcacactaaaatctcccttgttagggagatccagggtggtcttggcatactctttcctcctgaggaccccaaatacactgacctgtgctgaagtaagcgtaggtagggattaaactagcatgggaatgccgattttgagagagtttccagataccttattctctgaatgacagttcagggaaagcccggctactcttggcattaacattaggggccagttgataaggaagaagcttcagagccagcttcctgtttggcctgtcactgcctctgcctgctcctccctcacacccccatatttccttacctttagaagagagttgccagcaacttgccaggcctcttcctgtcagaactagataaaccaggcaatgccttctgttgtataagatcaacattcttgcctttttttttttttttttgagatggagtcttgctctgtcacccaggctggagtgcaatgatgcatcttggctcactggaacccctgcttcctgagttcaagcgattctcctgcctcagcctcctgagtagctgggactacaggcgcacaccatcacgcccagctaatttttgtatttttagtagagacggggtttcaccatgttggccaggatggtctcgatctcttgacctcgtgatccgcctgcctcagcctcccaaagtgctgggattacaggcgtgagccaccgcgcccagcccattattgccattttttataaggcctatggtaatgtgtgttcattctatacctatagtactacattaacattttcccatttgtgattctagttgcagttgccaatacctatgcctgtaaggggctagacaggattgaggagagactgcctattctgaatcagccatcaactcaggtgagcttgggacaaaagtgctgagacttgacacttcacatgttttcatcttctatctgttaaaacaagctgtacatatcacaaacaggcaaatacttgttttcccaacctggatctggatgtatgtttgaaaaataatggccacttccttacttcctgaactgttgtcaagttgtatctacgaagcagagaagaactagcctcctttggattagaaaacttttagtgtgttgtctatcagtttgtgtctttgctcctataaatgaaattgctgtctcaagtaactgattgtcttgtggtattaaataaatgcagacgtgatatatataaccttttctcacctggcttgtacaatgctgccaggaactaccatccatatgggatagctagccagtgttgacaaaaatgataggcttgtctgtcctggtgatcctttggttcagataatgtcctaaaattttgtttcaaattaagaatacagaatggcacaaaaggataccagttagggaaaaatatagctctgtgtcttttcataatctaaatacagtcatctgtcacttagtgatgggaatatattttgagaaatgcacattaggtgattttgccattgtgtgaacatcacagagtatactcacaccaacctagatggtagagcccagtggtccccaagctttatggcaccaggaactggttccatggaagacagtttttccatggaccagcagggggtgggtggtgtttttgggatgattcaagtgcactatatttatcattagattctcataaggagcatgcacgtgcacagttcacaagagggttagggttaggtctcctatgagaatctaatgccgcctctgactggtaatggactggtaatggactggtaatggtccatggcccgggggttagggacttgtggtgtatagcctgctatatacctaggctatatggtgtatagcctgctatatacctaggctatatggtatatagcctgttgcttgcttctaggctacaaacctgcacagcatgactacactgactactgtaacacaatgataagtatttgtgtatctaaactagaaaaggtacagtgaaaaaaaaaagtatacctgttatagggcagttcattataatcttatgggactatcattgaatagtggtccatcgctgaccaaaatattatgtggtacacaactataggtaggtttagtgtatagcctttagaatgcttgtgcaaatcttttaaatttttcacttacattgcttgagactgtgctaatggtgagagttattttccatttcggatattttctttaaatgttggtaacttgtgttcttttttttttttttttttttttttgagacagagtcttgctctgtcacccaggctggagtgcagtggcacaatctcggctcactgctgtctcttcctcctgggttcaagcaattgtcctgcttcagcctccccagtagctgggttcacaggcacgccccgccacacccagctaattttttttgtcattgtttgtttgtttttgagacagagttttgctcttgttgcccaggctgtagtgtaatggtgcaattttggctcactgcaacctccacctctggggttcaagtgattcttctgcctcagtctcccaagtagctggggttacaggcatgtgccaccacgcccaactaattttttgtatttagtagagacggggtttcaccatgttggtgaggctggtctcgaactcctaacctcaggtgatccaaccaactcagctttgcaaagtgctggcattacaggcatgagccaccatgccctgccatgtataataactgcatactaataacaccccgagggccaggtatagtttgatcttcagtttcctctctggatttgtgtgactttggaataagctatataacttaccttcttttcttttctttttttttcttttctcttctctttttttttttttttttttgagacagggtcttgctctgtcacccaggctgagtgcagtggcacaatcacagctcactgcagccttggcaaacagacaaatttcatatctgtttacttcatttgctcctcctgcaattcccaaggattggcaggtagggcagatatacttgatagggaaattcaggctcatcaactcttagtgacttgcccaagacctaaagctagagtgagaggactagattccttctttaactcttcagctgtgctgccttagttaagaccttaggtatgtccttgtgctcatttttctcaccagccaggggatctgcttttctacttacagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactaggtaactggaattttatcttgaaatactgttttatattaaatctttcttaaacagcttcattgacatatactctcatcttgagtctaaatttacacagttgtgcaagcatcactgcaatccagtttcagaacacttctgctaccccaaaagatcctcatgcctgtttgcagtcagtcctttttaatttaatttaattttatagagatgggatctcactatgttgcccaggctgatctcgaactcctgggctcaaacgatccacctgccttgacctcccaaagttctgggattacagatgtgagcaaccactaatctttttgcctctatagattttccttcctaaagcaatcataaagttcacattgaatcgtacgtagtaagttttgaaactttagcaaaaattggccttgaaaaatattttctgtaaatggatagtctttaatggattgctttataaaatcctccttacaaagaatcatcattaggtaatgtgtgccaggtaccatgccgctcaagttcactctaggctgggagcaatggtgcatgcatgcctacaatcccagcactttgggaggctaagacaggcagatcgcttgagttcaggagtttgagattagcctgggcaacatggcgaaaccctaaaaaacacaaaaattagctgggcatggtggcttgttcctagagtcctagctactcgggaggctgaggtgagaggatcagttgagctcgggaggttgaggctgcagtgagccaaaattgtgccactgtactccagcctgggcaacaaagcaagacctgtttccaaaaaaaaaaaagcagtttactctagtgggagaaacgtgtagatgcatgcagtgtgtatcagatacagtaatatgttcagggtagtcaagtccagcagcagacgtgagcagtcttggaaaaatgactgcatgattgctaagtgattgggtagaagtaagaaagtcaagacccaggttagagtccaggccttatcacttgtcactgtgatcccttaagtttttttgtctcttatttctaacttcagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctggtgagtaaaactttattttaaggtgtctgaagtgggttcatttatctctaggcccaagaattaaatgtaatcacaaaatccaagaatttcattcttagttgacaaacaacccaatagaaaactggacaaagaatatggagacagctcacagaaaaaggaagtataactagttgaaatataggaagcaatgctaatctcgctctgaggggtcaaatactgacatctctcttgtcctgccacacgggaaatgtggctgttggcaacggtgtagagaaagaaccacacttgtgcagctcttgctctaagggactgattcaagagacagttttagtaaagttacaagcatacctacacttggagctgttttactttttatcttacagatgtgtatatttgtttaaagttgcaagagactataacaatgcacatccactaacaggactaattaaattgatatatcacaatagactactgtgtagccattaaaggtttccaagttaaagaacagtatgtaccattctgtactgccatgagaaaaccatttcttcttagaaggggaaatagtggttggcaacagggaagaggaaggtcaaattcctttctgttttgtaattctaacttatcctttactcatgtacacattaaattttagttgctggctgggcgtggtggctcatgcctataatcccagcactttaggagggcaaggtggttggatcacctgaggtcaggagttcgagaccagtctggccaacaaggtgaaatcctgtctctactaaaaatacaaaaattagctgggcatggtggcgtatgcctgtaatcccagctactcggtaggctaaggcacgagaaggaggttcagtgagctgtgatcgcgccactgtacttcagcctgggtgacagagtgacactcaaaaaaaattttttgtagttttttagttgctttacctgtgctaaactggaagtaaatgtggagtcagtgatttaatagttaaatagaggcagtaaagagctactactgcttggttaatttacacatattgataataaataataatgatagcaggaatagatcttattcaactccaggaaattcttagtttttatgttgcctgatttacatcatacatctgcaaacaggctaacgtgaatatctgacttgtgtgttcctttgtcttgtttcaatgtgtctagattgaatttgccaggaagaatgtgtatagtgccaatcagaaaattcaggatgctcaggataagctctacctctcatgggtagagtggaaaaggagcattggatatgatgatactgatgagtcccactgtgctgaggtaagatgactgggacggtcatttgttggttgctgaagaagttcttatcagacttttcatttcaatttttccatactatgtcttagaatactcttctctatcaaaaggttgaacaataccatgtacataggtggctagttatgtggcagaaaagcaaaactaggcagcgaataattttatctaacaacctatgagtatacatatgccccaagtgagatacaactaaatgagaaacacaggccttgccctcataatgggtacagactaacaggggatacagccagccatgctgtcctattttgtgcctttttaatgctccttgcagaagagggctatctcataggcagtacactcagagtagccaagtccggttgttgtttaacggcataaatacaggtactattggctgggcgcgatggctcacgcctgtaatcccaacactttgggaggccgaggcgggtagatcacgaggtcaggagatcgagaccatcctggccaacatggtgaaaccctgtctctactaaaaatacaaaaaatgagccaggcatggtggcacgtgcctgtagtcccagctactcgggcagctgaggcaggagaatagcttgaacctgggaggcagaggttgccatgagccgagatcatgctactgcactccagcctgggcaacagagtaagactctgtctcaaaaaaaaaaaaaagaaaacatatgggaagactatctcaggcagccttggagtgggggtagttgagtcacattgctttctggaagagatgaatggtaagctgagaactaatgggtgaataaactaggtgaaagggcaataaggtgaccaaggttccagagggaaggcatagcatcttggctgggtgcaatggctcacacctgtaatctcagcattttgggaggccaaggcaggcagatcacttgagcccaggaattcaggaccagcctgggcaactgtgaaaccccatctctacaaaaaatacaaaaattagcagggtgtggtggtgtgcacctgtagtcctagttgctcgagaggctgaggtgggaggatcacctaagcccgagaggtcgggtccgcagtgagccatgattgtgccagtgccctccagcctgggcaacagactgagaccctgtctcagaaagaaagaaagaaaagaaaagaaagaaagaagaaagaaagaaaaaggaagggaagcagggaggaaggaagggaaaagaaatatcctcttatagtcctagaaagtggttctttgtgtcccaaaagctctgaagtcaatatgaactgtttgttcatgtcttgtcattttatttgaggagggaatatatacattacactactaacatgaaggatatttccattcttttgggtctcccctacctaatatgtttcttcagtttaagatgatgaactttggagactcaggcactagttcgaatccctacccagctgttttccagttgttaactgaagccatctacttaaactctaagcttatattcatatctatgaaatgtgaataatactgctgcactcggcattgtaatgaggatttttaaaagccaaagaatccacatatgtggtggacacataaccagcctactgtcatcgaactaatttatacatagcactgttggatccactgctaattttaagttttatttttagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaaacctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgcacttatgttctcattctatggccattgtgttgcctctgttactgtttgtattgaataaaaacatcttcatgtgggctggggtagaaactggtgtctgctctggtgtgatctgaaaaggcgtcttcactgctttatctcatgatgcttgcttgtaaaacttgattttagtttttcatttctcaaataggaatactacctttgaattcaataaaattcactgcaggatagaccagttacatgctgtttgttccatatgctttgtgtgttgctttcgtagagctgcttaacctgcatgacagagttattatacatacatgaatttcaattggcctgttggggagtttggcagagtgagaacattagaaggctaatgttaaaaatgggatgcttggccgggtgctgtggctcatgcctgtaaccccagcactttgggaggctgaggtgggcggatcacgaggtcaggagatcgagaccatcctggcgaacacggtgaaaccccatctctactaaaaatacaaaaaattagccgggcacggtggcgggtgcctgtagtcccagctactcgggaggctgaggcaggagaatggcgtgaacccgggaggcagagcttgcagtgagccgagatagcgccactgcgctctggcctgggcgaaagagcaagactccatctcaaaaaaaaaaaaaaagaaaagaaaataggatgcttgataacaaattaaaaaaaaataggatgcttgataacagatttaaaacaaattaaaagctaatgtgcatattcaaattttactaggtgacagttggccctctttgtttgccaacttactggacccctgtgagtgggtttttaaaccagtaaaagggcctagtcatgtctgactacctcactgaaaaggaatcagagctgaaaggaagtgagtgattgtttaaatcagcatcatgtaaaggcattgggcatttcttgccagggaaccagttaaagcgtgagtcctaaagggagattcttcactgtccagccttagctggacttaacttactgtgttgtcattttgggaaaaagtcactaacctcagttgttgttggggacatacgtatagaagaccatgtgagactaattagaagtaaaaagactttaagccccctgtagaaaaaggttcttcttacctcctgcctatggtatccagacttctagtccattcaacattggttatttaggaaccatcctgaatctccttgtcacacagatgaaatatgtcaaactagtttttaaaagtgagtctcagaacttgtgaaataggccaggcgctgtggctcatacctgtaatcccagcactttgggaggccgaggcaggcagatcacctgaggtcagggattcgacaccaccctgaccaacaacgtgaaaccctttctctacaaaaaatacaaaaattagcctggcctggtggtgcacgcctataatcccagctacttggaggctgggcaaggagaatcccctgcgtctgggaggtggaggctgcagtgagccaagattgcgccactgcactccaacctgagcaacagagtgagactctgtcttaaaaaaaaaaaaatgtgaaatagagctacatgcttctggctgtccctgctaaaaggtaagcagggctgccctcagcagaactgggaagtctaactcaaattagtctctttctatcctggttcacccctttctctccatgaaaacaaggaagcggcacataactttacatgttcctt

SEQ ID NO: 15481 - DNA, 10143 bp, Human
ggactgaaaaatgttggttgctagaaccatcaagtgactgcaacatatcagatgactgtcttcatcataccggttagcctttgagtgcttcacatgtcttatatacattaccttgcttcacaactctcctggaagataatggtcatccccacttagagatgaggaaacacaaggcccagagagggattacaagccaagcctcttactcccatgccctggctctttccagaattacaccagcattccaccacagctgcctgcacccagagtgttgggtatgaatcgggtacaactggtgagatccaacagtgcctcatcattcgacttgggtgcacacgggagaaggtggcattaaaatccacagggaactcaaaatatggaggcaggtagatgaagattcaagagtcaggactccctgtgaagtgagtgacacttaagagggggagtggagcccagatctgtcacacatacggcgtgggggaccccacctaccactggtcctcagcacctggagacccgagccttcagcaatctgggaagcatgaaagtgggtttcggtgcacagggccacgcctccgccgccagcagcccagcgggagcgtctgaccagtctcgccctccgagaggagagagaggcggcccaggacggtctgcttagaggctctctcccctgcagagctgggcccaggcataggtcagacgcctccaatacagtccccagggcagcgattaaagcggagcaggaactgcagacccgaccgggcaggacaggtgcagcttctcggagttgggggcgggaagtctcgggctgaggcccacgtgcttcgccttcgccccgcctctaccctcattggttgaagccagattgagaggaggtgccagaaaaaaaactcctccctccaacctcattggccagctcagttctgaggcagctctctggccccgtctatgggctcgcactacactccaattgggtggttgttctcccagacggaaactccgccccacctgtaccttggaccgctccgccctaggggcggttccagcgcgcttcgctaatcggttctatgctcccattggtctgctttaatgtgaagggcgggtcctagctgattcgctagccccgccttgcgttcctattggctgctcctgctctgcggttccgatcccgcccagcaccgtcccccaccccccgccgcccattggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcaggtgagctccggggaacccgggcccggatgcggcctcgccctcccgcccctccgcgtccgctccgctcaccctcggccctgtccccccagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggtgaggccccgggctcgctcctcccgccctgggaccccacgccctcctctcgggacgggcatcgggaccctccgccccccacccttcccctcgggacaggcatcgggccccgccgccaccacctttccccacgagacaggcattgggcctctctgccccccatcccttccctcgggacgggcatcgagcccctcagcccccacccctcccctcgggacgagcaccgggcccctcagccccctacccctcccctcgggacgggcgcggggccccggctcttttacctctgagcccgcggggagtgggtggagggggaggatgggctgcggcttcggcgccccctcctcagcagccgcccgcctccaggctgtcgtgaccctgggtgccgcggcggggggagtgctgggcggctggctggtggaccgcgccgggcgcaagctgagcctcttgctgtgctccgtgcccttcgtggccggctttgccgtcatcaccgcggcccaggacgtgtggatgctgctggggggccgcctcctcaccggcctggcctgcggtgttgcctccctagtggccccggtgagtgtcccgtctctcgagtgtcctgtctcgcggcctgagaccgagggggagtgggacaaaccgctccccaggcctgggggcgcggctccccctggcgggaccttctgggtgccaggcttgaagtccctgcgttatctcgcggtccctcccgtcgaccctgggaaggatcctactgttctctccattttacactgaggtcatgacatgcagtctcggaaaggtgaagtcctttgcccaggcgaggtccacagctagtcagaggggaagcagttgcaggaacccagggttgtcccacttagccgtgcccctcttttgctctgcaaacctgcggatgatccacaggagcccactccctacattttggttttcatccctggcttcgggtcaatgactgcaattagcaggaagttcctgtcctgatttctcttggggcaaaggctgctggcctctgtgttccccttcccttctcacaggccagcccctctggcttccccatcttccccctttccccctcctgacccaggctgcccacttgggagccccgaacatctgggtcaaatcctggttctgccactaacctgagcagagtgcctccctgggcctcagtttccttctctggaaaacagggattatggcattagcccctgaggtagtggtcaggattcagtgggactttggatagacagcccctggcatggcttgtagaggactggatcctgacagcttggtgacccatgaactgcccccagccatgggcttggacaatatctcccccaagtgaggttgaaagcagccactcaggcccctccctgggtgctcatttcaccaacgtttgctaaccggcagcagcagctggaccagaagagggtggggaagaagctgggccttttatgtctttggtttttttaactgggcagaaacacacctgtgttaggggcctaagctatggaataaccttagatgcatgggtgagggcctggtggcctgtgggcccaggagggagctagtggcagccactggtagtgaccgaggcagagagttcgtgcttctagtccaaggccaccactcaaagcgtgggccctgggctaggatcctgggtgggcgtcacgtggagctggttaacaaggtggaatctttcgcctgtccagacctactgcatcggaatctatgatttatccagggtgtctgtgcacattaaacgaaggcttgagaagctctgtgcccaccgcctctcgtcatcatatgcagccctctccgttacccttaatcccctttaaacacctgccacagatctttcagtggtggggacctggggatggctctgctcacctaggcaggttccactaaggggcttcagggcctgccgtaaccccctgcaaggactttcctcagctctgaatggctgagacctttccattttaagaactcttggagcctgagtaaagcctcatctttttttttttttttttaatttttatttaaaaatttcggagtttcgctcttgttgcccaggctggagtgcaatggtgggatcttggctcaccgcaacctccacctccagggttcaagtgattctcctccctcaacctcctgagtagctgggattacagatgtgtgccactaggcccagctaattttgtatttttagtagagatggggtttctccctgttggtcaggccagtctcaaactcccaacctctggtgatctgcccgcctcggcctcccagagtgctgggattgcaggcatgagccactgcgcccagccataaatcctcatctgattgctggcaggtctacatctccgaaatcgcctacccagcagtccgggggttgctcggctcctgtgtgcagctaatggtcgtcgtcggcatcctcctggcctacctggcaggtatagttgtcattatctcttgcttcctgtttgtggtcatgtggccattttacagatgtgtaaacagaggttcagtgaggtcaagggacttgtctgaggtcacatagccagtgcccaacatgccaggctcgccttcctgggaccttgggataggtgagtctttttttttttttttttgagacagagtcccgctctgtcgcccaggctggagtgcagtggtggctctctgcaacctctgcctcctgggttcaagcgattctcctgtctcagcttcccaagtagctgggactacaggcatgtgccaccacacctggctaattgtttgtatttttggtagaaagggggtttcaccgtgttagccaggatggtcttgatctcctgacctcatgaaccgccaaacctcagcttcccaaagtgctgggattacaggtgtgagccaccgcgcccggccgataggtgtgtcttatgactgagttccagggacagctggagaaggtgataccctcagctttcctgaagccccctctaggggtgtgggaagggctgactgcttaggtcagtaccttactgtgcagtgacaaaccagagggctccagaggtgggtgggtccctgtaaaaatcttcagcccgggcgagtaaagggctgagcaagtcccctgagaatgtcagtgccagattcaccatgtcggcgagttgcaacgtgaaggaggccggggtcctggggaccccgaggggcaaagctgggccagcatgaagaaacttcaggagacaggtgtgttctcattagaaagaggccaggctttagaggccagacccagtggctcacacctgtaatcccagcactttgggaggcagaggtgggcggatcacttgaggtcaggagttcgagatcagcctggccaacatggtgaaaacccatttctatttaaaatacaaaaattagccaggcgtggtggtgggcacctgtaatcccagctacctggggggctgaggcacaagaattgcttgaacccagaaggctgaggtttcagtgagctgagatcgcgccactgcactccagtgtgggcgacacagtgagactctgtctcaaaaagaaagaaaaaacaagggcaggcttcaaatctgaccatcctgagtttggggatagcctctcctacgtgctgtgtgaccttggccaagtcataccacctctgaaagcctcagtttctctgtcttgaaatgggcataacctcatctagtccagtacctgtccattaaattaattgacacatgaaaagtgcctaacagtgggttccaaatgagaattgtcaagggatgacttgagaaccatggggatcatcggggtaggaggcctcgggggcctgacgggctatggcctggcccagggcacaagccctctgcatcgtcagggcggatgatacacaggtctttggtgtttcatttttacccacttaaccaccctaacaaattcagaatcctgccagcgatctggctaccttgggagacctgagtaaaccaaagcccccactgtgtgcaggtgttgacattcatcatttcggggacaggtactgggtgtccacccacccgtggcactatcttcagctcatcttaatatgtgcttgttgcttctcctgcctttcctgatcaatttctgtgagtttcgatccactggggtgggtgaactctgataactccacaaagtgacatggtggtggcacgtttgcttcacattggggcaatcatgttccaacgactagacttcatagaacaattgtctgcacccccagcacagaagaaaaatagggacatcatggctaccttagaggtatttttccactgggaaccagggatgggtaagccttgggcttaggaaaaattagtaattagagcagcaatgccctagactcatttattccagggcccctttgtaagagaaccttttaactttatataaaactaggtaattctgcacttatgctgttcttcatacgtcaagacagcaaaatcctctcacctctctactttcatgtatactttgaatagataatgcattcaaatgactcaacactcaagtgccagagtggagagatgtccagtgaaaagcttcctccgcctctgtccctttcttgtctgggggagtccccattgcctgtttcttggtagccttcagagagtctgttcatatgagggacatgcatatttatcctccctcccccacctcttctacaaatggtgccacatcataccatgcggacacgcagcaagcacctcatccttcatttttgtggctacataaatgtttcgttgaacggatgcagcctagtaatgtccgcgttgtcatacccactgtcgcttccgcagctggtgtgattggcccgtgccatgtgccttcatgaacagttgtgataatggcaatgtcagtagcgaacatgagggcagatgtgcagaggcagcgaggccccatctctgaagctgagtctttgaggctggcaaggcccaggctggctcaccctggctctgacgccagcctcctccacccaccccccgcaggctgggtgctggagtggcgctggctggctgtgctgggctgcgtgcccccctccctcatgctgcttctcatgtgcttcatgcccgagaccccgcgcttcctgctgactcagcacaggcgccaggaggccatggccgccctgcggttcctgtggggctccgagcagggctgggaagacccccccatcggggctgagcaggtgagaggctggaaggcagagctgacaggagtgggacagcagtcacgggagggtagcacagcctgttcccaaggccacacacttggggggtgggggacagggaggtgcctatccaccctccaccctcagcgaggacaggcccagtgtgtcctgtctttgagcaggccaagacagctggagccccacggagctgggccctggcctccaaagtcaccagcaaagcccgagctttgacccttactgtcccaggaagagaatggccaggcctggtgggggatacagaggcagagctgaggacttggatttaacaaaggagttgcaaggcagggtagagggctaaaagtctgggttttagagtcacccaggcatgggtttgaagcccccacgctgcccctcacctaagctttagctcttcacctgtgatgtgggagtcagcacctgcttcacagtgctgggtgggactcagtgggggaaaggaaggcggggcttagggaggaggggggctcagtggggagggtggggtcagcgaggaggatgggttcagtggggaggggagggtcagggctgtaggaggtgcttagctagggccaggcccagacctgaggcaggtgctggatgtgttggtggtggcagggatgagggcagcagcttgctctttgcccagattacctctttgtggctcccccccacctatcaggaagtgccctgggcaggtgagggtcatctcacctgacacatggggaggctgggacttgtctgcacacctgaggacacagggggtgctgggatgaggagccaagacgtgggagtcagcgctccccaagccttaggacagtagacccccagaggggggccgcttgcgggaggggagagagaaatcctgatggccagtatccgtcagagcagagctttcacctggccctgctgcggcagcccggcatctacaagcccttcatcatcggcgtctccctgatggccttccagcagctgtcgggggtcaacgccgtcatgttctatgcagagaccatctttgaagaggccaagttcaaggtaaaagggccctgcctggcctgcctcgtccagcccccacatagatggagcttcctccccaagcccagggcccagccatccagcacaggcctggagagggagggacccagctctcagctggcccacctgacctgcctgggctctgtctcccccaggacagcagcctggcctcggtcgtcgtgggtgtcatccaggtgctgttcacagctgtggcggctctcatcatggacagagcagggcggaggctgctcctggtcttgtcaggtgagggttcacccctgtgcagcctccccgccatgggggggagggccttcgccaaggccaccacactgcaggaggaggacagggagcatttgtgatgacaaacatcatggactaatgcggccatgatttgacagcagcttgtcaccaagcactcactgcaggcctgtccatgccagtggcactcccacaccacgcctttaacctctgtggtgaacccaccagaaggcactctcacagccccagcttatgacgggaaaactgagggccaggaaggtgaagtgactcaagagtttgtgggtccttttggacaagtgactttacctctctgagcctcagtctccccctctgggaagtgggggtaatggcagtgcctccctcagcaccattttgaggagtgggaggtgatccacgtgaggccttcagcaagagctgcggcccacggacatttggtacccagcagctgctgcgaagacgaccgtcggggctgagggttactcgctgctgcttctgtgccggtacctcccatttcctcggcccagagggtctgctccgggaactttttgcagttcgctgaggtccaaggcggggtggctgccacccagtcagggcttctgcggccaaggtgccagaacaccaagctggccgttctctgggagccgggcctgcccctctcagaggcatccaggccatgctgctgcgccctgggccgttccccgggtgccccgcccactgccgccctcccgcctgcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggtaagggggcctgtgggaggctgggcgaggagtgggaggtgatccccccggccctgctgtggcggctcccggcaggtggggtcttccccagcctcacctctcctctcgtaagttccaagctctgcatttctagctctgaccacatgcagctgtggaactaggcccctctgcgttcctttcacttaatcccctgagcagccctcgagcaggccccgttgtgaccccatctcagagacagagcctgtgcctgaggagggaagaggctggccgaggccttggcaggaaagcatggagctggtgggaccacactgggatccgggaccccacagccccacaggctgggaagctgggtctcttggctctgcagcaagctgaggagcccagccctgcggaccctgatgcctgtcttgcctgtctcgctcccacaggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggtgagggcaggctccaccagcaccgcgttcgtgcagtcagccgagaagcactttctaaaaccacttgtattgcagaagacccagggtcgtggccttacatgcagcctgagccccaccatgcctgggccactggccatcttgggcaaggcgacgtggaggcagatgggctaggccagatggggaacccaggctgtgaccccttgggagtcctctgcctgtcttggcagtcagacagcacagctggcctctccccttagtgaacgtcaggaaagcgggccttgagcctaaggtcttacatgggaagagttgacagggctgggctgcagccccaccctggctacttccttgctgtgtgaccttgggtatgatgcttaccttctctgagcccgcttctttggctgaaactggaggagagtaacagcagcttgctcttaagacggatgggagcattaattcagttcatcctgttgctgccttctcacggatggactggcacaggtgtggcccctgtcccgggg

SEQ ID NO: 15482 - DNA, 24582 bp, Human
atgacttcaagactttcggcctgagcaaccagagtggacatttatgaacacaggaaaaactgggatgaacaggttgggttggagatacggggaaaaacgagttcatttctggatgagttgagatacctagcagatagtcaagtggaaatgtcaaaaaagcagctgtatgtatgagtctagagtcctggggagagttccagaaataaatgcggatgtaatcagtacttgagggtgatcaccaacgtgacctctggatgagatgactaaggtaaagaaaattctgaggactgagttttgggtcccctcaacagtagagaaaggacaggaatatgaggatgaaccagcacaggctctgaggaggaacagccggcaagacaggaggcagggtggcgctctggaaaggaaggtcaagaagggagcccaactgtatcccacagtgtgagagggaaaatattaatgaggatcaagaaccagcccttccatctggcaaacagacaggggatcctgtctagggcaacctagaatgaaggggagcgggcaaagcctgatgagggtgggctcaagagagaccaggaagagaggaactttctggaaatggtgagtgcaggcatctctttggaggctttgctaaaaaggggagcagagaaatgcaacaagagctgcagaggggatgtgaggtcaagagagggttttaagttgagagaaaaaaccgtatgattataggaaaaccatcctgatgttggggagacggtgaggactgctggagcaaggccctcgagtgggcaagagaagggatctagcacgtgtcctcccctccctcttggcccatttaactcctactcattcctcaagggtcagtgtaaagggcactttctcagggaagcattcctgaccctctaggtcaattccctgtaatactcctttacagcatgtgacagttgtgctttctggcatttgggaatggcataatgatgtgaaagccccatgagggcagggactggctccatcctgttggtagctgtatccctagccactagcatgctgtccagcaaatcacaggtgttcaatcaacatctggtgaaaggatgaatggtccaagaatagaagtgaagcaaatctggagacacattctgtgttctgctcccttctaacttaatcacgttgcagtggtcaggactgtgctgtcactggctactgcaaatatttggattcagaagagctcagttgtttgttcctgttttggctctgtagcttagctaacacagtgaccagagccacgtaactggacacatccttccactgatattgtccactaaaccctgaatgtattccataacatgtctaacgattcatttgtttatcaaatatttgcccaaagtgcaatatcctgggaatacagggttgaatcagacagacgacatgccctcatggagttagaatccaacagagaagatcaaacagaactgctattcagcacagcggtgatgggtattacaaggggaaagttcagggggtgtgaaagtatagaatagggagactcaacagtctgaggaaccaaaggtagcagaagagagagaccagaaaaccctccctctgcctcccctccccagcctgaagctgcctggatacgattctcaggctctaggccaggagttcagcaagggggctgcgggcattggagctggctctgggagtagcagggccatggcctcctgccttcagatgccctgagaccctccctcttcccttctacctctgctggggcttgcctgtctcctcttgcttccagaatggctgcctgttctctgactccaagagaatataacccagcatcctgaagcagagtttttggaaagctctgcctgcctggcgagaaggctgggatcactgatggcacagggcactgacagtggtgggaccatcactgattctcccctctgtttactttcaggctttcatagattctattcacaaagaataaccaccattttgcaaggaccatgaggccactgtgcgtgacatgctggtggctcggactgctggctgccatgggagctgttgcaggccaggaggacggttttgagggcactgaggagggctcgccaagagagttcatttacctaaacaggtacaagcgggcgggcgagtcccaggacaagtgcacctacaccttcattgtgccccagcagcgggtcacgggtgccatctgcgtcaactccaaggagcctgaggtgcttctggagaaccgagtgcataagcaggagctagagctgctcaacaatgagctgctcaagcagaagcggcagatcgagacgctgcagcagctggtggaggtggacggcggcattgtgagcgaggtgaagctgctgcgcaaggagagccgcaacatgaactcgcgggtcacgcagctctacatgcagctcctgcacgagatcatccgcaagcgggacaacgcgttggagctctcccagctggagaacaggatcctgaaccagacagccgacatgctgcagctggccagcaagtacaaggacctggagcacaagtaccagcacctggccacactggcccacaaccaatcagagatcatcgcgcagcttgaggagcactgccagagggtgccctcggccaggcccgtcccccagccaccccccgctgccccgccccgggtctaccaaccacccacctacaaccgcatcatcaaccagatctctaccaacgagatccagagtgaccagaacctgaaggtgctgccaccccctctgcccactatgcccactctcaccagcctcccatcttccaccgacaagccgtcgggtaagtgcttctgggatcgtgttacatgtgggtctcagagccaggcaccaggcttcccttggctgtgtccacaaatggggaaaagccatggccagttgaagccaggccaaagacatgcacaatcccccagcaatcccttgggctgagctgctggagccagcagggtgacgggtggcaggggaaccacattccttagatggatcctcaaagatattaccaaaaaatggagtttcagaagagggcaaacactctctggtttctgacaggaaagaacccagagcctgtagttttctaggctctgcatgagatcccgtgtgttggcagatagaagagaatgtctctcctgcagctcatgcactgtgcctggcacagggttggccttctgtaaatgttcaccaaataaacaatgggccaaaagaaaagaaagtattacccatgttaagaatatgataaacacattgtaggggctgggcatgggaaggagtccttcctaaagcccacacacttcctagagtctgctgctgtctagaattttcaatgatgcttccatatgctcttacatacacgtttcatcttaaaatacagcaattctccgaataccgttatgggggaggaatgggattgctggcaggttttaaagcttaaccaagatactggcaccggacatttccatgtatgttacataattaactcctggagctccttgcggacaggatgaataacttgctaataggcttaggatgttcaggctagatttgcattcaggtcttttcactttaaatctctggctgacttctctatgctctaggactctaggaatcatcatttctggaagaagcaggccagaggctcccctgtcagaatgtcagcacacatccagtcccctgaagctcagccccttgttcatccagaacacctgagccttcccagtgggctgccatatgagaactatattcatctctgcataaatgaaccatgtatctactccaagtcagtgctttcggtaccatttcattgtataggcagggagagatttttactgaaaatatcctgctttacacttatttcacacttttaaaaataaccaccagtactgggaatagcagcttcttgctaattccaaagaggggctgaacctgagtgcaggagggtggccagtgcagaggacaagggcagcattgttttcagatggggtgggtgaggtgagctaaatgcaaagtgagcatccactgcagcacctcaaaggaaagacctggcctgggtgcaggattgagagcaggcgctttggagtaggctggcttggatttaaatccggtttccaccactgattagctctgggacattaggcaagtcactttgtccccctgaggctcggtttcctcatctgttaattgaggatagattaaaatagtgcctgtcactttaggaaacgaaatactgcaaaaaacatgtttagcacaatgctgggtccacggtaaactacaagcctcctttgatctaggtcttttcatcttaaaacaaggagactgaaataaacagtcccttttttagctctggcgttccatctgtacacgtgtctgctttaaatcagaagctctgaaagagagggcagggtgtgttaatttgtcttgatagaataccgagagggtaaaacgtgcccttgggcaccaaacaaaggctcagttgaatgttgttataaccctgactggagacaggctggactcaatggttactcaacagatctcctctggcctaagtgtctctggtttctaactcaaaacatttcaggacattcctgggcttgaactaagctggcagatacatagtataggaataagacctgggtttgcatccatgctctaccccttggttagctgttcgctcatgagatagttatttaactcttctgagcctcaattttctcctctgtaaaatggggacaagggtcataacctcacagtgttatgctgtggatacaatacaatcaagcatgaaacattatgtcatgtagtaaagccaacatttgctgagcccctactacatgctagtcgcagcactagacttggggaagtaggtgacaattgtggtccctgacctccagaaactcagtctggggtagacggcaggtgcatgaatgcatctgggatccgtccaatgcccatgatttctagtccctaacatcagcacatcagatctgacaatggatttctctgggagggagtatccgtcgaggccaaaatttctaaaatcaggaatgcagtgaaaactgggctgtctgatcactgtggtgataccctggtgtgctaagtgccctgggggacagtaaggtggcatgactaattctgcctagagggaagggagagattagatagacgtggcacttctttgttgcatcttgaaggatttgtaagattttaccaggcagacctgggagttgggaacccaagtgactagtgggtccctgatggagatgagtctgtgcaagggcccaggggcacagttctattcctggcacctcaaatggttcaatctcctgcttctttgtgttcacaacccagtgtgggctgtgtgtatccaagtgtcctgcactcgcccgtcttttgtctcccacttaagaaagcacgccgtcatgggagggaatggcagtgatttcatcacagagataactggaatgcattagaatttatccttctttgttacgcaaggatccccaaatgttggtacttgctcattaccagtagatttcttgtgacccatctcaccactgagctcccacacaaggcgctgccagctgggattgagtgcctagctgtggaagatgaatgggtagacagagcccaggaagagagcagctgggggagggtcctgccctctcctggtgttgaggactaaactgggaggaaaaaacagatggtctctctgcacggaacagtcagggcatccaatgagcagagaacattcttatcaggtctgttcagagagcttggggcaggttcttatcctggaagacaaaacactcttctgtgctcttacccaacagatcctttgttcttagggacatcacttagccagaaatacctttgcaattaaacacctttgcatccgagccttggcagcttccaaacctttcactcagcagcctcagagccatgtgctcttttcttcgtctgcccacagcatgcccttccccaggggactaagggagccatggctgcttatctgaagctgtaccacaagcctgttcccagccttactgagacagtaacagggtggtcccaggccaggatggcctactgagagcctgagtgaggaggcacaggcagctcctggcttccctggctcctcacctgggctttgtcctgtgtctctcaggtctggccagacccaaaggcattttgattaggatgattctgtgatgaggcctgggccaaatggccctatctgtggtcctctgccccacctatcctgctgctgctattagaagaggaaggctccaggggtcattctctaagaggcaaaggatagagcaggcacctgggttctgggaggcctggtactgtttctcaggccacccaaggcagagccacacatttgccagccctcctgcacagtgcccatcccagagactgatcagggaggaaaggacagcgccaacagcagctgccacagacgggctttgtcagaaactaatctttaaagaccaaaaggagtgagcacttttagctgttttctctcctgagaaagagaatacaaccagttcactttatttctcaatgagtgaagaagaaggggccataaaaccatgaaatactggaactattaggggcctctcagatcccctagcatggccttcctgtaacagagcctgttggtggcagagcagagatcgaccctgggacttgtaccttgcaggatattgaggttcatagaggtcaagtaacttagccaagggtacacagctagtaagtggcttggccaaggctcaaaccaaagtatgttttaactactctggatattgcacacttccacgggaaggctggaggggaactggtgtaaaaatcaccccgtgaatgtctgatttggccccagctgccacagggacctgaccttctatctctacttcctgaccttctagctctacttcctggtaccacgttccaaacagttccttaaaatgagctctgggaacaaaggtggtagatttgttattagaacatggttccaatgacacaaaacactgtcgctaccaacccaccaacatcatgctccccctccctaggcctagcaggaaccagccaagctccccagtagaaagtacaacgtgcacctgactcccagcaaatggacccaactgaagtctaatttttaatttttatcaaatctggacatatcctctggggttccttctactcagcatttcaatgtatagctaagtctttcaacatatagctaagtgtgaagttctgatttctttaaatgttagccctgactgtataaatgtcagtagacatgaccttcccttgggaccacatgaggaggtccccacattgcttcactgacaagagtgctagcaggaagccaccccatctcacaacagatgggctattgggctatggccaggatggcatggacaacttgaacaagagtgttttcctagatggattttccacctgtattttattccaccctataaggtaggaaatacgtacacgattgtggttccccagcacaatggtatgttttaaaacagagaaatatatgatgttgtagctcccattctttctggaggtcaagcaagcaaccaggtgaaaaggtgtcaacccatgtgtggctgggtcagcttcagtaggctgggcatccaggcccaagcactgcagagaggtggagaagcacagggtgtgtgtggtgatggtggcgagtgagggtgactctgcccatcctgagtcagccttcaaggtcacagaggctgagggaaaagcccacacaggtctcctgcctccagagcgtgtgctgtttccactgtacaatactttcttttattctaaaaggttttgttaaacaaaataagatttcaaattcagtacaaactacataatccagtgatttctcaaagagcactctttgctagcttcttcctaaacaaaatctactctaggaagatggcccacctggatgatggttccaggagggccagctcccttattgctttgctttctcttcctcctcttctggtaccttggggaactgatcacaaagagccttttgagggtgatggaaagctacccctccattcctcaggcagttttccaaagatgacacttggctaaatgctcagggtatttacagtcataggagataaactatcaacttgttactgttaaaaaaatcttgagatctgggatcttgatgcctgaaaatcccaagattggtacttggcaaactgaaagaaatctagaaaaccctagagatcaggcatctgtggccagctaactggtcatacaaatggattgttgtggtgaacttgtatagtattaatcctgagatgctgtccccctccacccccacccccacaaaaaaaataaataaagtagtattaagttagcctcatacaaatgctggcaccatgctcctggacttctcagcctccataactgtgagccaaataaacttcctttctttataaattacccagtctatgctattctgttatagcagcagaaaatggactatgttcagtcttgtaaaagtaatgaagtatatacttccagtggtttatacccacatcagtgaaggatgcaggcagcagagacctcttgatgggaacactggagatgatctttcctactatccccgcatcaccactgcctcaacttcggctctccctggcatgaatctggtcaaagattatgctgaaaataagcctgatggtcctcatcttatatctcaagatgagcctgtggaactacagggcctggagtatttatgtgatcctttgtttaaaaaaaaataagttacttttccctgatatttttgaatacagtaagtcaaaactactatacacacagagaaaaatcttgctaagacaatttgtttacgttataaatgcaacagctcctaaatgttgaaattaagtatcttagatggtatgtctagagtagggtccaaatgaacaaaaaatccactcatctggcaccatcccagacataatgtgcagagagaccactacaaactgtccaggctttcccacaaagcaggtttcctttgccagggtttggtctggatgtggattatcatctgttgtggggtctctctttccagatggatttattattattggttctcagctggaaagcacagaatgaaggtagcaaaggggatgcagctcaggatggtgaaggatggagggtgaaggatggagggtcaaggatagaggattgaaggatggagggaggcacacagagcattgagggactcatggagtgagcctgcaagggttcctgcctgaaaggagcccacagtcttatggggacacagatccccaacaatcctaatgtggtgtgataactgcagcacagaaggtggacctgagttctaatcccagatcctccactttccagtcatgtgatcctcttgagccctggctttctcacaggtgcaggggcttatgaggatgaaatgaaacggtgtgcaaagcacatggcaggtgaaaggctctagatacatgatcatcaccattcttaccttattccagtagagataaatatacaaagcattttgggaacactgaaaaggataaagtagctttcctggggttggggaaagcttcctgaaggaggtgatgaggaaggtaagggccttgtggtgctctcagaaccaccaccagtgatagtcaagaaatcatgaagacaagtcttggtgccagacaaatgtcctgctttcagaaaaagaatgcataccagaaatcacatacaactggcttgtggtgaagccccagtaaaattatagaaaagagtacacaaagggttcgtgagcatttggaagattaaaaggtcaccaatgaaagccgacataggttcttaaagaagaaaccaatgaagctgatcccttccttggaaagggttaatacactcgccaactatgggactgctacctgtccatatctgtggattgtagtcatgggtctgataagttcttccatgatgtgcctgcaggacagcaccacagtctctgacagagccatggccactctcattagtgtgcctgtggaaccctggggcactgcccacctctacatcagagacctccctcacccaggaagccttgggtacaactggccactgcccccagggagccaaggtgagctgctcacctctgtacacagtgagaccactaaagccccttctaaactcttttttaaaatgtctttaaagcccctgtttctcctcctgcccaacagcgctggtggaaacctaagagcgacgcaatgctttggacagtggcctctggaaagtagtgctgcaatgtctgtttctcccgaggtcaaatgagcagaaacaggacctttataagccctttctgggccctaagagctcttacttgagaggcctcaggctgtatcacatgcattgaaatgacctacctcacacatttaatagaatttttactggaacaattttgaaaggatttaatacttttgcttttaaaattatttggctaagagtaactcaattaatttatggttggatctcatttctcagtaaacatcaagcatattcaggaattcttgggaagtgaaaaaaatctaacctacaagttgttttcaaaagtagtaacattttcatgaagacaaaatttaacaattaatgaacttgacaagatgtcacactttgtagtaatttaattacatacaataaattttgattttgcagttttcttttcatattttagagccagtaagtctttttaggcctcaaacattttcatcaactcctgaaacactcattggccccaggcaccatgcccatcgtttgagggctaaagcggcctgaaagcaggcacaagcatttggaccttttccctggaatgatcagaaatgacatgtgtgatatcaactctgaggttctgcaggaactgaaatgcctttgggaccatacaagctattcctgtgtttaggttattgttttgtactctggttcgctgaaaagcagtgattgacatagaatatatatacatccataaccagaatcttattttgccaagcctctggataaatgagattcgaagacccccaataactgcttctcactgtagccacccctcacaccccatcccccgaccctgtgtgtctgttctcctgccctcatggggtgcccagtgagtcctgatgctggcctgggtgggactctcacctaagcaggccacgtgccgtggcactcagatgcattaatttgggtaggaaattgcagatccaatttcaacagttagtcatttctcctgttagaaaaatgtttcagggagtggtaagaagactttttggagacagaccatcagtgagagtaactgaaaacagcatacagttctcatgaaaagcagactgcatcttagtgatatcacagaagcctctccctagtgcctgcgtatggactaaaatattcacaggagcaacttcccagaaccaagagccccccagaacatttcccacaggccacagggtcctctgagtggcctaaggtggtcaaattctgacacctggggctggactcaggggataaaaaggactgtcaggctgctggccagccatggggtccagtcccgctgtgggcaggaaggactctgctcctccccccacacctcaggcacgtcagagagaagaggcatccctcttgcccacggaggcctcactgcttagctcccagcctcaaggtcagatattcacggagccatgttttcctagtaagaggggcactgcactgagagctgatgcagtttgtgagcccatttctccactagggcctggacgggtaaatcaggctgatgctggtctgccccagacccacagagagagaactggaaataggaagttatgcttgcctggcctaggtgccggttctaactcagcttgaccagaaaggccctgtgttgggagtagcaagcactgtatcagccatcaatcaagtgggtcctggtttcctgggaggccatggtccttgtgtgcctaatccctgtcaagaaccccagagaggaggaaggaagcacccaaagctgatcacctccaacacttaccagggtatggcagtggggtccgggctgagacctgtgtacttggtactcccctacttgctgatgtccctcctctggaggcctcctgaccccagaccctgtgtgcctacccatccttgttgcttcttcagggaaccacacagactcggctcagccacggggctgcatttctcttcacgtggaacatttggccacagctcccccaagaatgtaaatgtggtctttatagagatgaggtcgcagcactcgctccactctgagcccaggtgctgccgagttagtgttggcctgatgctctgggcagagctgccctctcagaaggggcgccaagttaaacaccgctaggtactctgcactggtccaaagggagcgctttgcccactgcacgttgaaaactcagtttcattgacaaaaaagatttccattcttcatgtcaatatatctttgtggccttctccactgaaattctgacttaaaaatacatggaaaacatctactggtaaatatcttacatttagtcttgtattgaaaagcaaatatagtaacgtgtgtggaggaggaattagttgggggggtgaacaacttcaaaaatgtcagctttcatctatcaaaggaaacagaaagggataatcttcacagagcacctgccccagctggctcccatgctggccgctcttgggttcatgacatcctcagaatagctatggtctcttcccatttcacagaagaagaaattgaggctcaatgaggacactgcccaaagtcacactgtgcataggtgaggccatcgagattggagccaagggctcctgactccaagtgtggagtctccctccagccctcgcttcctcagccaggtcttcctccatcgaggccagacccttgcctggccccctacgagggcattatttatatggaacagctatagatttttcacagtattatttatatgttacagttgtggatttctcatcaaagtaggatgttttgtctctgctattttaaaggagccacataattttactgctgacaatttttcaatgttaactctttttctgactaattttcatccatcagtgatgtttctgacctttgccactggtgcctttaatgtgtgaaaaggaaatgtgtttgaatgcaggagatttcacagaggtctactaagggttctaagggaaattgtgtttgaatttgtgtttttgatggaagctaatggggcctgattgtcatgtgaaattccgtgtacagacacatatgcacattttttgtaacagcagaaaatactaaacatttctacacaatttgatacctactcgattattctagaaagccttaaaagaattaccccgtttgccttttttaaaaaaagaaaaacttcttctacatcataacagacactacaatcgttgaaaaatgggcaaagaacaccaaaaggtaaatacggaagaaaaaaatcattaaagatttttaaaagttttacacctcgacaaagaactgtaaatttttatgttttatttttttcgctggctgactggcaaagattaacattagttctaaggacacagagctaagtcagcatggatccctcattcttgagttcgttctggttgggggaaaagaagtagtgtgtgagctctgcacaccccctgggtgcatacacctgctgtgtcctttacccaccaggtaaccttgaggggctcctctaatgaccacagggtctgctttcctacctcacaggagtgtcaggagggtcacctgtggaaatacgtggctaggaccataggaaatgctcagtacacactggctattattattactacttcagtcactactcttagagcaaggagtttataacctgggactttgggaatccattaccttctgaaactgtatacagaattgtgtgagtctgtgcatttttctgaataaaggatctagaaccatccccaaattcttaaagggactagtagccccaaaacatttaaaaacacttgcctttaaaaagagcccttggtggaaatgccaaaggtaaaactgagatcattcatggcgcccacaaaggcagccccagctggagccacgaggccaactgccactctcccagcagcctccacagcctctccctacgtggcgcctccttcaaaggcagcctttacctctgacaattctgcagcagtcctggcagctgtgcagtaagaggctgggctgctcgctctcagtgggcgttattttgcaggcttctgccggatcttccgtcaccagcattcacatcgaacggcctctcctgtgctgctgacttggtaaggagctgggaggcctcccacgcccaccggcgctctgctccagctgttggggacagactcccattctctgcctccatccctggggcttcagctaaacacaaccaaaacctttttctccttcacaaatgctctttctggaggtctagcctccccttccctgggaaggatactgagggagtggtgggggaaaggcaggaagtggcactggcaaaggaagcagctgcttgtgccccatctgctaccctggggtggggagcattgggtcctgccccatcccttagagaagaggcctggcaaaaaggtaaatgggtgagaagatccttcctccccagaagatgaagggagaagcccctgagttaagtgtcagcacccaaaccaatctttcttatcggggcaatactgggcagtgggaagcaaggaatgagcaagacagcccctgccttcccgtcaggttctaggtggatgaatgctcaaacacaaggcttcttcctcaggaacagcccacctgagatgtctaacagagaccagaaacctaaatctttctggtttataactattacgtgtgaactagttgagcccaaacaccagccaggaaggaatctgagaagtgtgacctgtaccagaaaagctgagtatacctgtcactgatgggcacctcccttcaactcacacagaaagagaaaggacaggagtctacaggaattcaagtggggaggaggtagtgaggtcagctcctcccttgcagggcgtcagagcggccccaccctgccctgagcttccgctgcccagcaccgcatctgcagaggctgggactcaatacacagttgttgaataaacatacaaattgatagaaaacatacaatggtactttcttagcacttttgtccttaaccagtctcattgtggggatttttatttatttatttatttgagacggagtcttgtcttgctctgccactcaggctggagtgcagtggggccatctcagctcactgcaacctccacctcctggattcaagggattctcctgcctcaccctcccgggtagctgggatcacaggtgcgtgccaccacacacggctaattttttgtatttttagtagagacagggtttcaccatgttagccaggatggtctcgatctcctgactttgtgatctgcctgcctcagcctcccaaagtgctgggattacaggcgtgagccaccgtgcccggccctatgaggaatattttgaagagactgaagcaaaatgtgattttctttctttcagccattttcatctgaatggctaggccttgaccttctaaagcttcctcagatcaatgagaaaggccccagcctgtccagacccttggtgactcaagtttgtaccttcttgctgatgtgaccaacaatggaacataagaaactgcctggggagggcagagttgatgggcaggggtggggagggctaaaagaccagtggtataacacccattccttctgactgggctgcccaagctcagtgcagtcacaaagaatcacagaaccctctggtctcagtttcagaagagagccatggattgggctgtatcctggacatcatcctttaagtttatgagcctgcaaggaggacctcagaatgcgtgagtgccaagcatctggccctcactgagcttcctttggaaaacacacagattcagctgaaagggaacctggccccctaaaaacacacttgaagagcagtgaatgaattgcagaaatatcccaaagtctctggctacatggccaaattctgggcatggcctaggcccctgtgactgtggaagttcatttagtaaaagctgcagcagtcatcacgaagcactgtcactggaagggcagacgtggagtcagaattgaagggtgccaactgtacttggcccccagaaacagtaatccagtggaactgagtttccttgcagaagcaaagccatcagagcctgcaggcactgactgatgttgccacgtttagtaggtccacatctctttttcctaatataatgaacacgaaaaagatcactccagcaacttcccccaaatgatctcagtaatcctgacaacactatatgagggaaatctgatcttccttctacaatcagaagaaactgggggctgggagaatgaagaagtctgccaaaagtcaaactgtgaggcgggtgagaggagaaagtgagcttggagtatgggcatcctgacccctggtccgaggctcttgtctttataattacttattaaactcgcaaaacaaaaattggttacctcagaccgtgggcctgtggctcccagctggagcctcaacagaggttgtgcctgcttggggtgcagctgggggtgcggcctggtgacaggcaggtctgtgatgtatatgcatgtctgtgtccccaggcccatggagagactgcctgcaggccctggaggatggccacgacaccagctccatctacctggtgaagccggagaacaccaaccgcctcatgcaggtgtggtgcgaccagagacacgaccccgggggctggaccgtcatccagagacgcctggatggctctgttaacttcttcaggaactgggagacgtacaaggtgagactcggcaggggatgtctgtgctgcccacaaggtgactggcccaccccaagagaggcctgagcaaccaatagaagagcccactcagaggtacatgctgaccaagcccaggcctgtgcggccccaacaacacatatacctgaggcgagaaggatgcagacagggccattttgcaaacccaccaggggtagtgaggaccagcgcctcctctgcctgctgctagaaactgctgcaggacaagagtcagtagaccagaccaccacagccccacaggacagggtgagagtttagaaacgctggtatgggggcccaggggtgaggagcatttcactcccaagtggggtttccatggggaaagacccgctctcaaagcccagaaggcgcaagtcccaagaggctcccagttcctgggagaatcccccaaaaagtcctggtagggagttgtggcaatgctcaagtcctaattccaggctcatcctctgggctccctggttcccagggagttgaaatgctcatctgtgtagcagggaaagttgccaggactcagtcatacatcgttcttccccctctaaacagaggtagtactaaggaaggcaagagtggctctgtttgctgagtgcccaacccgtgccagcaccatgctaagggctttcgtgcattattttgtttaatctcgtatcaacctcctgagggaggttctgttatggacccagcttacagatgaaagtgtggagtaatttgctcagggttgcaaagccaggaattggcccagtagtgactgcagctgaggcctctgacactgaagctcacaaactacctgaagccatgatgccttgcacacatggctctgccatgccccttcttgagtctcctgtcctggttgtcccccaccccacctcctgaacagcctgtgtctctgcttttttctcctcttccacctacattaggagcgggagactcctcctttcttagaggcaatacagtgcaatgattaagactgggttcttggttcaaatcctggttcaccctcaggcattctgagaccctgagcctctctgggcctcagttcatccatactagggaggataatgatagcacttagttcttcgagttgacatgaggattagtaaaacaacctatgtaaagttcttaaaacagtgccagcacatcacaagcgctcaatactaaataattattgtattaatgaatcaccgattcccaagactttagtggccgtaactcagctgctgaccccaaaaccacatgcaaaaaaaaacaataaccacaaaaccactgggttttagacctagaggggagcgccggtggatgggacacatgcgtcacagctcacacccgtctggtgcgttacagcttacacgtgaccctcacacacagctcatctccagagaaggaggtgaagctcagtgaaggtcagagatttgtctgaggaatgcctgctgcgtgcctacttagtgccaggccctccacctgccacagcacacgtgttcctgcagcaagcctgtggggaaggtaatatagcctccctgatgtaagaacaaggaatctggggttcacatgatgcctggcacagggtaggcactctacatatttttgaataatgtgtgagtcatggagagattaagaggtggagtaggggtctgaaccaggtctgcttcatgctctgcttgtttcccaggcccctctatccagggctgagtgtctgacagccaagcctgctggctgcaggtgctgcaggctccacattaacactctcctgggttttccccagcaagggtttgggaacattgacggcgaatactggctgggcctggagaacatttactggctgacgaaccaaggcaactacaaactcctggtgaccatggaggactggtccggccgcaaagtctttgcagaatacgccagtttccgcctggaacctgagagcgagtattataagctgcggctggggcgctaccatggcaatgcgggtgactcctttacatggcacaacggcaagcagttcaccaccctggacagagatcatgatgtctacacaggtaggaaaagtggagtcaaacccaggtgcagggtagggaaaagaggtcaaccagagccagagcccctgactccagggcttggaaacgggaagatcccagggtgagaagcagctgggccaagctgcctgaccctgttaccaccccctgagggtcccttctcctgcccacaggtccccttcacaaagctgggtcacagtggcatttacaaattaagaaaaaaaaaatgggatggggcgagacataaagaggtatacaaatcacacgtaccagggccagctggggccaatgcagaaagacatgtgttgggctgtggcctcaccacttctgtcccaggcacctggtatagagctaaccaactgcgtaggctctgggccacacacctgggctccagtgctggccccacctcctaccagccatgtgtccttgggcatactgctaaatctccgtgggtctcagtttctgcatctggaagtaaggacaagaactacattgcagagtagggagaagggtagagagaatgtacctaaagtgctttgtctaggatttggcacatagcgagggctccatacaaactggctttcttcatggtcactgttactgcatgtaatgctagtgcagtgctgagaggaagctattaagaggaaagcagataggagagagaaagtgatttgtctaagatcacatgcttcaaatctaggtctttactaagaagtctttattaaacaaaaaacaagagaaaaaaacagaaaatcagaagaaacagagatatggtctggccctgagtccagatatcagcctcccacacagttaatgcctccccagggccaacacccagtttcttgagatgaaggcctctcagtctgccatgctcctccctgaggctggcaccacctgacggccgatgctgcctccaggctcaggctgtctgctctcaagggcaaacccagtcccctcctgcctccatttcctatgtggtcttggtcagaaggctactccctcccacttgagaagcgagctctcaagactgtcctacaaatggcctgtacttcaggcaggccctggaacctacatactaaggtggaggggatcctcatgccaggtccccatagcagccacattctgaagggtaattctcccaacatcaggggacaggagggacatgacctgcccatccctgtatcacacagacacctctgtccgcccactgacactgaactggcctggcccgaaggggccctggaagaggaacaggccctcattctgaagcagtaggggctgccgaggcttctagaagagcagggcagaaggataaccttcagagctggtcagaccctgggacacaggggctgctacagcctttctggagggccacctccttagggagcggaaagtgtattctatgatccaaactcagatctagccagcagcaaaatcagtagctggcaaggtccttgtccctggaggtgtgtgggacctccgctggcaaagaggaggctggttatggcgtgcccaaggatctccctgctataccagtccaacactgccacttggtccctgtggcctggaatcatggcccagagggacccccagaaaaactctgggaaaacctggctccacctcccctcttgctttctgcctcagactgagtgcgacctcctcacctcatcccacggcctcggccacctgctctgttgggccctccaacccacaattctgactggagcagcccctcccctgagtacggggtccccttgccaggcccagtcaggaaagtggggaccccccttcactaagagcaatgctggcagatagtggccccctgtcctcctgccacagagtgcactgcccctgcatgcccgcgcacaccttcccacagtttttactgttgttctgaactgcttgtccttggcagcaaaattcagcatgatgtgataatgccaagagttttatggaaatatctttcctttgtgaagtaatacaaaaaattgtttggatggaatacaagctggggaggactggaggagcatttcttcttaaacactttctttgtcattctttaaagactcctgatccaacagtttcaactcaaaaattcctaagaaaaagcttttctccctccccgcccacctcaggccatctccatttcctatcagaacacaaggtgtggagttcccttggggcctcctttgcacccagccctgggctaggtgtcaagtacgcatcctcattcaatcctcagagccgccctgtgcggcaggcgtcatttttattctcattttacagatgaggatacagtggctgggagaggtcaagtcacttgtctgagatcacacagctagttagttacaaagctgagcctcaaaggcgggcctgaagcatggcctctcaccacccatggagacgggtccacctttcaagcgttcttgctccagatgcctcccagagagggctttgccgaaagccctgagcactatggacgcaagtagaatggcctcctcccagacaccctctcactgccttctctcttgcaggaaactgtgcccactaccagaagggaggctggtggtataacgcctgtgcccactccaacctcaacggggtctggtaccgcgggggccattaccggagccgctaccaggacggagtctactgggctgagttccgaggaggctcttactcactcaagaaagtggtgatgatgatccgaccgaaccccaacaccttccactaagccagctccccctcctgacctctcgtggccattgccaggagcccaccctggtcacgctggccacagcacaaagaacaactcctcaccagttcatcctgaggctgggaggaccgggatgctggattctgttttccgaagtcactgcagcggatgatggaactgaatcgatacggtgttttctgtccctcctactttccttcacaccagacagcccctcatgtctccaggacaggacaggactacagacaactctttctttaaataaattaagtctctacaataaaaacacaactgcaaagtaccttcataatatacatgtgtatgagcctcccttgtgcacgtatgtgtataccacatatatatgcatttagatatacatcacatgtgatatatctagatccatatataggtttgccttagatacctaaatacacatatattcagttctcagatgttgaagctgtcaccagcagctttgctcttaggagaaaagcatttcattagtgttgtattacttgagtctaagggtagatcacagactgtgtggtctcaactgaaaggatcacccttggcatctgtgtgcctggattcttccagaatgtctacaatgctaatctctcacatagaggttcccagcttcttaagaaccccttttggcacctaatcaaatttcaaaatccctccccccacattttcatacttttccccattctcaggacttttcaccatccatcacccacttatcccttcatttgacaccattcattaagtgccttctgtgtgtcagtccctggccactcactgcagttcaaggccccctttccgctctgctgtactcctcgcctacctactccttgccttttctgtcgcacagccccttctttccaggcgagattcctcagcttctgagtaggaaacactccgggctccaggtttctggttgggaagggaaggccaggccaaaagctccaccggccgtatagataatgtactcgcagttttgtatcttccattcatactttaacctacaggtcatttgagtcttcacacaaataataacctatctggccaggagaattatctcagaacagaagtcatcagatcatcagagcccccagatggctacagaccagagattccacgctctcaggctgactagagtccgcatctcatctccaaactacacttccctggagaacaagtgccacaaaaatgaaaacaggccacttctcaggagttgaataatcaggggtcaccggaccccttggttgatgcactgcagcatggtggctttctgagtcctgttggccaccaagtgtcagcctcagcactcccgggactattgccaagaaggggcaagggatgagtcaagaaggtgagacccttcccggtgggcacgtgggccaggctgtgtgagatgttggatgtttggtactgtccatgtctgggtgtgtgcctattacctcagcatttctcacaaagtgtaccatgtagcatgttttgtgtatataaaagggagggtttttttaaaaatatattcccagattatccttgtaatgacacgaatctgcaataaaagccatcagtgctatttggatgtatctacactctgtgttactgttttagaatgccttcctggggcctcccatatcagagcctctttaagtaaaaccaggaagagattcggcaccaggacacacaccagaatcatttaaatcacacccaccctatctctggttaccacctataccctcagaagtaccacagtagtacttcaggccaagatggctctctggagctccacttccccacatccagctgtgtcctggatgtctccaccagatatcctccaagcacctcacgggcagtgcacttaacacctgacgtacctttcttccaggtctggtcccttttcaccaaatggcaccaggtactcaattgctcagatcaaaaacaaggacctctcccttcccctgccaaggacaatccatccctccacgccaagccatcttgcctgcattagcgtaggatcttatctcctctcccttcaactactgcaccaggctccagaccaggagtctccatctccctcattccagtccaatttccaccctagctgctagaactgtctccttgtaaaacaaatctgtgggttgggaagtgattctaggcatgacaggaaaccccaaaacctaaaggaaaagactaaaagatacaacttttttcagaactcaaattttctgctttccaaaaaacaaagcaaaaaaataaaacatgaccaagattaaaaggcaaatattgaacaagagaaacatatttgaaacatatatagcaaatacagaatattcgtgctatgctaaaacctctttcaaattaagaaagatgcaaatcctgtaacagaaaacttggcaaagtacatgtacacatgagaagactcacaaatggccagtaaacaagatgtcaacctcagtagtaatcagagaggtgctataagtgaaggataaaccatgacgtgtggcctgtcagattggcagagatgaaaaaaatgtcaatctccatgttgacaagggaatggacagatgtgtgcactatggatggacatataaattgactccatattgttgaagagtaacttgccagtgtatatatcaaaattgtaaatgcacttataccctgggccccagcaatccttctacctaatgaccaagtggcataaccatatgatagctttttctagtaaagctgcagttagagagagatgcactgatacgcactgaagcctaccatgt

SEQ ID NO: 15483 - DNA, 6872 bp, Human
  misc_feature (1)...(6872): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccttggcctccactgcacagcctggagcagcctctgccctgcctgtcccccatcccccagtgcctgagctgtgctgctgaggcttctgaaggggagagaggtggttgggtggtccctgctcctcacccgccacggtacaagcacaagtgagggtgtccacagccctggctgggccccaagctgcaggctaagcttctgcctgaagcctagggacttgcctctgtcccctccctttctccaaaaccactcagtcagcacattcctgaagcagccaagtggaccccctccccctgggcccacccctctttccccactcctgcctgagctgttaggttggcccaggaaggctggttgccctgtgggcagacacaccccttcagtgcctgtggttgtattgtccttggcattgaagcatggccagtggtagtgggatcaaggggaggaggtgggtgctagaaatccttggggcagttggggcatggactgcctgggtcctggagagtgcctctagaactgggctcccatgtgggctctggttccgcctggatccctgcctgccttccacctacctgactcagacctgccaggaatgccctgccccagggccctgagtcctgctgggtgagccattgctctgcctgagccatgccaggcatgtgtgactggccctggctggggtcagcaagggcatgtcgacagaaagaagcatgccaacaggctccttgggtgctgacggccaggtagggtttggtgcaggagaaggcgggcagctagcaggaggggacggtcaccaggcttcagaagcccactgagcagtgcccagagtcttagctgtgcttgctggacatttttccttgccccagcttctcttccttgtgtgtgtggtgtagtagagcctgtctgagctgtggagtcagacacacatagccaggtgctgcttcacctgtaagcctcttcgtttcatctgtaaaatgggggcattccaccccttctcagaggcaggtggcaagggccgggtgggaatgtaaacaggtgccaaggagcatgcctttcctccccttttctgtgggagacacaccctcaaaggagcagggcagggtaaggtggccgcaagctgacctttgccctggttcttggcagaggaccttcctggggactgggcagccttcgcacttaatctcagcccatccctgttccccctcccagtcagctttcagcgcagccaatgaaaactaacctagggggagggggtgactgtgcagcgtgttcctttcccagtccagctgccatcctgggggagggggtgccagctgccacctgttggccaagtcctgactgaggcagctgtctgtgcctcctctaggcccagaccccccttcccaggacaggggctggggtcttctgggatcctggggaagtagagcccctcaggcctctgcttgcccttttgtctcatctaggctggttgggaaccggtctggtgaggaagggaggctgcctcagtggagggggtggggccaggcctccctttcccctaatgagaaacctttttcctgcccctcccccatttcagtgaaggagtcttcaagtgccctgaggaccagcttcctctggactatgccaaggtgagtccacactgccaggaagaagcccaagcacagtctgttgcccttggaggccggagctgctggcagccagtgggctcagggccagtgtcaaccaaaagccttgggatggtgcgcctccacaaaggtagcctgttccctcccaccaggccagtttgcaaacgaggcccctgtttgccctggagggcatgcacaatgcccagcctgtaggggtgcacagagctgctctgtgcccgcaagaagtgttccctccccttccggtggcaagccagacctgtggctgagggccagtatccctccaccaggggaaaggaagcagagccccagggacagcctgggattgagcaggctgattggctgcctcttcaaaggaagcgtcctgtgcaggcatgttaggacccagcatcagagcagatgctgcctgctgtgcccttcatccctggactcaagaggggcaaagagcccaagagaggctattacaggctccaaggtagagccagcccagttgggtctaggggtgggaactgggcactgcagtcagctctgaccctggccagttcccccatccctacccccagatctacccagacccggagctggaagtacaagtattgggcctgcctatccgctgcatccacagtgaggagggctgccgctggagtgggccactacgtcatctacaggtgaggctctgatgtgagggctggcaccacctctcccttggcaggcactaattgcagccttcccaccagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgaggtgggtggggtctggctgaatgtggaggagggggtacctgatggcctaggcatctcttaactcagcacctctgacatttccagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccaggtgaggccttccctgaactgtgggttgcagggtaggtgacaggtagtcaggatattgactcctgcctctctacttctgtggccccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacagggtgagatgccccttttcctgtcagcccccttttgcccttgaagccctagacagaggctcagcttctgatgtacttaggccttggtggtccctgctgtgctgctctgaaaccctcagtccttccctctgctgccagctccagcctcttcctaacaccctctgtcttcctcacgtagagctgggtgcctgctaccctgtacccactcctctcctctccctggacctccccctactgataactctcctcccttcccccatggcctggggctttgccaacagtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaatttgcttccagcctgacttacctgggttggttaggtccctgggaggctcaaccaaactgaaggcaaagaaaggaccagtcagagaagggccgctgcctgggtctggccccaggatccagcttacctgctggctcgccctctgatggacgccgggaaaactgcatcgggctttgtgtggaagacggtccctgccactgccctctgccgatgaaatgcgggaagtgtatggcctagatgtttcataaggctggagtccctggtcagccccaccagattagtgcttctaccctaggcagggctttcttggtctaatggtaataagcaccgacactgctaagcactttacgtgcattattatttcattgaaaagaactgtcaagtgaaatactttttagcacagtaactggctttgtgggctctagagaagagttaatgaggcagtgcatgttcttggcccagagtaagtgcttagtgaatgctttctaactccgaaccccagccacatccagggactgggtgttgagcaaaaggggccttcaagatgttcaaggcacttggattttctcctgtctctcatcggcttttcttaacgggcctcagtgggtgcatgtgattatccacgtttcacctatgaaacatgaacagaggagactgacttatcagtgattcttccgcgggttcggacagggcctcgattctgttttaaactccagtagtccctagaaattgtagctccctctagttgtggcaataggtgtgggtccttgtgcttgcttttggcaagtttctgagctacacagggcctccattaccgtcactggtgaaatgcggctcacctcccagatttgttgtaaagattaaatgaactggtcagcacacagtgccttactgtcttgcctagccctgagaagaggctgtatgtacgagaatcattagtaagggaaggttcaaggactgtagttctttcttttcccatgcagaggctgagggtttaaacaaaaaaaaaaaaaactcagcctctgctgcacacgactagctactcaggaggctgaggtgggaggatggcttgagcccaggaggcagaggttaaagtgagcagagattgcgctactgcactccagcctgtgtggcagagccagaccctgtctcaaaaaaaaaggccttgggctgggcgaagtggctcactcacacctgtaatcccagcattttgggaggttgaggtgggcggatcacgaggtcaggagatcaagaccatcctggctaacatggtgaaaccccgtctctactaaaaatacaaaaaaaaattagctggtgtggtgacacgcacctgtagtcccaactactcagaaggctgaggcaggagaatcacttgaacccgggaggcggaggttgcagtgagccaagatcgcgtcattgcactccggcctggcgacagggagaataaaaaaaaaaaaaaccctttatggggtgacaggacaggactaagcctcagtgagccaggctggggaggtcatcatcggcccaatctttcttttcaaaaaggtcaaattgacttacttatctagggagaaatggggccctcctgcctaggtgagaaactagagctgggcttcttcaccagataaaccgtcttggtacggtgatgcctggagactggtagaggcaaccatgggctccagcagcataaatgctttcaggcaacaggctgaaacacctttccagaatcccagctacacacctgaccgagcacagtggctgatgcctataatcccagcactttgggagcctgagttggagatgaccctgggcaacaaagggagccaccccgtatctacaaaaaaatataaggagccgggcacagtggctcacacctgtaatcgcaacactttgggaggctaaggagggcggattacctgaggtcaggagttcaacaccagcctggccaacatggtgaaacaaaagtctctactaaaaatacaaaaattagctgggcgtggt

SEQ ID NO: 15484 - DNA, 47420 bp, Human
gaataactgcattttctgaaggaaaatcaacgaagtgctttgaggccaagtagatgggattcttgaggattccatgaatagcaaatagtagtatccccctcagaggctcttgggtgggggcattaaatgtgttaatacatgtgtttgctgcaggtatagccagaatatgtgaaagcagctacagggaatagagtgtagcaaactcctaatcatccctcaaaaccctgccctggtgtcctctcccttgtaaactttccttgaacaaggcagaaccagctacatcagcaccataccatccctccatcactacagatatcactctgtactataattatccatttatttttctaggccttgcactccctaaggccaggattctgactctttccctgagtgctgtttacctgaactgaaccggcatgaaccaccacgcccggccatcttgtcactttctaaaatgcattgctcttcgtggcagatgctccataagccagagctctaagccgcagcattgagccgcagcattgagctgaagcctgaagggaagatggctttgatatgttaaaactcattccagtttactcctatttttcattcattcatccacacattcactcaacaaagatccttgagctctgatatccatgtcttttttgtggctcttagtttatctttgacaaagttaatatattatgctgaatttaacttgggaaagacaagaaggaaatgagtggacagtggtagcaaagtgttgggacggtgagatcaagggtgactttttttccctttgcttctcaacttctccctaatgtagttgttattttacttttatgatggaaaaatgcatatgtatgggaatactgtatttcaggcattataaggaatgaaattataggccgggcatggtggctaacccttgtaatcctagcactttgagaggctgaagtgggcagatcacttgagcttcagagttcgagaccagcatggacaacatggtgaaacccagtctctaccaaaaacacaaaaatattagctgggtgtggtggtgcatgcctgtagtcccagctactcaggaggctgaggtgggaggatcgcttgagcctgggaggcagaagttgcaatgagcagagatcgtgccactccgctccagtcttggtgacagaatgagactccatctcaaaaataaataaataaataaaataaatgaaatgaaattataagaaattaccactttttcatgtaagaagtgatcatttccattataagggaaggaatttaatcctacctgccattccaccaaagcttacctagtgctaaaggatgaggtgttagtaagaccaacatctcagaggcctctctgtgccaatagccttccttcctttcccttccaaaaacctcaagtgactagttcagaggcctgtctggaataatggcatcatctaatatcactggccttctggaacctgggcattttccagtgtgttccatactgtcaatattcccccagcttcctggactcctgtcacaagctggaaaagtgagaggatggacagggattaaccagagagctccctgctgaggaaaaaatctcccagatgctgaaagtgaggccatgtggcttggccaaataaaacctggctccgtggtgcctctatcttagcagccaccctgctgatgaactgccaccttggacttgggaccagaaagaggtgggttgggtgaagaggcaccacacagagtgatgtaacagcaagatcaggtcacccacaggccctggcagtcacagtcataaattagctaactgtacacaagctggggacactccctttggaaaccaaaaaaaaaaaaaaaaaaaagagacctttatgcaaaaacaactctctggatggcatggggtgagtataaatacttcttggctgccagtgtgttcataactttgtagcgagtcgaaaactgaggctccggccgcagagaactcagcctcattcctgctttaaaatctctcggccacctttgatgaggggactgggcagttctagacagtcccgaagttctcaaggcacaggtctcttcctggtttgactgtccttaccccggggaggcagtgcagccagctgcaaggtgagttgccttcatttctggggaagcggctgttttgagagggttttgtttcttcctctttgagaaggctcagaaaattgtgggaattttctgcctacagagagaaggtgttggaaagtctaggtaaaaaaatgccgacatgaggtttggtcatttgaacatggcatcttggtcagatttcttttctgcaaatattagctgtggttgttacatgacaaggaaaaactttctgaaaagttcaaaatgggagtttgtatctgctaagaattttttttaacagagattatcttatcagtccttataacatgtaacctccccacaaatcctggtaagatggatatattaaacccattttatggatgaataaatgagtttcagttaaataacttgatccaggacacataactggtagagctaggattccaggatttgaacccaggtctatggggctataagttcttttctttctttccctctttccttcctttccttcctgtcctttcctcccttcccctcccttcccttccctttctttcttttttttttttggaaacagccttgactgcccagcctcaagcaatccttctgcctcagcctcccgagtagctgggactacaggcacaagacaccatgcctgcctggctaatttttcaattttttgtagtcaaggtctccctatgttgcccaggctgaactcgaactcttggactcaagcgatcctcctgcctcggtctcccgaaatgctgggattacaggcgtgagccactgcacttggcctaaaattcttacatggactatattcactacactgtcttctaaagacagagtttttgcctctttgatcttcctcttgtctgtttcaaaggagatgatctcagatttcgagggatgagtgcatttttcacaaatatttcctccccacataataaaagaggagcaagtaataatgctgagttagaacaacaactgcaaaatctttaaaagaaaggtagctacagcttgagtgctttccccagtaacagacctaaaactacagttgataatgagagctgctgggaagtgtctttcagggtcaggcaaaggcacccctgtttcaacgacctccgggctcttcctcaccctgcctgtggccagtgatgaagcctggctgggtctggtgggccagcaggtcccgctaaggaggctcatggtgcatacagtttgtccttgttaagtggcgatggggatgggggggttcattgtttttccttaagattattaggtggctttacagaattgaagtctgtgtccgaaggctccccattccaaccccgaaatagagacagaggttgcaaagcattgatgaaggggctcatgctggcgttcatatcgattccccagtgagccaaccccactgagaagccctgttctgtaaactcttcttcaaccttccctcacctctgcttcccttcttcagccccacagtgaagaacatctgagctcaaatccagataagtgacataagtgacctgctttgtaaagccatagagatggcctgtccttggaaatttctgttcaagaccaaattccaccagtatgcaatgaatggggaaaaagacatcaacaacaatgtggagaaagccccctgtgccacctccaggtgagttttccctgggggaacctcctgcttgtctccttgggcacccatgccctgtcggcaccgatgactcagaattcctctctctgctcctcctctctcacctgaggtctgatctcctcattgcttcttgaaagtccctgttggaattcaatgcagccgctgattattgggcacctcgctgtgcctgacggtatgtgaagaaggaagggacatggtgcggggctggccctgaagaagcttggaatctttggggaagaatatgggaaggagcttggcctgagaatgggaggcagtagagcctcgtggtgggcaccatggcggaggggtgggggtggagggtcagcatcctggcctgcgtccattccaattcaccgcttgctagatgctttgaatatcatcctggtgaagggcatcaggatgttagacaaactagttccaagccctgtgctggccgcactagttgccgggtgctgcctctagccagctgtgtgacgcagggtaagttaacctctctgaaacttagtgctcacctgtggtatgaggaacccaagggggccctcaccatagtgtgctgaggatgaaatgagatctacagcactcagcactgtgcccacacagaacagacacttagtccacatcagggttcatcaccatctactgagtacctgcccttgccagagctacacaggccacttgacagactttgcatctcaactgatctctgtggcggctctttgaagttcatatgattgactcatttcacagataaggaaatagaagctctaataggattatgacttcccccagcctgaatgaccggtaattacagagtttacagagttggaacttgagcccagatttggattcttcatgtccctcctccccgggcccatccttcctcccagggcagaaccaagagaatgagtcagttaatgaacaagtcaagggacaggcttgaggctcgctcaggtggaaagacaaagcaatctgcaataacgcaatagtgcaactgaaaccaaagcccccatctacacaagaccaccacatagccacacaaccccaccgccccagaggagcctttcccatggactacaaagggtagggcgccccctggatgtgtgcagcatgacggccctgagtgtatctgtcagaggcggcaaaaaatgccagtggctaagaggatgggcttggggatgagcaagtggctttgccactcagtagccctgtaacctttggcaagtcccctagcctctgagcctcaatttcctcctctataagaagagggtaacaatggtgatttcctggagttggaggaaggagtaaatgagctttcccatgtgagcaacttagcacagggcctggcctggagtaagtgctcagcaaatggcactgttggcattgctatcattagcggtggtgttggcagttaggaggtgatggagcaaaattgaacagagttccctctaggggcttcacagaagtcaggtggactctgtggcctttgaagtatgggtagaatgtagacaggtgcagaggagtagcaaggacattcaggaagaggggagaggtgagcagaggctcagaggcagaaatgagcctgactgtgcttggccaggagtgggctgggggctgggataggcaaagccaggccagagcacaagggcttgaatgcagggtaggagatttggactcgctctccctggcagtagggagccattgtaggttcttgagcaggacagtctagctgtggtgtggtaggtgaattggaggagaggactttgaaaccaggcagtctgggctatggcaactgaggtggctaagagaccaagaggtgagaacacagagttgatggcctctagatgtccagattctaagggctgtagaggggcagtggcttcgccccttccttctcttcatctcatcattgcagccgctgccagctgacctccctgactccagctccccacactggctctgagctctctcttgccaactggacttctagcaagtcacgcccctattctagagcctgcagtggctccccattgcctgtcaccacattaaagcttccacagagttctgagcgagcaccctacccaaatggagagcccatcccacctgcccatcccagccttcctcagctccccagtgcctgtgcatagcacattcctccctcagctcatccagacccaactcatcccctatttttttcttttctatttttattttttattattattatttttagacagggtctcactctgttgcccagacttcagtgtagtggctccatttcagctcactgcactgcaacctccacctgccaggttcaagcgattctcccacctcagcctcctgagtagctgggactacaggcatgtgccaccacgcctggttaatttttgtatttttagtagagacggtgtttcaccatattggccaggctggtctcgaacccctgacctcaagcaattctcctgccttggcctcccaaagtgctattacaggtgtgagccaccgcacctaggcttcttttttctttccttttcttttctctctttctctctctcttttaaagctgagaatcttgctctgttgtccaggctgccctcgaactctgggccctagtgatctatctgctgtctttccggatcaccctgaatctcccaaaacccttacggtgttggctgcagcctttaaccctcatccccacaccctctaatagcattgccagttatccctatgtctttgggggctgacttgtgtctttggaccattcaggaaatatgagttcagactccagggagggccctgagctgcagtggacatgtgacaaaccagctaacttgaccatgtttttccccctcctcttcatgctggggtgggctggcggaaaggatccagtcagatagaagaggggatgaagaaaaaaatatcacacatcaattcattcaactctcccaacgatccacaaggaaggaattttagttatcccattttaaagatgaggaccctgaagcccagaaagttaaagtaattttcaagatctcataattagcaaatgacagagctgggattcagatccaggcagtccagagggacccctgcatggggctgccacctttgtgtcctgggcatgtcacattccattgacgagtacatgcagatgcccactcccctggctctgtgctgggagttaagatatcaatgaaacccttctgctcatcagtgaattgtttgagccacttattacttacatacaccactgctaaaaacaatagataacatttataaggtccttagtactgtgtcaataatgagacaggaactattatccttgttttacaagattgagtgacttactggaggtcaattcctggaaaatagtggagctaaggtttgagtcaagtccaaactcataacatctacactatctgtgctctcccagagggcctactgtgtgctgcactgttcaagagacagagaaaaatgacccagttcctgctgtcaggaaggaaacggggaaacggatgtcttcctcgctggtttgggagacgtacatgaagaatgcgagttggagaaattgtgtcaggagtaggtgggatggagtgtagacaggaggtcgtagttgtgggtgtactgggaccgtgctagaggcctctgctggggagactgcagaggtgcctgggcaggctgtagtgtggggaggagttggggggaggaggtgggtccacccagagtgcaacatccactcaggtgagggaggggtgatgttactggaagaggaagcagccgtgcaaaggggatttcatcctgaaagcaatgagagccaatgaatatattttgattttaaaaagtaattttctaatctgttcaggtgtcatgaaaccaagagcctattctaagtgactggtgattctataccttcgtaaacaattaggaaatgagcatggtgtgtgtgtgtgtgtgtgtgtgtgtgtgtgtgcgcgtgtgtgtgtacgcatgtgtgtattttagggacaaaggcaaatgtgggagcatctaggtgaagacacatggaattcagaaccaagtcgagctatgtgttgcttgctgggctgcagttggctagaaataaatatgtgccctctttcattctgctttaactggggttcgggatttaatgtgcttgcatactgccagaagggccccctgcatgttgaggtccagggctgctgccccatctgggtctggaccctacctgttatcttgcttgagataaggagcaccttacaggcggagcaaagtcaggaggctctgcgcagtccaggtagcaaggacaaggggcctgcaaggcaccggaaggggcttacgatccctcctgcaatattcctactagaagtcacccctaacccagtgctttctttggtttcttttctggaatcgcacagaacatgctgtatgtaacaagtaatataacacttcccgggacagccttgtgaggtggtgtgagcttaggctgggctgtggtcctggggctgctgtgtggccctggacaagatccttaatctctctggccccagctaatgcctcaataaagtggagatgacaacgtagagctgtctgcttaacgagactggacgaaatgacagaaaggaaatttgctctgtaaactagaaagcaccgcgcaatggtggtaattatcataagctttattgcgattttatggggaataaacaaacacgaggcccaacacgacccgggcatcttagcccagacacagtccagtgccatccaaactccgcggcagacgccggctgcgggcccctgggtgcttgggtcccgggatcgccggggaaggcagggaaggaggggcagctcggcccgggacatcgcgtgggtgaagagcccccgccgctgctcggctcgccccgcccccggggcgggggctgcaggctccgagcgataaagcgcgggcgctgggaggcgcgtggagccagcggagctgcgcctaaggagccgggccatgcgcgaggggctgggcgcggcgtgcgaggccgccgggccccggctgtgcaggctgctctgcaggatcctccggccgaagcctgactgctgcccgcgcagagccaggtaccccgcgggccgaagtccgccctgggagggaagcggtgggctccgagcccgggcggggccccatctctctctgggagaaatcggagggcggggatgtgcgctctgtgggattcctgagggtttactaaaagcgttttcctcttttagaacgcttgagaggtcgcaattcaggagcccaggcggcccagagaaaccccccatgcactatgagaggcgtctatgcgggttcagttgcgctgcgaatgtttcagcacttgggagcttttgaaatttttcagcactggggttgaaagttgctacactctttggatcaaatatggttaagagagcaaggaggttcttgtttcacaaatgagatccatttcccagggcgccatcccccccaccctccccatctgtccccaccaccactcttggtgtaaggcgaggtaaacaggcagggaggcgtcggaaccgcaggggaatctggcccccaggtcagcccaggcaagccacagtctgcagctgtgaccggctcggctggtcaagggcttgtagaaagttctgggtctaagcaagccaccacactcacagcactccccacgcccccgacccctttttttgatagggtctcactctgtcacccaggcgacagtggcgccgtctcggttcaccgtagcctccacctccagggctcaggtgatcctcccaccttagcctcctgagtagctgggactacaggcgcgcatcaccacacacttggcaccttttttttttttttttttttttttgtagagatagggtttcaccatgttgcccaggctggtcttgaactcctgggctcgagtgatccgcccacctcggccttccaaagtgctgagatgacaggtgtcagccaccgcgcccagctgccagcactctctttgaatgcaggtccttgagggtcctcaggaccccgcacagctgtgggtttagtcaaattgcacgagcgtctgcggggtcagaatcaacaatgtgataatttggaaagaagtgtccagattctgaaggtgctcacctggagtctggtcaccctgtcaccctgtctcccagcagccagccagaagaaatggtgtgggaggggacttgggcaaaactttgtttattcatttttcaaatttaaagaattgtccaattatgaaaggaattcattgtcactgtaaaaagttggaagatgtggaaaagtataagaaaagttaaattgcctatgatcttatcacttaatgctagtcactgttaacatttactaacattccctcgaggtgtttttctgtgcttgtacgcacacacacacacacagccagcatcagactgtgtatacagtttaaggcattatttatatgagggcaaaactagacacagtctaacatccagccatggacaatgggaccaggctaatcgtggcccatctgtagagtggatttttagccaacttttaaaagtgatactttttaatatatggggtaaaatgattatgttaaatgtacaaagacattgcttctcaatctaaacagtactgtagatgtttctggtctgaagcttctgaaattgtccaactctacttccagaagtaagtgagaggaagcaagaatgggtgcagggtgggtgctggggtgagggggaatggcaaaagagcaagaggggcagttgtcccctggggaccccatcccccatacatcttcctattgaagcagccccatggtgactgctcagccatggcttatctgttctgaatatccagattgccatatatatatatatttttgttttgttttgttttgttttgttttgtttttttctggcaggccacaccagtctagaccaggtgtgttaaagaaaaaagtattcaatgatacttgttaaagaacagtatggaagtctttatttaggaccatctcaataggtacagggacctactgcagtggggtctggcagtggaggagagagattgggcccaaatccaaatacagcaggagcaagtgggaatttatagccaaggatcagggtggggtctgtggatggaaaattaccaagaaaaacttcaggcatagggggaattctgcctcacccaacctaacaggattcttgcttaggacaggctaaggtgatcagacatcgcctgggggaggatggaggatgaggaccctgatcagatggggaggacgacaagctatcaaggatggagggttcttgttaaactgactaagtagggattcttttgctaaaactgcatttttacaaggaaatgcttggatgggccccgcagaagattcagaagtctgagtaaagtttggctaagcaaagcatctttgccagttggcaatggttggtcacatggaaggccctttacagggttgtggaatcccttgattcagatataagttgctttctgatacatacttacatcctcttttaagacagtatctctttatagtaaaaaatcacttactgctactatgtaatgtatataattaatgatataatggtaacatatagtcatttttttctataataaaagcaatacatggtcatttatcgcatttcaacatcatagatacatatcaagtagaaaatgtgagaccctcataatagtctctaaccacctctccctcagatgcacaagcatgcataccctggaaaatactgccaagaacatggaacacaatatgctttcaaaccaaggtgccctggtgggatgattcttcctaggggaggcatgtgtgagtggtgactattcagttcgccggaatgaacctgaaatcccaaaccaggacaaacggtttctgaccggtttcagaatactgaatttttaagtaatctttaatttaaaaaattactttaagtaatgtttaatttaatttgtaagtaatctgtaatttaatgctaatttttacaatacttgtttttaccttggtgaaggtaagttgacatcttagatttgttttaaaataatgatgggggcagggaaggtataggtgaaacaagatcggccgtggattgatcactgttgaattgggttgaatctgggtgaagggcccatggaaggttattagactattctctctacttttgtacacttaacattttctgtaatagaaatgtagaataagtaaataaaccaagataaatcacgtgttttaaataaagcttaagtcatgaaaaacaagtggctggggctgggcgcggcggctcctgcctgtaatcccagcactttgggaggctaaggtgggaggatcacttgaggccaggagtttgaggccagcctgggcaacatggtgaaaccccatctctaccaaaaatacagaaattagccaggtgtggtggtgtgcgcctgtagtcccagctacccaagaggctgaggtgggaggttcacttgaacctgagaagtggaggttgcagagagctgagatcatgccactgcactccagcctggatgacagtgcaaggctctgtttcaaaaaatataaatcaatcagtcaatcagtcaaccaatccaagtggctgctgggcagtgctgctagtctgggaggcagagttgttggagccattctctgcccacccagcccctgtgccacgtttgtacttggcttttccagagggtgaaggagcattttccagatcctctatgggctgctgtttgggccagtagctttggctcagctctgctcatgcccttttggctctgcgggaggaagaagataagaggaagagggaagatggggatggggaggcagttggtcagaccgaccatgaacaattcactcccaccctctggactcagtttccctatttgtcaaatgaggttactggcagagggaactccaagatgcccctccacccttggataccgcatctcatgctagctgtttcctttcacagtccagtgacacaggatgaccttcagtatcacaacctcagcaagcagcagaatgagtccccgcagcccctcgtggagacgggaaaggtcagtgagtcacatgggtgtgggaagccccttcctccctggtccaggcagatgcagacatagcagcctgttagagctgggctggagagggcaggaagccagggtttggatggagagtggagagtcccagacccggggtgttggggggaacaggtgggaatgaggaagggctttgggagagtgagacaacccccagtggtcgggagtggtggcccccaaggtgcactgacagctagcttctatctcctgggttccataccattctagagaggtgggcagagaaatgggtaggagtgggagagagggtggcttatatgtccttacatgctcccagggaaggaatgcagtggtgcctttctgttctcagtagtattggctctgacagtcatccttctcacctccaacttagtctttagtccctcctacagcagttcctctgaggaagcatttggcaaggccctgggtgaggagaggaccctggccagtggcccaggcacctggagctcttagcaggcactggcccaggtcgcccgggggctggaaacagaggagggacgtggagggacaccctgccctgtgtggccacccatagatccttccccactctaagacaaggcagggcctggggtctaggagagacctgagagaaaaccctgttttttccccttgcagaagtctccagaatctctggtcaagctggatgcaaccccattgtcctccccacggcatgtgaggatcaaaaactggggcagcgggatgactttccaagacacacttcaccataaggccaaaggggtaagtctggggcttcagggagaaccacctttgtcccaagctggtgaagctgccagggctttgtggatcaaacaggtgtccccctgggcaaaccaaacaatcatctgcttgggcaaaggggtctaggaacagagacattcctcacagattacagtaggaagtaaatgatgccaactccctgttaaccaccccagtaaataatggataatccagaaggtcaaataaatgattgcagaaacaaattcatatctttcttagccggatttcaggataatgtcagggagaattttctaacagaactgctcagagctggactgtattacatcaggaggtagtgagctccctgtcactggaaggatttaaatgcaatttgatagattgcagaggggttcaagtatcctgtgagtggttggactaaatgtcttttcaggcttctttctgtcatgtaagtttttaattctaacttcaggatacattctatggttgtaaagtgggaaagaatggacaatttcaggaccatgaaagcaaaattatttcccacatgcccccaaaccaccacagttaacattcgggtgtacttcattcgtgtgtgtgtgtgtgtgtgtgtgtgtgtgtgtgcacgcgtgtgccttcctatgtctcatttcagtttgttttggccaaataccaatatcatgttcccataggagccatattggattgactttgctctggatctggagctggctggggagcagggccagagactgagtccggagtagggagaaaaacctgactcacacccactggggttcagccagtggaagagaggagatctaggtgggagaaagccaggtggaccccaaggaggaggtgccacaggggtggagaagaggtgcagggagccggagcagccagagaggagccaggtggccaggagagctggccccagaggagggtggcaagaggccgaatggcccaccctcaccacctgcctctctctttccagattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagagtaaggcttgcctcctgcagggtcgctgcctcctgcccttcctcctgctctcctgtctctacccatcaccctctgatcctagctagatcccttttctttccagatttgtggtgttaaatcactatgattttgcagagcgaaaatcacggttttctaggggagaagaccctggagcaggttctcataattgtgggataacgttgtacatagcaataccagttaaaagtgactgaattcgaaccctggctcccgcattgtgtctgaacgtcctcatcatattaatggcaaaaactgcaactacttttgcaccaacctaatataaaatggggataataacagaaggtggctcatgagatttttgtgaggattcagtaagttcagaacagtgtcctggcatccagagaccttgattgtgaattaatatggaccctttaattatgaaatgtttgagacagaaaggatctctgagaccacctagtcaggcccctactcctacaggtgtgaacatggaagctggtgacatacctgaagtcacctcattccagctagaagccaggccacctgactaggagagggcaggccattgctctttgccctgaccctggtggggttctacatttctggagttctcttcttttttctacccagtgaggcttccctgaggaccatgctagacatccttcatttctatggccaattggtcatttggttgacagacacacatcaggcactgagtatgcctcagccttgtgtcagacactggaatacaaagatttttaattgtcatttgccaattttattgccaacgtatacaattttaatcatccaaagagaggttgtatagcattgtggccttcccaggttcaaatcctagctgtgccccttacgagctgagtaaccctgggcaagttactttgtctctctatgccttgattttcttaccgaaaatggtgataataatagtacccaccttgcaggaggagggtagttggcgggagtttataaagatgaaaggagttaaagaatatagagctaggaacaatgcctgggccacagtaagcacgacataagtattagccattttcatgtttttagaacactgcgttgtccaaataaaatatgtggctatgtaatttaggcccctttaaaacttttaaaacaaaaatgcatgaagagattgtaagaaagaatgtctgaaagaaatggattgttttctttttgtttgtttgtttgtttttatttttgttttttgagatggagttttgctcttgttgcccaggctggagtgcagtggcacgatcttggctcacttcaacctctgcctcccgggtttaagcgattctcctgcctcggcctcctgagtagctgggactataggtgtgtgccactacacctggctaattttttttttttatttttagttgagatggggtttcatcatgttggccaggctgatctcaatcccctgaccttgtgatccacccacctcagcctcccaaagtgctgggattacaggcgtgagccaccgagcccggcccagaaatggattgttttctaggctggaaggggagtgttgctattaggggagagcctcacacagcactgcaccacacaaagtgagccacagacatgtacctgggactccctggcggaaagagtggcttctggtggtaccacctccacttttctttggcttttttttttttttttttttttttttgagactcggtcttgctctgtctcccaggctggagtgcagtggcacaatctctgctcactgcagcctcgatctcctggatcaagtaatcctcccaccacagcttcctgaggagctgggaccacaggtgtgcaccactatgcttagctaattttttaaatttttagtagagacagggtctcactatgttgcccaggctggtcttgaactcctgagctcaagcgatcctcctgccttggcctcccaaagtgctgggattacaggtgtgtgccgctgcacctggcccacctccagttttctacaaccctagaatgtctgagctgggagggaccgtgagtcttcagaagaggccctcatcttccagggtcggtggtcctcaaccctggctgcacagtagacttacctggaaagcctgcaaaattctgatggcagggtcccttgagccaagggcagcagaatctggggagatggggatgaggcagacatgtgtgtgcttcaaaagctccccaggtgattctaatgcacagcctggattgagcagcctgttaggggctgcctgcttcctgactgcaaacttcacaagatccttggcctttcagctcggttgttaattaatgagcctttcggggtccagggattttcctggatgggtttcattgggccacagtacttatgttatttatttatttatttagcataaagcacgtgtgcaccatgacactatgagattggtattattgttatcctcatcttacagacaaggcaactgaaatccacagaagagatgtaccttgctcaaagtcacacccttcgaagccccagagtggggattcgaacctaggcagctggtgcctgagcccttgcttttcccatcaatgctctagtacctagctgtgtggccttgcaggttcccaactctattctggacgtgggaggccttgctgttgtgtggaaggcaattgggcgggtgttcagaagcccagcagggctacagggccatgcttggtggtgttggaacccatttgcttctcccagaggaaaattgtatttttccaagtcacaagtacataccttgaacccctgcttccctgagcaagagatcctgggggtgtgaacggggaatggcagcctctcctcacagggaccctggcaatctaagacatgaccagctgagcaggttcagtggccttttgtatctgaagaatcatagcatatttagagattgtgacttgctgcatgttacatttaaatctgttcactgatgatgaaagccactcctttttttcagagctcatagacatcatagcatttctaatgccttagaaaatgactatatgaaaatggctatcacatctaaaactctgaaggaattggatgtgaatgtaaaaaataatcctttcttgcatatgcacgtgctgaccaccatgtgtgttggtggtgtgggtgttatggtgatcattactgttgtcatgctcaggtgcagaggggggaatattgctggaagctttgtttggggagggaggtctcccagcagtggggtggttcccacctcacccagcagctccttatggcaggggtgtccttggggataaatatcatcagtgttttgtctttgtgctttttttctctaatcaaggaaaagttgtcgagacactcttcatccacagaaaggccattttgttcagagttacccactctccttaatcaggagttcattctttaaatagttttgatgctgtttcaaaaggctttggtgctgactggaaatctcaaggttgttgttgttggtggtggtggtagtgtgtgtgtgtgtgtgtgtgtgtgtgtttcaaagcctttctgactgagtccctccctccctttgggatatttttgaagtctgggaggggaggagagaagcaagtttagaattgcatatggagtgactgaatgagcaattctgaggctgaggaacagcacggtttagagagactatgacgtgggcagctcttttctggccaggccctgggaccctgcagactgagctccgatagccaggtcccagtcctggcttgaccaggctcctgagaagggtgggcaggccctcaacatctttgggcttactgtccccgtagggtggaagatggaaggtcacgttgctgacagttaagaacctgggcttggcatcagggcgacctgggtctgagtcctgactttgctctttcctgtacttatgttcctgggcctggtgcttaacctcctagagccttgagatccttggctataaaatagatgcaaaaatacctccctcccagactcagtgagaccctgcctgtgggttgcttcacccagtgcctggctcatgtgggtacccagtacaccggagctgccacggagggactggctcatctctcagtcatggcaaggaaggagggcactctactaactaatggagaggcaggacattgctatggctggatgggacactcctcccaggcttgcaagtgtctgagaaggattgcaccccttactgagatgaatatgattaaagaaaaagcacctgaaaataagcagtgttcccatgggctcaggactggctaggtagtatttataggactcaatgtaaaaatgaaaatgtgggctctttattttaaaatgattaagaatttcaagatggggacagcagagcattgagcgtggggtgcttctaggctaagtgtgaggtccccaaagccagccctggagggagctgtctctggtgagaggcatcttgcccttctgatgtcctatttcagttcctgcttctgtggattgaattaatccccatgtaaggccatctcattgttgatcttcctgctgtcttcctgtcccccagggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtgaacttccttagacttgagcgggagagagctggaggcggccaggccctgagcagatggcttggaacagccacacagagctgtgcccaggcctcctgggactgaagccatggccctggatcctctcttacattcccaaatgttgagatggggcacctagggtccctctctagaagccttgaatcctgtttcagcaccagggtttctagctgcccattctctattgtgttaaattcaggagactaaatgccatcattagagtaaaccacgaccttgtttttattacacttgaggccgtggtgctgcaagatgtgttgttttcctccaatgcttgaattcttggctccaagagaacattttatttagcctagcctcctaggccatctttttgttggggagtcatttgttgcaggataatatcaaaagcacttggacagagaaatcgattagaactgccagtgaaaccaactctggctgtgtagtatgtgctggtgtgggaaaggacctagcctggggctgtggcaatcccgattcatggtgctttcaagtcaggttttcttggaattctgggtttgctggggtcttctgagtggggttgcctgtgctcccctagagggcagccatgaaatgggagcggtggtgcagatgggaggctgaattcttctgcatggtgttgagtggcaggtgcagattggaggctgcactcttcggcatggtgttgagtgtttgtgtgttgagtgtttcggctgcactattgattcccagtgacttctgatcagcctcaaagcctctgtctacccagtctttgatgggcatggtctggatgggctgttgcaggtcttcgatgcccgcagctgttccactgcccgggaaatgtttgaacacatctgcagacacgtgcgttactccaccaacaatggcaacatcaggtcggtgcacgtttcccagggctgcagaggggcttgccttgcctgagaatcttagccaaaagatgcagcacttgggtctaggggaggcatctccagctccaggagaaaccagggagaaagaaaaaagagaaagactcaggcttcttcggggacttccagtagtgagcccagcccctgtgagctcagctcccatcggcaacccatgcccttggtttccttctgatgtggagccacttggaggggatggaggatctttaagaagtaactgcttcactattcagggttggggctcccattttttagaaggcatgggacattaagaggttaccttcctctcccaaccaacgaggtcaaagctaataggactgaacagctcatttggtcattcattcatctttttgttcagcaaacactcagtgcctacctaatgcaactcaacacaggacaaggctgggagagcagggggaagatggggtatgggggggtaggaggaagagtgactaggaccctaagatgctgctccagctggtgtgagcctatgacctgcactagacaggcaaccagctaactcaactgcaaggacggagacataggcagtgagggaaagactggcagatcagctaaccctgcctgatggatgggaaggcccccttgagggggtggaccctgggtcttgagggagggcagcaggagaaggcatgtcaggaggctggctcagtcagcttgggatcaggggctgcagagcaggtagggtggagagggaggtagggccagtgcaggatggctgggcccccaccagggctaggtggtaaacagtactgttcctgtcctgggaaggtcggccatcaccgtgttcccccagcggagtgatggcaagcacgacttccgggtgtggaatgctcagctcatccgctatgctggctaccagatgccagatggcagcatcagaggggaccctgccaacgtggaattcactcaggtacccggcccagcctcagccgccggccattggggcggggagccccgtggtgagcgagtgacagagtggagcccagaggagacacgcagcccgggcttacagactcacagggcccgtcttgttccccagctgtgcatcgacctgggctggaagcccaagtacggccgcttcgatgtggtccccctggtcctgcaggccaatggccgtgaccctgagctcttcgaaatcccacctgaccttgtgcttgaggtggccatggaacatcccaagtaagtaggctgagggtgctgggggcaagggcgagtcaacacacagcccttctcctttcctaagtgcggctccagccttccccataccttccctaaagcccagccagcagcaggtgacactcagggggctggccttcaaggactcttttgtcactgttgcattctgcagccattctgcactggcacctcgggcctcagacaggtggatgtgttgatgctgaggggaagcagaggcttaggcggatggggccccaggagcttgagaagcagtgactgcaggagaggaatgcattgagattctagaaaggagcagcccaggcctcttctgccctcctgccaatgctcttagctgtccctctcctgtcgggatcatatagggctgcagtgacttcaagagtcctactggcccagcccctgctctaggcagttctcataattgcaaaaatacctctgcgtattgagatttactctgtagcagacattgggctgggctcttcttcctggccgttgaatgaaccaaattcagtcctgactcacagcctttgtactccctgttccctttgcatgacatgccttttcctcagaatttttctaggctcatttcttcttgtcaaaaggtatttcctataatgtcacctcctctgagaaggctctctgaccactcaagctagaggaggcccccttaccctcagtctaacacatcatcttgtttttatttcttatatatttgtttacccatttataatctagagtctagacattagactacaagttccttgagggtggagatcttttcttttctgttcacaatgtatacccaacagctagcagagtgcctggcacatagtaggtgctcagttataaatatttgtggaataactgaatatacaagtgaatgatattactagctttataataattccatgaatttgatgctatgtttctattctgataatggggatgttgaggctcagagaggctaaaaaacatcccaagttcacactgctagtcagaggcagaacttgaaccccagctttctgacactggagtccttaattgctctgttgtgttgcattctcagcatttagcacagagcctggcacatacttgaagcttaatataggtttgcatgaatgaatgagtgcatgaatgcataatttaataaatggcatcctatgtgtccaatacgtctctctggctgggattaactcagaatcaactcttggaaaggagttttcttgtttgactctttctgaagcttttttcttggtgggcaggtgggggggtcagtgggaggccaaaggtgcaaaagtgaagcccccagcgccagacaaggtagttcacacctgtaattccagcactttgggaggctgaggcaggaggattacttgaggccagtagttcgagaccagcctgggcaacatagtgagactctataaaataataataataataataataataataataataataataaggaaaaaaattagctgagcaagatggcacatgcctgcagtcctagctacttgggaggctgaggcaggaggatcgcttgggcccaggagttaaaggctgcagtgagttatgattgtgccactgcactgcactccagcatgagcaacagagcaagaccaagtcactaaaaaaaaaataataataaaataaaaataaggaaggccccagttaaattgtgtctacctttttgccagatacgagtggtttcgggaactggagctaaagtggtacgccctgcctgcagtggccaacatgctgcttgaggtgggcggcctggagttcccagggtgccccttcaatggctggtacatgggcacagagatcggagtccgggacttctgtgatgtccagcgctacaacatcctggaggtaacccagccagcccagctggccagatgaaggtgtgggcctgggggtggcttcagggaccgactcgccgctatcactctgcctctgtaggaagtgggcaggagaatgggcctggaaacgcacaagctggcctcgctctggaaagaccaggctgtcgttgagatcaacattgctgtgctccatagtttccaggtatgtctggagttttgtgagtctgaagactttttggtgagaagcttaactgatccagtgacttatgtgatgcttaatttataagtaagcccccttgctcactctagaggtccagcaacaggcagctcctcacctcccaagactgttcaatccctgtacttgagcactgaattctgtcctctctcaatcgctcaaggactttactcccaaaaattttcctcttctctctctgtatcatcaatgtctctctctctgctgagtcattcccagcagtgtacagacaggctctcttagccccatttcaaagaaagaaatgaatagctaaccacataactcctgccaaacctcaggctccctccagccactgcctcacccttctgctcctttctacagcaaaactatggagagatctcattgtgcttcctcatcccccaactgcttcagcctggctgggcgacagagcaagactccgctcaaaaaaaaaagaaggcctccctgaccgtgccatgtaaaatgacgccctcaccccactgccaacctgtctctctgtgttagtcctttaaccattttatttttcttcaaaatacttcctcatacagttcctggcattatataggacatcgactttcttctttcttttcctttttttttttttgagacatcatctcactcggtcacccaggctggaatgcagtggcatgatcactgcagccttgacctcctgggctcaagtgatcctcccaccttagcctgccgagtagctgggactacaggtgcataccacgcttgcctaatttttatatttttagtagagatggtgtttttccatgttgcccaggttggttccgaactcctggcctcaagtgatccgcttgcctcagcctcccaaagcgctgggattataggcataagccacggtgccgggccagctttctttattgtttggtttcctccactagaatgtaagctccatggggcagggaccttgtctgtctgtttgctgctgcacctctggcctagaagagtgtctggcacatggtagatgctaaaataatttgtctttgaagaatgaatgatgagggccacatccgcgatctggcctggcacaaactgggtcttcagtccttgtctgacgtgtgcatgaatgagtgatgctgggaggggacctatgagctgtggctgctcttgcttgctgtgcgaggatgacaacctccacctcctcttaagcccacacacagccgctgggctcctgtgtagggctaagccctcaggcccatccgctgctcttactcatagaaacacttcccttccctgtgggaaggaggcctgagatgtaggaagatactactttagaagccacagccattgccacaaagctgacagatgccctggagaccccaccactggtcagtcattcattcattcagcagtgttttactcagcatttgcctggtgctgggcactaggctgggccaaggatgtgagtggtgaacagagtacagatgagcacacactgttccccatgactgggtcaccccataggcagatcaggcctgtgcttgacgggggaggggaagatggaacaggaagagccccccggtgtttcgggaagggctggctttgcaccacacatcctgactcctggggactcccagcaccagccctgatgctggcaggatgtggatacgtcccagaaaatctgtgagcctctgctgtctcctcaccgtggctgactgtgtccttccactgcctgagcgtctccaggacttcctcaccaccctccttcagggtaaacttcaaaagatgggcccttgtttcctcctctgtaaaatggggataatagtgcctccctcatctgaggattataagagttaagtaaaaatgcatgcaaaatgtttagctgcactgcctggcccatagacaacactcagtaagcaatgattttcttactgtttattatgttgtcatcatgatcgtggctaccactgagtttttttttttttttttttcctttggagatgaactctccctccattgcctaggctggagtgcatggtgtgatctcggctcactgcaacctccgcctcctgggttcaagcaattctcctgcctcagcctcccaagtagctgggattacaggattgcaccaccatacccggctaatttttgtaattttagtagagatagggtttcaccatgttggccaggctggtctcaaactcctggcctcaagtgatccacctgtctctgcctcccaaagtgctgggattacaggtgtgagccactgcacccatcctgtagctaccactgagcttagaactgatctggctcccaggagttgctgtgtcttggaagaataagtgaatgagagcccacgtccacaagagtggtggccggacttttatatacacatatataacttatgtatgtctattgaatttacaaggcatggctggccttcccaggcctgacaccagctggatcctctcatgcctccctgccttgactcatgcagtgccccactcaactaacttgcacccctctcacaagtctcccttcctctcaggagctgctcccgaaattcgccaactcaccctgggcctctgtctggcgttgtatcctctcttctgcccttccccagcacctttgcctgcctccatcagagtttctatcaggccgtgtgaaaatgactgattttccttggcttccccacccagttagactagactctaatgcagagaaagggctgtgtctttcccttctataacgccgatgccttatgcagtgcctggcagatggagattataagagcagctaatatttattaagcacttactatgctttgcttattccagcttattgcatcctttcaacaacctcatgatgtaagaactttttttttggagacaaggtcttgttttgtcacccagactggagtgcagtggcccaatcatggctcactgcagccttgacctcctgggctcaagcaatgctcttaccacatcagcctcccacatatctgagaacactggcatgtgccaccaaacctggctaatttttaaatttttttgtttttgttttttttaagacagagtctcgctctgtcacccaggctggagtgcagtggtgcgatctcggctcactgcaacctccgcctcccgggttcaagcgattgtccttctttagccttctgagtagctgggattacaggtgtgtgcctccaccatgcctggctaattattatattttttagtagagacggggtttcaccatgttggtcaggctggtctcaaactcccgacctcaggtgatctccccgtctcgccctcccaaagtgctgggattataggtgtaagccccgacagctggcctactaatttttaaatttttatagagacagggtctcaccatgtttcctaggctgatttcaaactcctgggctcaagcagtcctcccacctcggcctcccaaagtgctaggattacaggcatgagccactgcacctggccattataggaattcatatcactcccatttcacagatgagaaaacttaaagaactaattgctcaaggtcacatggcaaataaaaagccagagtttgaaccactgtgttaaacaaatgtctcttgactgaatgggttgccacagacatagaggccagtggctgccttgctggaccattccatggggtcagaccccacagcccgtaatttcagactgtgagtgattcgtctcccatacactacagttctcccaatgcttcagacctccccacggaggggtctggctccttcttggctgaggaggctacaaccccatggaagtgactcttagaactctccaccataaatggctgggatggtatttcctttacctgccaaaaggtgctgtggtttaagttatgcagatccagagagagccatttgctgggagtctggggagacctgtgggcatgagaggctggatattgccctcaaagacttaagggaggcccccatgggacctgtgggctgaccctgactaatgtgctttcttgggctctgtcagaggctccacaagcgccttccatttgggtgtttattttcagcaggcaaggagagggccaggagttgctctcccgtgttacagattgccaggccttcccaggcactctctgggagccctgcggccaaccggcccctctcctgattcccccacccttatctccactccctatcttgccttctgatacagaagcagaatgtgaccatcatggaccaccactcggctgcagaatccttcatgaagtacatgcagaatgaataccggtcccgtgggggctgcccggcagactggatttggctggtccctcccatgtctgggagcatcacccccgtgtttcaccaggagatgctgaactacgtcctgtcccctttctactactatcaggttaggggccttcctcttctctccttcctgggggctcagatgtggctgtatgtgtgtgtgtgtgtgtgcacctcattgttacacatgtagggcacgacgggaagcaggagtatgttgttagagctttccaggccccactcaaggatgctgagcagcctttgtgcatttccacggagagtggcactgaaggaagtggcttccactgcaccgctagtggcctgtggctcagatggggggtctgtcattacacctgcttccacgggagggcccggcaacagtcactcagcagagtgttgaggggattggcccctgagtcagacgctattgattctgccacttcctagcaatagggtcttgggtgggtcctttcacctttctgagccctgatcttctcatctctaaaagggatgggcttcactccacgacggggggttgtgtggatcacaaagctggtgtatggaacagctcagcccagtgcccaatgcagaatgcattcagtaaccatgagctattgagaagagttcattttgtgccaaaaaggacttgggttggattttaagagcttccttcatctaaaggaagagcttcctccatctacaggacctcacatgcagggtgacggcatgtcctggagtcttgcctgttgtagtagcagctcttcttgctctcaaaggtgtctcggttgggactgtacattatgtcatctgcctgctgataagatgctaaaagcaaaaggagtgcagcctgttccttccaggaggacactaatgagaataagggttagccgccccccctcgatgtgcaggctccatgccgggcagtggagaggcaactctgggggagaggcagccacggccctcccttgtgggagttcagtgacaggggtggggcgcaggccagccttctctcccaggctcatgatgggtgtgaagggtcctctaccactccagcatccgcgagccgagccaagccaggaccccgccctgccctcacatctcctttcttttctgaaggtagaggcctggaaaacccatgtctggcaggacgagaagcggagacccaagagaagagagattccattgaaagtcttggtcaagtgagtggcagtggcagtggctagtagtgatgtgtgaactatatctctcccttctagtcagcctctgcctccagtccttgaagggcaagaacacaaggaatggttatgctttttgcttttgtttttgagacagggtcttactctgtcacccaggctggggtgtagtggtgccatcacagctcactgcagcctctgcttcccgagctcaagtgatcctcccacctgagcctcccaagtagctgggaccacaggtacaaacccacgcctgactaattttgtttgttttttttgtagagacggggtctcgcagtgttgcccaggttggtcttgaactcctgggctcaagcgatcttcctgctcagcctcccaaagtgctgggattacagatgtgagccacggcacccagcctgggaatgtatattcttcgtggaatttggctcccagaggtccagtcgccaattccaagggtcccctgctgccattgttccaaccttctctctcctcccttttcccaaaggggcctatagtagtgggtgaggggaggaaaagggtgagttgtcacggtacatggctggtgagaaacgtagcttgcttttccctcaacctgccccacattaaacgctgtcccctcccattcccctggtcccccattttcttctggaaggctgactcagcacacagcgcctgcctgtctgtctgtccccacagagctgtgctctttgcctgtatgctgatgcgcaagacaatggcgtcccgagtcagagtcaccatcctctttgcgacagagacaggaaaatcagaggcgctggcctgggacctgggggccttattcagctgtgccttcaaccccaaggtactggctcagtgggatggctgttgttttttctgcttgtgtgcaggggagtctaggaaaagttaaaacggtttccccactcctggatgtctcagagtcttggatgtggtaatgtgcatcattaatctggaagagaaggaaagacttgtgtgcagggattcccaaacttacacagtagatgagtttttcatggtgttctggagaacacagtttgagaaacactttcacaatgaatccaggcctcaacatacatcagctgctctggctgaactttattcaggctcactgaacacctgctctgcaggatgcagtgctgcatgtgaaagggggaagagatgagtaagcttcagataaacaaaaaaaggccgcagagggtctgtctaagctctatcccctgccttcagcactgatggataaaatccaactcttagggaatggtggccacgtgctggaccagccccgggctctgaggatctgacagtgggtggcgcagagccaggccttgcccttggggagctctccagcatacaccccaccctcccctcccagcgccctgcaaagcaggcgtcaatgccattgttaatgcacagaggaggaacctgactgttagacaggttgatgggttttccagggtcgcacggcttctgggagatggatgtgactctgaggacagggcacaggccagtgtaatgccacgatgggatgagctgtggtctgtgccacgtagaggcttaggccaagggggcactgactgatgaccaggtcggccaggttgctgaaaacacctcttgggtccaagcctcacctgctggctcccaggagtctggaactgccaggagagtggtggcaggtcccccatcctccgctgggtgggcctggatagaacagcaagatgagggcacatttccccggccattccctccaggcacagctgtgacctgctcattccaattttgtggaaatatttccacacacacaaaattgcaaatagtagtggacatggtgagaggcatttagacatgggaaaggcagtatttttgggacagatcttccagggcttgccaatgtgttaaccatagggcttaagcggggaaggagaacagaggatgatgtgttcaaattggttcattcacgtcctctgtgccacgcctgtgccgggccctgggagagacagatgagcacaggagccgcagcctgggggcagtgtgggaggaagcccagggtgtctgcgcagggtagggagggccctactgggagccgagggctgatgtccacttgggtgccatccaggttgtctgcatggataagtacaggctgagctgcctggaggaggaacggctgctgttggtggtgaccagtacgtttggcaatggagactgccctggcaatggagaggtgggtggcttgaggtctggctggtctagggggtggtagggcacgggaggacccaggaaagggtctgggggatgcggcaggtcctacggaggacatttgggagtcagtgctcaggccactccgggtcactcaggtcatttgccggcctccattgtaattattgccatatgggagtgccacctttcctatgacatatttaatatatttctgtgaatggcctacctgtttgtatttacaaattcatatttaaaggaaacttgtatcactctcacaaatggaaagcagcaaaacataaattcaatgaaaacaaaatgaagttaatgaattttagctagatactattccctggccaaggcctgctctttgtttgttttgtttgttttttggtttttggtgtgtgtttgtttatttatttatttatttacttaggtggagttttgcttttgttgcccagggtacagtgcaatggtgcgatctcagctcactgcaaactctgcctccctggttcaagtgattcttctgcctcagcctcccgagtagctgcgattacaggcacgcgccaccatgcctggccaattttgtattcttttttttaagtagagatggggtttctccatgttggtcaggctggtcttgaactcccaacctcaggtgatccgcccgcctcagcctcccaaagtgctgggattataggcgtgagccaccgtgctcagctatctttgtttttaaaaaagactaataggcaatgagagaggtattaaaggtctattagcaccaatatgagactgtctctccagtgctccgaagaatgaaaatgtaattgaaggggaataactaaaaaataaattatgaaaagggagtaaatactcaccatgggatttgacgctagttctgctgggtcacatacctcctggaatcatcttggcttcctggaaagccagccttatttcagagactgtaggaccaattgttgttgcttctaccgggttccaaacagaatcacggcgcattcggagcccctctggagaaggcatgctaccaggcaggcccctctgccagggctggatgggtgggggcccagctgttccaggtcccccattaagaggcagggcctacacaagttgctacagtttagttggagtgagagacaagctaaacttgtcagctgacaaccaggtccttggccaggtagccccatatgtaaaccaacttccgtggtgggctgtgagccttctcctgcaagctgtggccaggtttccagaagaaaggaaaaaacagtgtttttattcatcctggcttgagaactctgtcattccctctctttctagaaactgaagaaatcgctcttcatgctgaaagagctcaacaacaaattcaggtaaagctttttccgttgtcctactcctagccctgccctgtggacccaaagtctgggttcaggggatggaactgggtgtgcacagggggtcttctcagaaccgtgcaggcacagagacctgggtctaaggtctgtactcagaatgtgtcgagggtcaaaccacagaaaccaagtccctctcacaggtctgcaggccaagcatggggtggtcatgggagttggtgacaaggctgggggatggagaggaccagaagggggtccagctccattctccagctggagggggagagtctggggctggctctccaggctgttggtgctgggtgctgggtgccaggtgctgcttgcatgggacatgtgtctctgtgtgtgtcctcgggcaggtacgctgtgtttggcctcggctccagcatgtaccctcggttctgcgcctttgctcatgacattgatcagaagctgtcccacctgggggcctctcagctcaccccgatgggagaaggggatgagctcagtgggcaggaggacgccttccgcagctgggccgtgcaaaccttcaaggtcagttcccagccagagctgccccacagcagggacatgacagggtgcattcatgcctaggacatctgtgctgggcgtcccaggtggcatgacctctgcctgtggtcctgtagatgtggtcccaggcatgggccagggccacaaacctgagggcttaggtcactgctgctctccctcagccccctagaagagctccaccttgtgcacacaactctgggggagaaggtggcacagatacccccctgcccttagggagcttctagtttaaggtctttcctccagtgactacctaggtcacctcttaactactgtgtctgtttcagtctcacagccatagagagcctggggacaggcaccacacaatggcggatccactttggatccactcagtatctccatagctctttattgctgtgattgccccagtcatttagggaactcgtcactcatgcagagcgtcactcagcggtggtgcttaggagcatcagcttgcatcggggcaggcttggttccaaagcccaggcctcctccatgtggctccacaccaggaacataagagcaatcagacctcttccagtgtgggcatgaggatacaacaagatcatgtcaatattggcattcatagtggtcgggcacagtggagcatgcctgcaatccaagcactttaggaggctgaggtgggcagattgcttgagcccaggagcttgaaactagcctgagtaacatgtgaaacctgcctctaccgaaaatacagaaaattggctgggcttggttgtgcgtacctgtagtctcagctactcaggtacgggctgaggcgggaggattgcttgagcccaggtggttggggcttcagtgagctatgatggcaccactgtactccagcctgggcgactgagtgagaccctgtctcaaaacaaaaacaaagcaatatttataatagtagcaatagctactatgtgccaagcccagacacctctttgagtccttgctgtcaccctatcaggtaagtgtgcttcgaagttacacgaaacacacggctcagtgtttggcccatggtaagggcctaaaaagtggtagccccagtggtggggatgctgctgctgctgaccattaaccgcagtctgctccaccttcttccaggcagcctgtgagacgtttgatgtccgaggcaaacagcacattcagatccccaagctctacacctccaatgtgacctgggacccgcaccactacaggctcgtgcaggactcacagcctttggacctcagcaaaggtacctgcttctctgcagcacatggggcttgtttgtgttggggtctgagccctaagcccatggtcaaggagacccccaggtctttctgaacagagacagctggcctcggggcctccctctcactgcatgcaagagcctgttagggcataatactcaaggtgctgagggaggctgtttcaggagggagccccaggagggtggtggagacagaagggatcagcatccgccaagggcctactgtgtgtcagacactgtgcggggctcctggcccacatgggctaagtgagcctggacactcctcctgggagaaaggcacagatggagaaattgcagttcaaggaggtgaagcaagctgctagcctgtggccatgttggggtctgagccccagccttccagctgcgaaggcagccaagtgtcgtagagaaggtgtcacagaggcgattccaggctgtagtggtgaactctccactctgcacccccaggtgctgtgccctgtgccctgtctaagatagtcctgaaggtttctgcatatttaagatatccccaatgtcaacaatgctctcctgtggatcccaagccatggagatgtcccgggactttccatttttaggttcctaaattgaatttcccaacacctagaagcaacacttagaagctgccctgtatcagatcaaggagcttttttttttttttttttttttttgagacggagtctcggtctgtcgtccaggctggagtgcagtggcgcgattcccgcttactgcaacctccgtctcctggcttcaagtgattctcgtgtagctgggactattggcactaccaccatgcctggtttcagtatgttggccagtctggtctcaaactcctgacctccagtaatccacccaccgcggcctccaaaagtgctgggattacaggcatgagccaccatgcccggtctggaccaaggatctttatttgtggaataaaaggaagaaaaagaaaaacccaacggccacctcagcaggatgccccaagggtggtgttcagatgtcactgactcagacatctgggggcttcccctacctacgctcaagaaccactttgccatttcaccgtctctgtgtcctccacagccctcagcagcatgcatgccaagaacgtgttcaccatgaggctcaaatctcggcagaatctacaaagtccgacatccaggtaagggaaagtgcagggcttcgtgggtgatactctgtcgattttattttaacgaatgaaagatcagaagaagtcagtctttgaagggagaggagaagagcatatgctggcattagcagccacactgtcggtaggaccggcccacctggtaacctgcggccacctgtgcttttacgtctactcttggttaaccacgagccacttttccagcttggactctaagcatctgctccacttcctctccttcctcattgaactctttcactaaaaggagagtgcaagagagacttaaactgtttgattcattcttaagaactttcaggaaaagtgttggcagggaaggaaatttcccagctctgggaaagagccttgtggattatctgcaggtttcattgatctgtgctgtcctccccgcatgcattaggaaaactggccttggttctaataagaacagggtttgtcctggcaacaaggaaaggtttcttctgatatccatgtatgtccaaggcggatgctttctttaggcagaggctgtagccaagccctcggggggctccaagggctgctgggaaggggtgggcccccctcctccccagagggaagctcctggggccctcttaagcacccctgcctgtggggatgcctcatcccaagctcagggtggtggcctagcttgtggaaccagccaggaaaatgaaaggagggcacatttcctggggaatctcgcctgcccatcaaggagccctggaggaaatcctgcaatgtcacctgaggcttcattttccttccccagccgtgccaccatcctggtggaactctcctgtgaggatggccaaggcctgaactacctgccgggggagcaccttggggtttgcccaggcaaccagccggccctggtccaaggcatcctggagcgagtggtggatggccccacaccccaccagacagtgcgcctggaggccctggatgagagtggtgagtcccgggctagaaagccagtgctgcctggcaccctctggccgccccacctggctgaggggctgagcctgggcctgccggtgacagccatccctgtccttcctgctgagagggcgggccaccaaagcttatgtgaaagcagctgtggaaacagtcccagcccataaggcatggccccctggccttagtttccctaatgataacatccccctcaatgcagtggccaaagtcagaaagtgggatgagctgggtgtggtggctcacgcctgtaatctcagcactttgggaggccgtggcgggtggatcacttgaggtcaggagtctgagacaatcctggccaacatggcaaaaccccgtctctactaaaaatacaaaaataattagacaggaatggtggtacatgcctgttatcccaatcccagccactcgggaggctgaggcacaagaatcgcttgaagccaggaggtggaggttgcagtgatatgagatctcgccactacactccagcctgggtgacagaaactccatctcaaaaaaataaaaaagaaagtgggatcagagaaacagagcctggcagtgacccccactgtccaggagaaagtgagagaacctgagacgtggggacgacaagacagttgcccttgtgactgtagggtgaaggatgtggttcatcaggactctgttccagaggagagaatgtcaggctcttatttttacccagtgtttacaaagcatctgtgtaccaggcacggcaccaactattatggcacaatttcattcagtgctcatgccaacccagcaagataggttgtgctatcagatctgtttcacagggagggaagccaaggcccagaggcttcagtcacctcagaagtggggagccagggtttgaacccgtgtcttctggcaccagggtctgtgctgtgactgccctgcatgctgctccctgggacttccctttgggctcatctgctcacccagcacatcttggtacagcacccaggggactgcagtcatgggcttctctctaagtgaacaactggcctgtgaggtatccattagtctttggtggatttagtcattgtgagtctgtagatcaccagtgagtgtcttgctaaagttcaggtctgggccagagaaggacgtggttagtttatcaggaccacgccaacttactgcccctttgggggctggtgatcagccttccctggcagtcctttctccatgcgccaccttcttcctgccttttgctcttagagccaggtctttagagcctcctttcccctgcagctggagaatagagggtgtctgcctgggggcctcgctacctactgagaatcctgaatggggcctcttttccatcctgacaccttccttccccatccaggcagctactgggtcagtgacaagaggctgcccccctgctcactcagccaggccctcacctacttcctggacatcaccacacccccacccagctgctgctccaaaagctggcccaggtggccacagaaaagcctgagagacgaggctggaggccctgtgccaggtgaagatcagggctggtgggcagtgggggtatgtggggggtcccagcatgtggggagccagagtccagagctggttttaactttcaagagggatccacaccaggttcccaaagtgagacttgtcaaaggctggtgggaagccaggcatcgtccgctggcccatgtctaggacacagttgtgttgagtgaactgaatttttccaagtgtctgcaggatgcaaccagagtgcactgccttgaacattagctaggaaggggagccgcccttatccgtctttgctttccccaaaactggaataaacttgtcacttaagatgtattgggggatggatgatgtggatgaatggataaatgggcataatgggcagagtgacagatggagagctgaattaataagttaatgagagaatgcgttaactcacctgcaactgtctggttccaagtctttgcaaaaggcactggttgtcattattatcatcatcattatagctaattatctcaatttaagctacctccaccgccattattttgtggctgcaatgtactaacttggcacatgctttctcatttaattcccataacatccccacaagacaggcaatactgtccttgtttcacaaagggtaattgggacaagattccacagctagtgaggacacccagccaagatttgaacccaggtctgattggttccaaagccttgccccaaataaattacaataaagatttgacccctgcccatgagttgccgacagtggaggtaacacaagttagataaatgtactggactgagttcctccaggacaggcacttattttgtctcaagtttggtcgtctcagcaccatggacagtgcctggcacatggacttgtttgttgagtgagtgaatgaatgaatgaatactgggttgtgacagtcttttccccaaagcgggacaggcgccctgagtcactgacatcacccttggcttttagccctcagagtacagcaagtggaagttcaccaacagccccacattcctggaggtgctagaggagttcccgtccctgcgggtgtctgctggcttcctgctttcccagctccccattctgaagcccaggttctactccatcagctcctcccgggatcacacgcccacggagatccacctgactgtggccgtggtcacctaccacacccgaggtgagccaggggcagaggctctggaacagccccgctccgcccattattggacatctgttcatcaactcagattcagctccctcatcagttcaaggagggagggaacacccacagcccagagttgttaacagtattaggaggtgtgtgggaagagatctctaggaaccaggcactaaaccaagccttctgtatgtatatgatcagttacattgtggggtaggcactgtgtgcattttacaggtggcacagaaagtcacactgttagtaagtggagagctgagattcagacctggatagtctaactgctgagtccaagtcctccaccactccactgtcccactactcttgggacaatttaatgagatcagatgtgaagagcactcaacccttggtaggaggccagtggttcttagtcttcccaatcatgcagcctgaacgcaggggagattctgcattgattattcattcactcactcagctattcagtgggtgcctggcactggggtgggtatggaaatacaacagagatcagccctgccctcagggagcatctagaggcggcagtggagagataggcatagaaataattagatgattttcattgtgctgaagccaagaaggaaaggtcagggtcactgagggaagcagagcagggggtgacgctgccatagagcgggaggccaacatctcgtccaggtggtctcggctccaccactggccgctgccccctgccctgccctctgtaactgagcattgcctgggttggcaaagctgggagctgcccacacttccgagccctctgtcctcaagaagcaaaaacacagtttctaaaaccttggcagagactctatttgccctgctagagaacagcccacccagaccaggagaggagaggcctacatgtcttgtgagagcaaaatttaatcccgaggaaaaccagggggacctctgcagttggttggaggccttcttcaagtgctgggccattgtaaagggaacacaacccagagagacctcctgggtttctacaagcccaggagggcccactgaggaggaaagcaaggtgccagagcaggctgaaatgcgcggagctcatccaccacccagggttgctaccagcaagggccacgctcatgagcacgcacagcagtagccaccctgaggggccacttcatgctgctgtcagtggagctcagtggtgagctgggagtgttcccggagaaagtctttggaaggagcactggagtaggagtcagggaagctgagctgtccacctgattccaccacgacctgagtgacctttttcaagtcacttttcctctccccgtctcagtttctgcttgggcagaaggagcaacttgcagcctctctaagtccctttcaacgttcctcagctccgcgcttacagagggtggatctcagaaccaggaggacaaacagctgctcattgagtcctgagagtgcctgagtgggggcgtccaaggaggccgtggtgtgggcggagcagctggtacagtttgcgcatgggcagtggggggacgttggtcactttgtggtatcgttgcagatggccagggtcccctgcaccacggcgtctgcagcacatggctcaacagcctgaagccccaagacccagtgccctgctttgtgcggaagtaagcaccccttccactctgtcccctgtggggccgccgacccctgggagttccgggaggaaagggagggatctggggtttaggagacgctcggagccccttggcccataaagaaggcactggggtcacactggtgtggctgcctgtagcagggacagcgatgacaggtgggtctcaagagtccagtgagcttggccctttttcagaaggacctgggggaggtgctggtgcctggacagaagtgaagcagcctgcaggacgtgggaaatcaaataggagcttcttgtcctctccaccccctcacgaccgcctcccacaggcccagctccccagccatcctgtgtgtgcgtgggcctggggtgtctgaggactggccccctcttctcctgtcctcttcagtgccagcggcttccacctccccgaggatccctcccatccttgcatcctcatcgggcctggcacaggcatcgcgcccttccgcagtttctggcagcaacggctccatgactcccagcacaagggtaaggctggaggcttcccaggtgggaggggcaccagggggccagcgcctgcctaggagcagaactgcagccccacaaacggttcctgacctctctcgagggaaggcctcccaagtttgcttccctgtgcgggcctctgcgggttagaatggctgcctttccgtctcccgcatagtagccagggctccctctcctgggagtggaggtaacaggaaagtccctgcttttgatctccgattggctgagggaattctgcatccgcactttcagttctgtgactatggatgagtgatctgaatgcgctgggcctcagtttcctcatctgtaaagtggggataatgctattaaatagctagtgggagtgaagtgagaattccagttgggcttggagccctggcgccctctggtggccaacatggtaacaacagcccgggactcctgcaggagtgcggggaggccgcatgaccttggtgtttgggtgccgccgcccagatgaggaccacatctaccaggaggagatgctggagatggcccagaagggggtgctgcatgcggtgcacacagcctattcccgcctgcctggcaagcccaaggtaaatgcagcctcaaagcaggtgaagcattacacacacaagctccactgtgagccctgggtccccacaggcccctcgcctccccgagccttcacctcctgagctcgaaaatgctggtaattcacaaccatcagagtgatgctgtgaagagcattacaccctctcatacagcagaagcgacagacctggagaggttcaggactaacctaggtcacacgcgggttaaccccagagcccagcctgctgaaggtccccagcaggccccctgggacacgcgactgcccggggagaggtggtccaggctggctacgctcaagccttgcaaggctggagggcggccgatgcttccaccacggccatcagaggggctcttctgtccccagggccgcgttaccccctgagcctggggtgtcagaatagactctcggccttcacacatttgtcccatcagggcacctcttgggcccagtgctctgtgcccagtgctggggccactgggcatcctgtgtggagcaggagcagagagtccctgactgactcctggaccttgtatctggggagcccgggatccataccctgcagagacctaatgggtagactgcattgagaggctcccttttctggggtgtaggcagagccctgggcagggggactgccttcattgatgcctttttgaagcatggcaaattcagagacagtctgggatccccactggatggtcagcccctcgagggcaggactgtgtccagcatttatctctctaatcccagccgagccccaggggcatccatgcacctcatcctgagcctggccccttgcaaggtcctggctggaaggggactcactcctcaccccttagtgcccctctccccgcctccttgaggccagcaggcctgcctgcaagccttgtcctgagcagctgaggactgaacccactgtttcctctggtttcaggtctatgttcaggacatcctgcggcagcagctggccagcgaggtgctccgtgtgctccacaaggagccaggccacctctatgtttgcggggatgtgcgcatggcccgggacgtggcccacaccctgaagcagctggtggctgccaagctgaaattgaatgaggagcaggtcgaggactatttctttcagctcaaggtatagtagtgggtgtgtgggctgaaggtgccggccaagggcacaggccgttggagccaggaccaggggtggcaggtagacccaggggaatcaggcccagaaaggttctggaccccaagagaatcttagcagtggctgagatctgagctgggtgggctgtcagatggccctactgcacatcctggaccagttggcagctttgagaagtcgggtgaatgtgttccatttttccatctgtagaatgggggcaggagagtctccctggcctctccccaaacccccctttcagaaagtatctgtgtggccaaagcaaggctgtgaacacaggggagagcaaggctgccccccgtcagcctcgtgtgaacctcacacttcttatttacacccaggctggtgtctgctcaccctcatccccccagcaggaagggcttgcattttattgatgaagataatagtgatatttatcaagggcttacactgggcatactgcttgccaaggattctcatgtgacatttcattcagtcctgccgaggactttatgagggaggcacccccttttacagagggaagggggcctacggggaccacagcagtaaatgtgagagcctagagttcagtctgcctctctctggttccaaagcctgtgattgtcacttccatactctccctaagacacattcatacgttcaactgaacatttattgagcacctactatgtgctagggatagagcagtaaatgaatcaggcaaaaattctttacattctactggggctgacaaacccagacaagaaagaggtgtagtgcttcagagaaaaacagcaggaaacagcccagggaacgctggggagtgtaattttaaatagggtggccagggaaggcagagctggaaggtggcatctgagaataaacctgagatggtgaggaggagccctgtggatactgaaggaaacactctgggctgttctggaggggcagcaggtacaaaggccccgggggtgggagttaagctggcgtgtttgaagaacagtgaggagataacaggcatttccccaaatgtgttcagtgggtcggtagacagttggcatcaaaaagattccaaggtcgaatagcctgggacatgcttagttaaggcaaggcaaacacgttgctttactacaagacttctgggagccttcagtatgctgctgttcatcaggacccttcaaggctggaaggaaagaaaggacgtagcatttcccaaacatatttatctcagagctcacacttcctggagtatcttgggtgggggatgaacgctgggcaggaaatgggtatgctaagtaaagctttggagatggttagagggcccgcaccagagcaggtgctgagcagggttagggtctaaaccagattcaagcacaatctaagtataacagttgggaagacagatggctcatgaaggtccatgtgatagggaagctgggcaaccccaggggctcatcccagcctggacttgacacgttgctctctgtttttacctaaaagagccagaagcgctatcacgaagatatctttggtgctgtatttccttacgaggcgaagaaggacagggtggcggtgcagcccagcagcctggagatgtcagcgctctgagggcctacaggaggggttaaagctgccggcacagaacttaaggatggagccagctctgcattatctgaggtcacagggcctggggagatggaggaaagtgatatcccccagcctcaagtcttatttcctcaacgttgctccccatcaagccctttacttgacctcctaacaagtagcaccctggattgatcggagcctcctctctcaaactggggcctccctggtcccttggagacaaaatcttaaatgccaggcctggcaagtgggtgaaagatggaacttgctgctgagtgcaccacttcaagtgaccaccaggaggtgctatcgcaccactgtgtatttaactgccttgtgtacagttatttatgcctctgtatttaaaaaactaacacccagtctgttccccatggccacttgggtcttccctgtatgattccttgatggagatatttacatgaattgcattttactttaatcacactgtatgcgtgtgtgggtgttttgtagggaaagctcttctcagagtggggagctggtgggtgtcacagcctggacagatccccgacagagggacaccccagccagtccatggctcctctgaaatggctgccaggtgtgccagcagcagatggagcttcgtgctggtccaaagacctgtggtagggcagggggcgcaggcctgcctcccacacaaagtatctgaaacggggtctggtgagggtgggattgtcgcataaggccagtgtttcgaggaaggccttgagcttcttcttggacactgtcttagaaagcgttttgctctggggccaccagtctcatgcgagactgtgccttggccagtacggatgtggtccctgggaaggcagcgtgtcgaggcgagtgtgggccacagcatcctcgcctgagggactggggaccctcttgggtttggagcaggccaaggaagccttcttaggagagtgggccccgtttccttctcctggtcagaaccaaaaaaggagctcagcggcggccactggggtcctggcaacacacggctcccagcttaggtttggcctctgcctcctgggtgccctggccgacttcacccccttgcccgccaccttccccttctagcagtagcatctcaggggcaggagaaggggcagtgccaacctcaggctccaggaaagctccatgccctgcgcgacagccgtgcatctcagcaacaaggccaggagtccgctcccggaccagggctttccagctttaatgtgcgcacctcgtctggggtcctgtgaaaacagagactctgacctcgcaggtcgggtggggcgcgggatgctgcgtttccaacaaactcccggatgcagctggtgccactgctctgaggactactatggggcctgaggaactggattcttactgggctgagcaggatgtgttggcatcacctggatgcagagtcgggcttcctggcagtggcccagtggctggcagaacccaacacatgaacactgagccacttttcctatgcaagccctaacccctaatgccggagagacccacaatggaacacacacccagacggtgcttcgggttggcttctcctgacccccctccccaagccacctcctcccactgggacgccaggtctgaggaggcagctctgaccctgctgtggccctcacaggctctgccccagcccctctcccatctcggaggcatggggctgtttcctggggtaccccattaccaccttcctgtgtccgagactcctgcccaaaaggctagagccccagcctgctttctccaacaccctcgtgggatttgtgagggaccctctgggaggaggtgtgaggtcaggaccccctgcccaaagggagtccatgctttcccatcccactcctctcagcagcaccgccgcccgattccacagactccaaaatgtctccaaatgaattaaagaagccacggtcaacccacatgaatgtgccaacaagcattttcatttctttattttaaggacactgggaaaggagccagtcccctgaagagaacactctggtcagttggtggaggccagtgggatgccatcaggctggctttccaggagggggtgaagggttgatgcagggtgcaaggtgagagttaggttaaaggtcagaggggagggactgaggacgtcacctcccaccaggagtggacagctggtggcttg

SEQ ID NO: 15485 - DNA, 12515 bp, Human
cacttaccatgaattgggtaatgtgctcaacacattatcccactaaatcttagtaatagccctattaagtaaataccatatcataagtattatctctcttttactgacatggataatggaactcaaggagattgagtaacttgtactgaatcacacagccagtaaattgtaaagatgggactcaaacctagggagatggactccagagccttaacaactatttatttatacattctccaattgagctacacacttcttgaaggcaaaggcaatgcctgagtcacctttcatgttcaaatcatattaaaaagttagcaagatgtaattatcagtgtactatgtaaatctttgtgaatgatcaataattacatattttcattatatatattttagtagataatatttatatacattcaacattctaaatatagaaagtttacagagaaaaataaagcctttttttccaatcctgtcctccacctctgcatcccattcttcttcacagaggcaactgattcaagtcattacatagttattgagtgttaactacaactatgttaagtacagctatatatgttagatgccgtagccacagaaatcagtttacaatctaatgcagtggttacagcatgtatacatataatataaggttgctacaaatgctatctgaggtagagctgtttgaaagaatactaatacttaaatgtttaattcaactgacttgattgacaactgattagctgagtggaaaagatggatgagaaagattgtgagacttaattggctggtggtatggtgatatgattgacaataactgctaagtcagagagggatatattaaggaggagaagaaaagcaacaaatctggttttgatgtgttcactttgttataattattgattatttactgaatatgaatatttatctttgtttttgagtcaataaatatacctttgtaaagacagaattaaagtattagtatttctttcaaactggaggcatttctcccactaacatatttcatcaaaacttataataagcttggttccagaggaagaaatgagggataaccaaaaatagagacattaataatagtgtaacgcccagtgataaatctcaataggcagtgatgacagacatgttttcccaaacacaaggatgctgtaagggccaaacagaaatgatggcccctccccagcacctcattttgccccttccttcagctatgcctctactctccttagatacaagggaggtggatttttctcttctctgagatagcttgatggaaccacaggaacaatgaagtgggctcctggctcttttctctgtggcagatggggtgccatgcccaccttcagacaaagggaagattgagctcaaaagctccctgagaagtgagagcctatgaacatggttgacacagagggacaggaatgtatttccagggtcattcattcctgggaatagtgaactgggacatgggggaagtcagtctcctcctgccacagccacagattaaaaataataatgttaactgatccctaggctaaaataatagtgttaactgatccctaagctaagaaagttcttttggtaattcaggtgatggcagcaggacccatcttaaggatagactaggtttgcttagttcgaggtcatatctgtttgctctcagccatgtactggaagaagttgcatcacacagcctccaggactgccctcctcctcacagcaatggataatgcttcactagcctttgcagataattttggatcagagaaaaaaccttgagctgggccaaaaaggaggagcttcaacctgtgtgcaaaatctgggaacctgacagtataggttgggggccaggatgaggaaaaaggaacgggaaagacctgcccacccttctggtaaggaggccccgtgatcagctccagccatttgcagtcctggctatcccaggagcttacataaagggacaattggagcctgagaggtgacagtgctgacactacaaggctcggagctccgggcactcagacatcatgagttggtccttgcacccccggaatttaattctctacttctatgctcttttatttctctcttcaacatgtgtagcagtaagtgtgctcttcacaaaacgttgtttaaaatggaaagctggaaaataaaacagataataaactagtgaaatttctgtattttttctcttttagtatgttgctaccagagacaactgctgcatcttagatgaaagattcgtaagtagtttttatgtttctccctttgtgtgtgaactggagaggggcagaggaatagaaataattccctcataaatatcatctggcacttgtaactttttaaaaacatagtctaggttttacctatttttcttaatagattttaagagtagcatctgtctacatttttaatcactgttatattttcagggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaagtgagaaaataaagactactgaccaaaaaataataataataatctgtgaagttcttttgctgttgttttagttgttctatttgcttaaggatttttatgtctctgatcctatattacagatatgatagacgctgctactttgaagtccaggaaaatgttagaagaaattatgaaatatgaagcatcgattttaacacatgactcaagtattcggtaaggatttttgttttaatttgctctgcaagactgatttagtttttatttaatattctatacttgagtgaaagtaatttttaatgtgttttccccatttataatatcccagtgacattatgcctgattatgttgagcatagtagagatagaagtttttagtgcaatataaattatactgggttataattgcttattaataatcacattgaagaaagatgttctagatgtcttcaaatgctagtttgaccatatttatcaaaaattttttccccatcccccatttatcttacaacataaaatcaatctcataggaatttgggtgttgaaaataaaatcctctttataaaaatgctgacaaattggtggttaaaaaaattagcaagcagaggcatagtaaggattttggctcctaaagtaaattatattgaatgtggagcaggaagaaacatgtcttgagagactaagtgtggcaaatattgcaaagctcatattgatcattgcagaatgaacctgcatagtctcttcccttcatttggaagtgaatgtctctgttaaagcttctcagggactcataaactttctgaacataaggtctcagatacagttttaatatttttccccaatttttttttctgaatttttctcaaagcagcttgagaaattgagataaatagtagctagggagaagtggcccaggaaagatttctcctctttttgctatcagagggcccttgttattattgttattattattacttgcattattattgtccatcattgaagttgaaggaggttattgtacagaaattgcctaagacaaggtagagggaaaacgtggacaaatagtttgtctacccttttttacttcaaagaaagaacggtttatgcattgtagacagttttctatcatttttggatatttgcaagccaccctgtaagtaactacaaaaggagggtttttacttcccccagtccattcccaaagctatgtaaccagaagcattaaagaagaaaggggaagtatctgttgttttattttacatacaataacgttccagatcatgtccctgtgtaagttatattttagattgaagcttatatgtatagcctcagtagatccacaagtgaaaggtatactccttcagcacatgtgaattactgaactgagcttttcctgcttctaaagcatcagggggtgttcctattaaccagtctcgccactcttgcaggttgctatctgctgtcccttatgcataaagtaaaaagcaaaatgtcaatgacatttgcttattgacaaggactttgttatttgtgttgggagttgagacaatatgccccattctaagtaaaaagattcaggtccacattgtattcctgttttaattgattttttgatttgtttttctttttcaaaaagtttataattttaattcatgttaatttagtaatataattttacattttcctcaagaatggaataatttatcagaaagcacttcttaagaaaatacttagcagtttccaaagaaaatataaaattactcttctgaaaggaatacttatttttgtcttcttatttttgttatcttatgtttctgtttgtagatatttgcaggaaatatataattcaaataatcaaaagattgttaacctgaaagagaaggtagcccagcttgaagcacagtgccaggaaccttgcaaagacacggtgcaaatccatgatatcactgggaaaggtaactgatgaaggttatattgggattaggttcatcaaagtaagtaatgtaaaggagaaagtatgtactggaaagtataggaatagtttagaaagtggctacccattaagtctaagaatttcagttgtctagacctttcttgaatagctaaaaaaaacagtttaaaaggaatgctgatgtgaaaagtaagaaaattattcttggaaaatgaatagtttactacatgttaaaagctatttttcaaggctggcacagtcttacctgcatttcaaaccacagtaaaagtcgattctccttctctagattgtcaagacattgccaataagggagctaaacagagcgggctttactttattaaacctctgaaagctaaccagcaattcttagtctactgtgaaatcgatgggtctggaaatggatggactgtgtttcagaaggtaattttttccccaccatgtgtatttaataaattcctacattgtttctgccatatggcagatacttttctaagcaccttgtgaaccgtagctcatttaatccttgcaatagccctaagaggaaggtacttctgttactcctatttacagaaaaggaaactgaggcacacaaggttaaataacttgcccaagaccacataactaataagcaacagagtcagcatttgaacctaggcagtatagtttcagagtttgtgacttgactctatattgtactggcactgactttgtagattcatggtggcacataatcatagtaccacagtgacaaataaaaagaaggaaactcttttgtcaggtaggtcaagacctgaggtttcccatcacaagatgaggaagcccaacaccaccccccaccaccccaccaccatcaccaccctttcacacaccagaggatacacttgggctgctccaagacaaggaacctgtgttgcatctgccacttgctgatacccactaggaatcttggctcctttactttctgtttacctcccaccactgttataactgtttctacagggggcgctcagagggaatgaatggtggaagcattagttgccagacaccgattgagcaatgggttccatcataagtgtaagaatcagtaatatccagctagagttctgaagtcgtctaggtgtctttttaatattaccactcatttagaatttatgatgtgccagaaaccctcttaagtatttctcttatattctctctcatgatccttgcagcaaccctaagaagtaaccatcatttttcctatttgatacatgaggaaactgaggtagcttggccaagatcacttagttgggagttgatagaaccagtgctctgtatttttgacaaaatgttgacagcattctctttacatgcattgatagtctattttctccttttgctcttgcaaatgtgtaattagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccaggtactgttttgaaatgacttccaactttttattgtaaagattgcctggaatgtgcactttccaactatcaatagacaatggcaaatgcagcctgacaaatgcaaacagcacatccagccaccattttctccaggagtctgtttggttcttgggcaatccaaaaaggtaaattctattcaggatgaatctaagtgtattggtacaatctaattaccctggaaccattcagagtaatagctaattactgaacttttaatcagtcccaggaattgagcataaaattataattttatctagtctaaattactatttcatgaagcaggtattattattaatcccattttatagattaacttgctcaaagtcacattgctgataagtggtagaggtagaattcagactcaagtagtttaactttagagcctgtcctcttaacaactatcctggttgaaaagcaaatacagcctcttcagacttctcagtgccttgatggccatttattctgtcaaatcatgagctaccctaaaagtaaaccagctagctcttttgatgatctagaggcttctttttgcttgagatatttgaaggttttaagcattgttacctaattaaaatgcagaaaaatatccaaccctcttgttatgtttaaggaatagtgaaatatattgtcttcaaacacatggacttttttttattgcttggttggtttttaatccagaaagtgctatagtcagtagaccttcttctaggaaaggaccttccatttcccagccactggagattagaaaataagctaaatattttctggaaatttctgttcattcattaaggcccatcctttcccccactctatagaagtgttgtccacttgcacaattttttccaggaaagaatctctctaactccttcagctcacatgctttggaccacacagggaagactttgattgtgtaatgccctcagaagctctccttcttgccactaccacactgatttgaggaagaaaatccctttagcacctaacccttcaggtgctatgagtggctaatggaactgtacctccttcaagttttgtgcaataattaagggtcactcactgtcagatactttctgtgatctatgataatgtgtgtgcaacacataacatttcaataaaagtagaaaatatgaaattagagtcatctacacatctggatttgatcttagaatgaaacaagcaaaaaagcatccaagtgagtgcaattattagttttcagagatgcttcaaaggcttctaggcccatcccgggaagtgttaatgagctgtggactggttcacatatctattgcctcttgccagatttgcaaaaaacttcactcaatgagcaaatttcagccttaagaaacaaagtcaaaaattccaaggaagcatcctacgaaagagggaacttctgagatccctgaggagggtcagcatgtgatggttgtatttccttcttctcagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtatgttttcctttcttagattccaagttaatgtatagtgtatactattttcataaaaaataataaatagatatgaagaaatgaagaataatttataaagatagtagggattttatcatgttctttatttcaactaagttctttgaaactggaagtggataataccaagttcatgcctaaaattagcccttctaaagaaatccacctgctgcaaaatatccagtagtttggcattatatgtgaaactatcaccatcatagctggcactgtgggttgtgggatctcctttagacatacaacataaatgatctggatggattaacattactacatggatgcttgttgacacattaacctggcttcccatgagctttgtgtcagatacacgcagtgaacaggtgtttggaggaacagaataaaaagaaggcaagcactggtaagggcaggggtttgtgaaagcttgagagaagagaccagtctgaggacagtagacacttattttaggatgggggttggatgaggaggctatagtttgctataagcttggaatggtttggaacactggtttcactcacctacccagcagttatgtgtggggaagccttaccgatgctaaaggatccatgttacaataatggcattatttggaaatcccagtggtattccatgaataaaaccactatgaagataatcccactcaacagactctccgttggagaaggacagcaacaccaccctgggaaagccaaacagtcagaccagacctgtttagcatcagtaggacttccctaccatatctgctgggtagatgagtgaaaccagtgttccaaaccactccgggcttgtagcaaaccatagtctcctcatctaccaagatgagcaaccttacctcctgatgtcctagccaatcaccaactaggaaactttgcacagtttatttaaagtaacagtttgattttcacaatatttttaaattggagaaacataacttatctttgcactcacaaaccacataatgagaagaaactctaagggaaaatgcttgatctgtgtgacccggggcgccatgccagagctgtagttcatgccagtgttgtgctctgacaagccttttacagaattacatgagatctgcttccctaggacaaggagaaggcaaatcaacagaggctgcactttaaaatggagacataaaataacatgccagaaccatttcctaaagctcctcaatcaaccaacaaaattgtgctttcaaataacctgagttgacctcatcaggaattttgtggctccttctcttctaacctgcctgaagaaagatggtccacagcagctgagtccgggatggataagcttagggacagaggccaattagggaactttgggtttctagccctactagtagtgaataaatttaaagtgtggatgtgactatgagtcacagcacagatgttgtttaataatatgtttattttataaattgatattttaggaatctttggagatattttcagttagcagataatactataaattttatgtaactggcaatgcacttcgtaatagacagctcttcatagacttgcagaggtaaaaagattccagaataatgatatgtacatctacgacttgttttaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggtcagaccagagcaccctgcggaaacagaatatgactcactttaccctgaggatgatttgtagaaaattaactgctaacttctattgacccacaaagtttcagaaattctctgaaagtttcttccttttttctcttactatatttattgatttcaagtcttctattaaggacatttagccttcaatggaaattaaaactcatttaggactgtatttccaaattactgatatcagagttatttaaaaattgtttatttgaggagataacatttcaactttgttcctaaatatataataataaaatgattgactttatttgcatttttatgaccacttgtcatttattttgtcttcgtaaattattttcattatatcaaatattttagtatgtacttaataaaataggagaacattttagagtttcaaattcccaggtattttccttgtttattacccctaaatcattcctatttaattcttctttttaaatggagaaaattatgtctttttaatatggtttttgttttgttatatattcacaggctggagacgtttaaaagaccgtttcaaaagagatttacttttttaaaggactttatctgaacagagagatataatatttttcctattggacaatggacttgcaaagcttcacttcattttaagagcaaaagaccccatgttgaaaactccataacagttttatgctgatgataatttatctacatgcatttcaataaaccttttgtttcctaagactagatacatggtacctttattgaccattaaaaaccaccactttttgccaatttaccaattacaattgggcaaccatcagtagtaattgagtcctcattttatgctaaatgttatgcctaactctttgggagttacaaaggaaatagcaattatggcttttgccctctaggagatacaggacaaatacaggaaaatacagcaacccaaactgacaatactctatacaagaacataatcactaagcaggagtcacagccacacaaccaagatgcatagtatccaaagtgcagctggagacaggaaagctgcttggggagtctcccagcagaaccttttagctccaaacacctgtggtgggacctggtcactctgaaaggactgcaactcagagcagagagctttagggagctatttgccctatctctcactagtcatgaggtgagctgaatggaaccatctcttccttctgattcagggatattgactttttagcagcctgagttcaggttcattcgccaactttctaaggaatagctaaatctacataacttagcaaaaggctgactgtgggaagtaattggctaattttatgaggtgggtctggttgttccgaagtcctgagctttggctttgcactctctttcttttcacacttctttctttcttcttgcctttcctttttttttttggatatagggtctcactctgtcacccagtctgtaatgcagtggcacaacagtagctcactgcagccagccttgaactcctgggctcaagtgatcctccttcctcagcctcccgagtagctgtgactacaggagtgcaccatcacacctgcctaatttttctttaatttttatttttgtagagaaagagtctcactgtgttgcccaggctggtctcaaatgcctggcctcaagggatcctcctgcctcggcctccaaaagtgctgggattacaggcatgagctaccatgccaggcccacaatttccttcttaatcttttcactttcttgttatcaggagtgctgaatttaagatatcctattgaagagataaaaacagtaagtcagcttctagatatacaaccgaagacgtgggaggctttggaaaatagaaacattgattcattgtttgcagccttcatatatacatgtatgcatgaagcacttattcaattaacatttattgaatgccttccttgtggtagccattgtgttggatttggggatatagtacatggtatgcttagtgttctccactctcccaaacctgttctactccatccagtcctcaaatgcaaaaaaaacagtgactcatcctccaatcttcctccccatatccaatttctacctccctatatccaattactcatcaagcctgctgaattcacctcctatatatttatcatattcacttttttcctgtataccgattgtcacctttgtagttgagatacatctcttgccaggataagggcaatcacccacttcctgttccctttcttacatccagcctctcctgctaccatctcatcctcctccaaaccacttctaaagccagaatgcatacagtttaccctttgtgaacctataaaatcctttgtgtgagcaatctggtcatagctacaaagagatatacaatattcatgagttttcatgcaatatcactctagtgatttatcccaagaaaatcatttttaaaaaagaaaatagttatatacagaaataaaaatatagatgtaaatttcatattagtaggaaattaagaaaatatttaacagtggaagaatggacaagcaagatagcttattagtaaataaaatagaatataaggattatataagcacaatagctttttatgaatatggaaatatttacaaaataagtgaaattttaagatgtaagaataattctaaaataaaaattatgtaaagttgtatatacatatacttcatgaacaaaatataatcttgacatatatccttatttgtacatactc

SEQ ID NO: 15486 - DNA, 12515 bp, Human; identical to SEQ ID NO: 15485

SEQ ID NO: 15487 - DNA, 18016 bp, Human
  misc_feature (1)...(18016): n = A,T,C or G
taatactaataatttatattaataagttacttgccgtgtctgctttaaggacagccctgagggcccgtacaaagagcagtggtgacacctgctgttcaaataaggcagcttcgggtgtcagccaggccatgtgtgtatgacggagcctttcaggaatccaattaaacttgtggatcctttctccagaaaataaaacatattcccatataaatacaaaattttcctacaatatacataattcatgaatccctgaactaaataatagggtcacttgagttctatatttatctaaaatattgtaaactttcaaggggatgacatcattctataaattcacgacagtgttttaaaaggagcaaattcgaggcaatttacctcaatcattaccatgttgttattgagaaattaaattaatgtctccaggatgattaaatatgtaaaaagttaatagatccaactagacaattaatatattgccatatatattagtcttgcttaggtttctatggttttattgtcatttcaaatcatgttattttctatagttattattaataggtgagtatattatttagttcatcaagtatatattttacaattatggtattttcttgcaaggaaataccatcacctgccacctttacagaaaagcaattcttaggccaaactcacagttaaattcagagatgctgtatcttcaagtaaaaacatgaccttaaggcagggctcagtggctcatgcctgtaatcctagcactttgggaggccgaggcgggcggatcacctgaggtcaggagttcaagaccagcctggccaacatggtgaaacgctgtctctactaaaaatacaaaaattagccgggcatggtggcgggcgcctgtaatcccagctactccagaggctgaggcaggagaatagcttgaacctgggatgctgaggttgcagtgagccaagatcgcgccatggcactccagcctgggcgacaagagcgaaactctgtctcaaacaaaaacccatgaccttaatgtttttaatgaatttccaagtaaggttgatttatattgctattcttttgctagattttttccccctctcaaagtgtaagcagtatgctctcaggacaggattagtgaaactgaaacagggccagtaaaatgtttgtctatttaagtttgtaaatgcctaagtccatccatttttttttttacatagaaaaataattgggtagggttgatcacaaaccacagattttaccagggtagaaagcaaaaataccaatacttggcacaaggatatgtataaataaaaatggctaaagtctccaattgtgtcttctaccagctttgaaaagctgtaccctggcattgttgaagccacaataatcagcaggcaactaggaaatggacaagagctatgcagttttgagaaattaaaaaaaaaaatctattagcagaaaataaatatggggttttgttataactacatgtcaaaattttccaaattaaaacagctattcctcaacgttcacttaacaagtgtttactggactgtttaagcgaaattgttttcaggtgttaagcctacaagtgtccaagtgcttctcgccaggattagaaccaggagacacaaagcacgcaggcgacctccaaagagatcaaggtagtggaaatgccttagatagagcccacgggagtttgctctccagacgcttaggttctctgaataaaaagcgttaagcttccggggaatacagcacgaacaaccaggaccccaactaaggcagaaaacataattctaagatttcttcagagggacgagtgaaaccctccacccaggcccttccaggagtctccggctttcagcctcgagactccgccctagaggcggtcccgaggagggagacccgcctcctgatcctagatggccgagggagactagcgcgcgtgcgcagagcttgcatcacatccgccgcctgggcgcccaattccggaaggtgctgcacagctgtggcggcgggtactgcgttagtgattagagtttcttccctgccggaggtgggatacacggtagcatcatggtcgaggtaaagtgacactggggctctcaagagtcgtttgtctctggactgttttttttggcagtgcgcgtgggggattgagagtacttggagtccagagagaaaagaggctacgaggggagctatttggccaaggccgagtggtctcttcttcgggttttcggggaaggggtagaagccggatgagaacccgagtcggaggttcagcctgggcgcgaagcctgagataattcgtccagtcctcgtttgactcttgggagctggaaagtgtcctcggaggcggggcctctgttggtgatcgaccactggtacttgccgccctcggggcagtgtcagtgagtctgtgccctaaaagattggtagtcttctctatcttgcgttcaggtcgtctcttatttcacctctacccccagaaaaacttgccgttctttacatctttccctggcatgaacagccaacgctgttagctggtcttgtccatcttaccccacatgtttattgattccattcactcttctccatatccgctgcagtccaccttaattgagaccaacatcatctttcacctggactggtgcattagctccccgttggttggtttccttgcttccattttgttctataagttgttctgtttaaaacgtaagttgttcatacctttcttgtttaaaaccctttactgaccctatgttgctagaacaaaatataggctgttgtaatagtctaaaagaccttacctaatctggaccttgtctacccttgcagctacaaagcaccatctcatcctccatacacagctgtactgcgctccttgtattatttcagttaactgaacttttttttacatgacatttccatcagcctggttcgttcttacctctgttttgtgcaaggctaactccctttctgcttaaatatcaccttagtgaaatctttcacaattatacttagtccttcattccctgactcagcgccttgcttgttgccttcatagcacttatcaaaatgtggaattattttactttttatttgtctgtttcctcttgagcacagggaccatgaccacctttttatcattctattgtgagattctagcacaatacctgccagacacacagtaggagctcagtaaatatttattgagtaagttaaactccggcatcactcagttgctaaacctgaggttctagccaaagaggagcttcctcctcttctctgaacttgactcctgtagcttgcaacaagtagctatggtgagtggtataaagctttttacatatttaaacacgtgaagtgtataatcaatctgactttaggttatgatttgtgtaatttgtagataggtgtgtaattacattctttttttttaggaggtacagaaacattctgtacacacccttgtgttcaggtcgttgaagaggacccatgacatgtttgtagctgataatggaaaacctgtgcctttagatgaagagaggttggtgtagtttttttttttcaattgctaaaatacttaacattctaatactaggggaagagagcagggagagggagtcctttaaagataagctagtcatgggctaattattcaataatgagtggtgttttggcataatttaagctgatttaacttttttttttggccttttacagtaaaagttccattaattaattgcattttacaaatacccagtaattaagagagtcccttttaggtattttattttataatcaatcactttgtatgtgctttcagcttcccgctgctctcagagccttgctgagctgaaattgtacctggctagtacctctactcccatcttttctcgttagtatgatgaagatttttgagtggtggcatatttttggttctacatatccagctccagtctgggaatgcattatgtgcagtgttccttctttgtcctttacctttttaaaatctacttaactcctcaaacaagcatttatatttaatttataaagtagactatttttaaaagtaatataaatgcatttctttttaagatattgaaccaattaagtactttgattagttctaactaacctgtttggatacatctagtaaaggttgctatagagtttttactatatttatattttgaaggaaagtatattgactttgaggtttcttaaagggtatgttagtttctgtatatctttcagtcagacccttgacaatttatcataaaaggttttctatttattaggtaacaaactaaaatattacgtaggtttaatgaatgctgtgtggtcgaatgtaagcaaaagaacagatatggtggggaaatgcccttggaaatttttgattcttttaaatactacttaaaatcatactagaaactttttctacgtgaatgggcaaacttaagctaagtgtttgttttaaagtatttatggatacgttcttatgtttataatttctaaatagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggtgagtatggtattatcagaaatgtcagacttatatgtgaattttaaaaacagaaaaataaaatatgttatttttgcccctcctggcaggacttattgtggtcgtacagtatttaatggccgtacctgtattataatggaagttttgatcctcatgggaatactgttgatgacttttttcttataggaaataaaaatggtagtataatgatggcagagattcttagagtgtggagaaggtcacagtagagattaaaggaaaaaattggagaatattcttaacctgtgaggacaccatctatcttgtctgtaattcagaaagatgaaattaaatactgaaatcttaataagtaaagagaattcaagattccacaggaaaccatttgcttggaagaaataccagagtggattgtcacttgataggagggcttctttgtataccattgctatatagcaaatggtcaaggacatggtttacagagatcaaagcaaaagtgatcaacttcccttatttctgaggcttgactttagttgagaaaatttgatagatccagttgaaaacttaatattacttgatacatttaaagagatgataacttttgtataaggtaaattcactactgttgattttttttgtgtttttttaggacaagaagttgaatactttgtggcaggtacacatccatacccaccaggacctggttagtgagctgttatatattgaaaatgtcttaaaaatgtcacatatattttcactaacgagccaataatgagattcttgttgcctataaaatgcaagataagctcagtagccaagcatccatgcatagctttgtaggtaataatgaatactcatatgccttcattcagcaaacattcttaagtacgtataatttttcaggcaatgtgctaggaattcaaagacagtaaaactgttgcaggcctagttatttattatctggtggtttaggcagacatgtaaatatcactaagcttgtaaaaatgatggaaatgttagaagcagtatctgagaaacatgtcctctgtctgtattaaggcattggtccacagatggagtggccagtgtaacagggtagaggacaaaaggcttagtatgtaaagaaagtacagggaaattgggtgtttctagttttagtaagttacatccactcttggaaacattctgttagtatttgaggaactgcttaatactgacttgaaactaatacccaaatataatggaaattaactttactattctgggctgctttaataccatgtgggctgtgatcaaatcaaatttgagttacgtgttattaagcagtatttattgtagaaattaaaaacaaagatgagcaaaacttaatcaaatttgtataatatcactgcctggagataataaacatttggtgtatgttttccttcatcattttattttaagtgcatgtaaatgaataatacacagctactaaaagaagttgatttttcattttaataggggttgctttgacagcagatactaagatccagagaatgccaagtgaatcagctgcacagtccttagcggtggcattacctttgcagaccaagtatgaaatattataattacaaagatcttaaaagcatatttcactgttcacattttttctttttaaaatttctttataactattatatgacattttcctttatcaggactttataacaatttaaaataaagggttagttttgcagaatacatgactggaggcattaattactttgaaaatattatttcttttgccccagggctgatgcaaatcgtactgcccctagtggaagtgaataccgacatcctggggcttctgaccgtccacagcctacagcgatgaattcagtaagtttttctgcatcaaatagcaggtttctaacttttggaacatgttgccatatttccctcttctttggaattattaagataaatagcagcctgagctagtcattcatatttcatagccctaaaactcaagttggtagtaaattaacgtattttttggaatttaattctgttatttgtctacttgtacattgtgtgtaatatatattttgataaagataatgtgatgttggtatttattgcccactattaaaaatgcaaggagagtttttctgaaacttgtgttagtatgtattgaatatgaaagtctttttttttttattaaattttaagttggtgtgtacagttatcttgagtgctgttagtgttgtactattcatgggctatacaactagtcttataaatgagcatttagaaataagtttatctgtttgtaagtaaatggcaactggtattagtatggtagaaatagttgttgaattttctatagttattttattgatttatctgcagcataataaaatatgctgccacttgaaataagtgctggttttgcttctcagctcattatgcaattgatttgactttatgaagtgaatgaatgtgtaactgccacatctcctttcctcctttattccattcagagcacgtcttctgtccaggctctctaccctccttatgagggtataatttaagcttcttgagggcaggaactttatgggcttatttatgttttggatgactagatgactgctaacaacagatggtatatcaggcagtatacctgttaaaatagtatttaaatattgtattagaagataaatagaaggaactgtcagtctttgctatattaaaccaataatgttaaaatatgacaatgaaagacagtggcactaatacacttaaaatgactttaatattgggagcttacatggagcatttactacttattaaatctttgtagtaaccctatgaaataggcactattcttcccattttacaggtgagccacatagaggttacatgattgttacctaatgtcaaacagctagtaattggccaagctgggttttgaacccgtacacagtgatgtgtgctcttaagtctaatgctctgcctgtctgtgattttataattgcttttttaagttaacatacagaaaattgtatttcttcatttatggaaaaattcttttgtaagttccctctttccatttccatttctgaattgatatcatgaagccttaggtatgatgtctttaataataataatgtctcttctatgtctagattgtcatggagactggcaataccaagaactctgcactgatggctaaaaaagcccctacaatgccaaaaccccagtggcacccaccgtggaaactctacagggtgagtgactctgcatttattttattatgtgaaccatgattgctttgtagttgacaagcactgaagaatagaataaggaggaaaaagagtgaatatgaaaagctggtagagcgatctgaggtggattgagaagagtcgtagggagtatcttaaaagatctcttgggaaggtgacttccttaagcaaaagttatacttttatataaaatagtatgaaatgtcaagataaagctactaaatatggatggcagactaaataaatgtagaaaaagtgttcaaagtatttagtttgaaggtgaaggggaaaaacaccatataaagaaatttatttgggcctaccagttactctttcaactacaataaatgaaaatgattcagagtgtatcatctaaaagaaaatggacatgcatgctaacttcagcagcacatacactaaaattggaatggtacggagaagatgagcatggcccttccacaaggataacacagattcgtgaagtgttccatactgtttattttgcattgcttgcctataccaaaatatctcatgtactccataaatacatttctactgtgtacccacaaaaattaaaaacagaaaattttaaaaaagaaaatgtacatagtaggaaatgtacagctacacataatttaatatgtatcttaaaaatttcatttttcaaatgattgtacagtaagagcctttttgtttgacatacagctctaatgaattgtaatagatgtattgatttgggtaaccactaccacaattaggatatagatgttacaccacctcaaaaaacacccttgtgctattcgtttgtagttacactttccttcacctctgacaatcactgatctgttttctatcactatagttgtcttattttttttcaataatttcagttctaatttatttttaatttttatggctaacataatagatgtgcatatttatgggctacatatcaaatttgatacaagcatacagtgtgtaggccaggcatggtggctcatgcctataatcccagtgctttgggaggcctaggcaagcgcatctcttgagcctaggagttcagtaccagcctgggcaacacaacaaaaccccgcctctacaaaaaaatacaaaaattggctatgtgtagtggagcacacctgtagtcccagctactccagaggctgaagtgggaggatcacttgggctcaggaggcggaggttgcagtgagccaagatcacgccactgcactccagcctgggcgacagagtgacaccctatctcaaaacaaaaaacaaagaaaaacatacagtgtgtaatgatcaaatcacggtaattgggatattatttctttgtattaggaacattccaattttactcttctagttattttgaaatatacaataaattactcttaactgtagtcactctattgtgctaccaagctaactagccaaactagtgctaccaaactagctaaccaaactagtgctaccaaacactaaatcttactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactatgtcatataaatggaatcatacaatatgtactttttgagactggcttccttcacacagcttaatactttgtgagtcattgaagttgttgcaagtattaataatgtattcctttttattactgagtagtttacattatatagatgagccacaatttgtgttaactattaactcactgaagataatttcatattattgtaaaatgtaatagtcattatcttttatgatttgaagatgggagggcaattcaaactcgggctgcagttaaacttaaatacattttaacttctacgttggcctgcccattctactttgttttatacaggttatcagtgggcatcttggctgggttcgatgtattgctgtggaacctggaaatcagtggtttgttactggatctgctgacagaactataaaggtaataatgaaggaagaaaaaataaacatgactttgtgtttgtcatgtaagtttaatcagttattatttcctgtggcaggaattgctattgcagttcctctgttattttagacctgaataaggagtaaaatttatcatttatactaataagtgttctaaataaatatctgtttgaaaagtgctatttaaaccactttttctttacctactgaatacctaccactaattcctttatacttacattgttctctccaactggttacaaaattaagagcatgctcattcatagaaaatgtggaaaatatagagaattaggaaagtacatagacctgtatataatcctaccattgttagatatttggataagtttcgttttagtatttatttctgtaagtatcaataccttcacttctaagctcttttcctgtgtgtgtatcttttaaaaaatcattcttagtatgtaattttgtatcttgcttttttcacttaacgttgtatcaaaggcatattcctgtgaaaaatttaccatcttttaaagtggttgcataatattatatcatttagatagtctgtaatctgttttcctattactggacagtagagtttttagtctgattttcaccattacaagtaatgctgttaagttttgtatataagactttttctgtattttaaattattttgttatggtagagttccataaatggaataaatgggtcaaatatttttgaagctgatacccaaagtacaaattactttccaaatgggtgaatcgatacttgcagtgtatgagaggatccttttcagcacattggttgtacattcctttacaaatatctaatatggtaagcaaaaatggatacttaatctttttaaaaaactttgtatgaaatttctaatgagtgtgaactttttcatatctgtatttgctgcttttaggatttctttaagttgttgccagcctcagttaatttaataccatacttttcttactgttattatcaaagatatcatttatataacaagaaggttaaccttttgtcatctaattgcaaatatttttccagtttgagcatgccagtttttttcttgcttttatttggaggggagtcattttgcaaaattttttatttttacgtatttgttatctttttccttttgtctttgaaagctcagttttaataatcaggtttctaaaattttgttttgcagtaaccagtgaaagaaaaaaataaatattctttgattgcagatctgggacttggctagtggcaaattaaaactgtcattgactgggcatattagtactgtgcggggcgtgatagtaagcacaaggagcccatatctgttctcttgtggagaagacaaacaagtgaaatgctgggatctcgaatacaataaggtaagtttggagttaaggatttaaaacattgtgaactactatttatctttctaattctagaagttttaactttcctgctttgtctttaggttatacggcattatcatggacatttaagtgcagtgtatggtttggatttgcacccgacaatcgatgtgttggtaacctgtagtcgagattcaactgcacgggtaaatgggatagagttgtgtatttatctgtaaatatattgcatcttgtagggtgcactttcggtttcagtgtcttcaattgattgatagagaattaaagatagctgtcttgagtcatcaatatcctagtccctaagtttcttaacttgcatttttttccaccttagtcttcagttgtatggcctcaccatgttagtgttattagtgccctgcccctgaaatgtgatattctcacgttccattctgtaacaactattgtccattagttctttcattcaatagtcttaaaaagtagtcccatcatactcattcttagattttcagtaccctgatcttttagctttttagaattcttgcaagttgtctcctatttatattcgtcctccagtttgtaaatcattatctttcacttaagcattttctttattatattcaggcactagttatgtagtaaattttcagccttgaattgatccagttatcttcttgagataatgaatacctattctctttcctaatatgtctattgtgtttttatagatttgggatgtgagaactaaagccagtgtacacacattatctggacatacaaatgcagttgctacagtgagatgtcaggctgcagaaccacaaattattacaggtatgatcgatacttttcaagtttacagaatattcatgtcagaatccatgttattatacatatacttttaatattcatgatgactcttgctctgtattgtgtttacagtgtttctgtgtcatattttaatcatggacaattgaaatgtattcaaatgaaatttcattccactgtttttacctcatgctttttacatatcatagagtatgccatacatagtatcctgtaatgtctgactagaatactgtgttatgaacaattattattttatagtgtcaaaattatttttctaagaaattgaagttagaagacaaaacatcttgagactagtaacctttagaactgatttgaatcttactttgctctaaataaagttagtaacaatggatctttaatactagcaaaataattcctttgcctgatgtattttattaacttaaaaaaatcattgaagttttttccttttcactagggtatacaattatatatttatttgttatttgcatttgttttagctgttcaattgacagtgaatcaattgttgtattgcatttttttaaagaattaaaatcaacctaaaaatttggaactatgaagaaattagccaagactaatttgcgtgtgatatgactttcatttagaacatatgtgttttggaagaatgctttgtattttatttaacttttgcattatttttcctggtctatgttttgagggatatatgtgtttccattacaggaagccatgatactacaattcgattatgggatctggtggctggaaaaacaagagtgacattaacaaatcacaaaaaatcagttagggctgtggttttacatccaagacagtaagtgtattttcctaattagcttcttgtttttcttcagttcttaagataatgctgaaatgctagtggtgttagcactgcttttggcagtcatttagctgctgtcatttctaggcctgtgccgcataggaacgtgtgtttcttttattttcctcatgcactattttgcttcatgccctataaaacatgaggaaagccttctacttgataacaaataaataatgtcaaatgagacagtgtaaatcatgattaaatgctgcatgtcaaaataaaagatattagtggctaggcttaatgttttggacataaatgattttggacactgagacattcattgaatagtttaattcttaaggaggaagttaatatatgtagaaacagaaataataagaaccgtgaacattacagtcagagtatccaaaaaggtggagcataatatcacaactattgtttggtgtatcagatcactctgacacttttctggattcttcctctccttcctttcctcttctctgtcttctactctccatacccttttccccctctcttcttccttcctttgcttatctttctcactcccatttcgcctctcctccctcctgttctctctcttcctcttgccctctattccttttctctctttcttcctgtcctgtcttgctctccctccctccaaaagagttgcataacacattgcccttcatgtgaaatagggcttctgcacatttattgctctggcttagtgcagagcattaaggaaatgaaaggagaacaaaacattaatctaggacttaaaatatactgttaaaaatgtgaaggtctgatttaaccttgaacaaatgtcttaatatttttacattttgatacgactattttgctgaatatataaatcattgagtacacactgcaaaatataactgaaataaactttttaaaacccaccactttatttaacttggtttactttgtcgttaattctttttaatattatttcagttacacatttgcatctggttctccagataacataaagcagtggaaattccctgatggaagtttcattcaaaatctttccggtcataatgctattattaacacattgacggtaaattctgatggagtgcttgtatctggaggtaaaataagatttttataataaatatgtttagtctgttattttttcttttaatgatgaataaacatttgtaatgcttctaagctgtcacacttaagtattatagcagcacttgcctggttagggcatatttgcatgttattatgtgtgttcatgcatattcatattacatgtagtatatttcatagcttagtcctctttgagttcccatctaatgaatctcagggatttatgctgggaattgcttaaaattttgtttattattctggaattggatgtcagattttcaggtgctttttaagatctataagttctgaacccagcccaaatgaaagtagacaaaccaatattaagagaaggtggagtgcctgtgtcttatgtatttttataaccgtagtattcccatgcttgggctaatgatgcttcataaatgtttgtcaagctgtactgctgaggggataccaggtgtaactagatttttccctttaagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccgtaagttctgtgtttcacattcgttaagtaaaacagctataccaatttggcagcatattctcatttaattatcagaaggaaaaataatctttatagtatttaagatatctgtcttcttgaatagtgtccatttatatatttctatattgtttcactgatgccagtgaatccatggatggctttaattttatcccaacttcctttgttatagttgctgggaaatgttgcaccaagaataacagcaaataaatagattgctatgtaaattaattcgagaatcataagctttggtgttagtagaatatccaagtagaaatgttattttagatggaaaactacaaactaaacataatgaatccatccatctgttattagacttggataatgccagaagtttatcaactcttcctaaaactgtcaaagaactaagtgtataaagccaatgaataatgttagataccttatttttgttagaaaggaagcctattagacatgaagcaaactaataatactttattttaactcacttttctatttttagacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtcccctacccctgtgtttttatttctaaaacaatttgtgatactaggaagatgcagatatcaagtaaatgcaggtttattgaacataactattctagatgtaatattttgacagtcttattagaaaacccccttttttaaaaaaaatgtatgaaaccgataattaggacatttgaaggagcagtagtttttttttagtcctttaaaaaataacatctgtgactaataatttgagattaaaagatttgaagtcttaatttatgtatgtttattccaaaaacagtttttgagtgtatgttctacaaagttctgcactagatactgttcaggaaatagcacaagtaagatgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15488 - DNA, 12075 bp, Human
tttggcatctgaggcatgtaccaatgacagccagttcactcattcatcccgtaattatgtattgaacgcctactatgtctgtcttgctcaccaatgcattcccagcccctatcacactacccgtcactgaggagactctcaagaactatttgtaagatgaatgttaagtctgtgctgttatggtgcatgcatgctggattgaatccatcctccttctgaccatgggaagaatgccaatcagagtagaacaaagtaggaaagtaaaggaaccttcactttagtgttgaacaagagtctattatatactagaaaaaactttacaaatttacagacttctgaaagttaaatgatgattctattgttagttgatcaaacatcagtcattgaaaatgtagtaatacgttacctcaaaagaaaaaaaaaaggttagagttttcttaacagataattctttttaaatctgtaagaatctgtacgtcactaaaataaaatcctgtctagattattaaaataaactttgttatcagttatattttcatggaaaatattcctgtatatattttaattaatagccacatagatatttgctttttctgtcagatcatgtatccctttaaaaaccattaaagctaaagaaaaaaatcttaaaatataatatttactcattgctaataaagggaacacaaatttggaaagactcaagtgaatattttttcttaatttaaactgagtactttgtctctattaagctaagttaaaagaatttgggaggacaacctatgctaccaagagaataatttgtttctaggaatctgagttaaaagaatttgggaatgcaatctctgctacctggagaagaaagaaatgtcgtgggtcccacaccattctcaagactctgtttcaaagcattgtttcaatacgctgatccaaaccctgataacctgccatctttttaataaaataatttataaatttaatgagaatgtttcactttccatacaaaaaacagaaaaatgctttgaatcaatgcacttactgggatttggattactgactggtgttcctattgattcttgtaggagttattaatcctgattgcaacacacaagtgaacagacaagagagataaattttgtggcttgtgggaaatgaaggaaaatgggcctcatttagtctgtgagcatactaattgaaatagatgtatgaagacttcaccagtgttaaaataacattgtttttataaatcatatgatataaactatataacaataaaatagaatgttaaacatgtatttaatcatcatcataattttgattcagaaatctataatttattagttatcttaataatgtttagaatttgttgaacattttaccttatgtgaattaaggacaaaatattaaagctattcagcacaaaaaaagggtctttctgatgtgtatttttcatagaatagggtatgaatttgttattttgttattttgattaatgtctaaaacaaaagataaacacattatgatataacattactattgattttaatggccccttttgaaatagaattatgtcattgtcagaaaacataagcatttatggtatatcattaatgagtcacgattttagtggttgccttgtgagtaggtcaaatttactaagcttagatttgttttctcacatattctttcggagcttgtgtagtttccacattaatttaccagaaacaagatacacatctctctttgaggagtgccctaacttcccatcattttgtccaattaaatgaattgaagaaatttaatgtttctaaactagaccaacaaagaataatagttgtatgacaagtaaataagctttgctgggaagatgttgcttaaatgataaaatggttcagccaacaagtgaaccaaaaattaaatattaactaaggaaaggtaaccatttctgaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggaggtgaattttttaaagcattattatattattagtagtattattaatataagatgtaacataatcatattatgtgcttattttaatgaaattagcattgcttatagttatgaaatggaattgttaacctctgacttattgtatttaaagaatgtttcatagtatttcttatataaaaacaaagtaatttcttgttttctagtttatcacctttgttttcttaagatgaggatggcttagctaatgtaagatgtgtttttctcacttgctattctgagtactgtgattttcatttacttctagcaatacaggattacaattaagaggacaagatctgaaaatctcacaaactataaaataataaaagagcagaattttaagataaaagaaactggtggtaggtagattgttctttggtgaaggaaggtaatatatattgttactgagattactatttataaaaattataactaagcctaaaagcaaaatacatcaagtgtaatgatagaaaatgaaatattgcttttttcagatgaaaagttcaaattagagttagtgtgtattgttattattaatagttatgaaacacggttcagtctaatttatttatttgtagaacagtttgtcctcaactattatttttgctgacttattgctgttaatttgcagttactaaaaatacagaaatgcatttaggacaatggatatttaagaaatttaaattttatcatcaaacgtatcatggccaaatttcttacatatagcatagtatcattaaactagaaataagaatacacaataatatttaaatgaagtgattcatttcggatcattattgagtttcaagggaacttgagtgttgtacttatcagactctacatgtaagaacatatagttaatctggttgtgtgtgtaaaaacatatggttaatctggttaagtctggttaatcatattaggtaagaaaaatgtaaagaatgtgtaagacgaaatttttgtaaagtactctgcaaagcactttcacatttctgcttatcaactaaacctcacagagatagtttaatagtttaggctttaaaatggattttgattattcaacaagtggccttcataatttctttaagtgtttttctttaagtatatactttctttaaatattttttaaaatttccttttctctagtaaagccagaccatccatgctacctctctagtggcactctgaaataaaaagaaaatagttttctctgttataattgtatttgtaataagcagatgaatcacatttcttaaaatttgttttagagagggtaagctctgactaggaccatgacttcaatgtgaaatatgtatatatcctccgaatctttacatattaagaatgtatatagtcaactggttaaacaggaaaatctggaaccagcctggctgggttttaatcttagcaccatcctactaaatgttaaataatattataatctaatgaataaatgacaatgcaattccaaatagagttcatctgatgacttctagactcacaaaattgcaagagagctcagttgttgctcagttgttccaaatcatgtcgtttgttaatttgtaattaagctccaaaggatgtatagctactgacaaaaaaaaaaatgagaatgtagttaatccaaatcaaaactttcctattgcaatgcgtattttctgcttcattatcctttaatataatattttaagttagcaagtaattttaattacaatgcacaagccttgagaattattttaaatataagaaaatcataatgtttgataaagaaatcatgtaagaaatttcaagataatggtttaacaaataattttgttgatagaagataagactaaaagtgaaattcgaagtggagaggacacttaaactgtagtacttgttatgtgtgattccagtaaaaatagtaatgagcacttattattgccaagtactgttctgagggtaccatatgcaataagttatttaatccttacaataatcttgtaaggcagattcaaactatcattacacttattttacagatgagaaaactggggcacagataaagcaacttgcccaaggtctcatagctgtaagtcaaccctacggtcaagacctacaagtagccgagctccagagtacattatgagggtcaaagattgtcttattacaaataaattccaagtagaatcaacctttaataagtctttaatgtctcttaaatatgtttatataggagtctaatcaccaattcacaaaaatgaaagtagggaaatgattaacaataatcataggaatctaacaatccaagtggcttgagaatattcattcttcttgacagtatagattctttacaatttcgtaagttccaatgtatgttttaggaatatgaggtcattactattcataatctgatacagctttatcctaaggcctctctttaaaaactacactgcatcatagcttttttgtgcagttggtctttctactgttactgaacagtaagcaacctacagattcactatcaccaaccagccagttgatggatcttaagcaaattatcaagcttgtgataacctaaattataaaatgagggtgttggaatagttacattccaaatcttctataacactctgtattatatttctgcctcattccttgtagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctggtgggtgcactgatgtttcttgcagtggtggctctctcatgcagagaaagcctgtagtcatggcagtctgctaatgtttcactgacccacattaccatcactgttattttgtttgtttattttggaaataaaattcaaaacataaacatattgggcctttggtttaggctttctttcttgttttctttggtctgggcccaaaatttcaaattaggatatgtgggtgccacctttccatttgtattttgccactgcctttgtttagttggtaaaattttcatagcccaattatattttttctggggtaagtaatattttaaatctctatgagagtatgatgatgactttcgaatttctggtcttacagaaaaccaaataataaatttttatgttggctaatcgtatcgctgaattttcctatgtgctattttaacaaatgtccatgacccaaatccttcatctaatgcctgctattttctttgtttttagggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaaggtagatatccttgtgctttccattcgattttcagctataaaattggaaccgttagactgccacgagaatgcatggttgtgagaagattaacatttctgggttagtgaatagcattcatacgcttttgggcaccttcccctgcaacttgccagataagcactattcagctcttattcccagtctgacatcagcaagtgtgattttctatgaaaaattctactatgactccttattttaagtatacaagaaacttgtgactcagaagataatatttacagagtggaaaaaaacccctagcatttatagttttaacatttgaggttttgaatgagagagttatccataatatattcaattgtgttgtggataatgacacctaacctgtgaatcttgaggtcagaatgttgagtgctgttgacttggtggtcaggaaacagctagtgcgtgagcctggcacaggcatctcagtgagtagcatacccacagttggaaatttttcaaagaaatcaaaggaatcatgacatcttataaatttcaaggttctgctatacttatgtgaaatggataaataaatcaagcatatccactctgtaagattgaacttctcagatggaagaccccaatactgctttctcctcttttccctcaccaaagaaataaacaacctatttcatttattactggacacaatctttagcgtatacctatggtaaattactagtatggtggttaggatttatgttaatttgtatatgtcatgcgccaaatcatttccactaaatatgactatatatcataactgcttggtgatagctcagtgtttaatagtttattctcagaaaatcaaaattgtatagttaaatacattagttttatgaggcaaaaatgctaactatttctacataatttcatttttccagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaaggtaactgattcataaacatatttttagagagttccagaagaactcacacaccaaaaataagagaacaacaacaacaacaaaaatgctaagtggattttcccaacagatcataatgacattacagtacatcataaaaatatccttagccagttgtgttttggactggcctggtgcatttgctggttttgatgagcaggatggggcacaggtagtcccaggggtggctgatgtgtgcatctgcgtactggcttgaacagatggcagaaccacagatagatgtagaagtttctccattttgtgtgttctgggagctcatggatattccaggacacaaaaggtggagaagagctttgttcatcctcttagcagataaacgtcctcaaaactgggttggacttactaaagtaaaatgaaaatctaatatttgttatattattttcaaaggtctataataacacactccttagtaacttatgtaatgttattttaaagaattggtgactaaatacaaagtaattatgtcataaacccctgaacataatgttgtcttacatttgcagaatgtgaggaaattatcaggaaaggaggtgaaacatctgaaatgtatctcattcaacctgacagttctgtcaaaccgtatagagtatactgtgacatgaatacagaaaatggaggtaagctttcgacagttgttgacctgttgatctgtaattatttggataccgtaaaatgccaggaaacaaggccaggtgtggtggctcatacctgtaattccagcaccttgggaggccaaagtgggctgatagcttgagcctaggagtttgaaactagcctgggcaacataatgagaccctaactctacaaaaaaaaaaaaaataccaaaaaaaaaaaaaatcagctgtgttggtagtatgtgcctgtagtcccagctatccaggaggctgagatgggagatcacctgagcccacaacctggagtcttgatcatgctactgaactgtagcctgggcaacagaggatagtgagatcctgtctcaaaaaaaaaaattaattaaaaagccaggaaacaagacttagctctaacatctaacatagctgacaaaggagtaatttgatgtggaattcaacctgatatttaaaagttataaaatatctataattcacaatttggggtaagataaagcacttgcagtttccaaagattttacaagtttacctctcatatttatttccttattgtgtctattttagagcaccaaatatatactaaatggaatggacaggggattcagatattattttcaaagtgacattatttgctgttggttaatatatgctctttttgtttctgtcaaccaaaggatggacagtgattcagaaccgtcaagacggtagtgttgactttggcaggaaatgggatccatataaacagggatttggaaatgttgcaaccaacacagatgggaagaattactgtggcctaccaggtaacgaacaggcatgcaaaataaaatcattctatttgaaatgggattttttttaattaaaaaacattcattgttggaagcctgttttaggcagttaagaggagtttcctgacaaaaatgtggaagctaaagataagggaagaaaggcagtttttagtttcccaaaattttatttttggtgagattttattttgtttttcttttaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggtatgtgtggcactctttgctcctgctttaaaaatcacactaatatcattactcagaatcattaacaatatttttaatagctaccacttcctgggcacttactgtcagccactgtcctaagctctttatgcatcactcgaaagcatttcaactataaggtagacattcttattctcattttacagatgagatttagagagattacgtgatttgtccaatgtcacacaactacccagagataaaactagaatttgagcacagttactttctgaataatgagcatttagataaatacctatatctctatattctaaagtgtgtgtgaaaactttcattttcatttccagggttctctgatactaagggttgtaaaagctattattccagtataaagtaacaaacacagtccctagatggattggccacaaaggcccagttatctctctttcttgctatagggcacaggaggtctttggtgtattagtgtgactctatgtatagcacccaaaggaaagactactgtgcacacgagtgtagcagtcttttatgggtaatctgcaaaacgtaacttgaccaccgtagttctgtttctaataacgccaaacacattttctttcaggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataagttaatgttttcttgttttgtaatccacacattcaatgagttaggctttgcacttgtaaggaaggagaagcgttcacaacctcaaatagctaataaaccggtcttgaatatttgaagatttaaaatctgactctaggacgggcacggtggctcacgactataatcccaacactttgggaggccgaggcgggcggtcacaaggtcaggagttcaagaccagcctgaccaatatggtgaaaccccatctctactaaaaatacaaaaattagccaggcgtggtggcaggtgcctgtagtcccagctacctgtgaggtggagattgcattgagccaagatctcaacactgcactccagcctgggcaacagcgtgagactccacctcaaaaaaaaaaaaaaaagaatctgactatataccatggaaaagccaccactctgccacttaaataaacatcaggatcagagattccaagaggacaatctgcatcaagtcttcaccaagtgttttttaagcgaaataatgaaatagggagcagaatatgcctgttgcccatagaaacgaggtctattcttgtcctcaattaggcttttttttcttcatagttacaccagaactaaagtaaaagtggtttttctgttctttctacttctccccatgaaatgggcatatcatctcaacacttcactccaagtcgccacgggcaaccttatgaccctaggtcctccacccctaatgtatcatcattgccacccatttttatggtacttattgttcttaagcttatcctcttaatcttttcatgtaagcaaagctcattaatttctgtcttggaaatgctactactctctttaattactcaccaaatccaactttaacttttgacctggtttctctgccacaagttctgtcccactggagcccatactcacctaccgctttgccatcacatttaacagaaaactcttatcaacttacttcctgcttaacattagctccttcctatctatatccaaatttcttaaattcaaattttttagctggagtaaaaatggtcccagtaccatttcctgttcccttcactataacctacatttttgtcacattaagtttttccccattccaggacaggtcaggccctttaaaaatttcaacagctttattgagatataattgatataatttaaaaaatcctgcacatgtgtcatgctggagccctattgattccaacagggatggcgccttgtccaagaagagacccagagccagtgaatgggacatagggtttatttaggacttaaatacagatgtggtccagtggcagtgggctggacaggaccgctactatttgtaaagagtatgtagtttatataacatttctacttagcactctccacttagcaacctccatttaacccaaaataaaaggccttggttccttgcacatcctgagttccaacggacaggcagggagttcaagtgtccttcacagataagaagtgaatctctctgggttggccattcccggattccttagcttagactctgaacacatattcttcttagaccatacagtcattctcagggtatgcttgagttaatgctgtcggatgcatctgtcatacaaagtgtttaacatatacgatttcatgattttggaaatatgcatacacccatgatatcactggcacagtcaagatattaaatatatccatcacctccaaaagtttccttgtgttcatttattttagtttttcatggtaagaacatttaatatgaaatattatcaacaaatttttaagtgcacaatactgtattattaattttaggcattatgttgtacagtagatctctagaacatattcatctactaaaaatgaaattttatctccatttccccctacctcccatcccctggcaactaccattctattttccactttgactgtttcagatacctcatataagtgaaatcacacagtatcctttcgcactgttgtggggat

SEQ ID NO: 15489 - DNA, 34068 bp, Human
aatctattgttcaatgtctaacagtctgttcaatgaaaataacctctaagtagccaaatgaaatgagtttttaaaatatttttaaagacaaacagccttttttctttccatatctatgttttgtgggagggggcaggcacacagatagggcaaaagtaagttcctcttttttttttagcggttacagagtcttactctgttgcccaggctggtgtgtggtagtaccattgaggttaactgcagcctcagccttccaagctgaagcaatcctcccacctcagcctccagagtagctgggactacaggagcacaccaccacacctgactaatttttgtaatttttttctttggtagagacagggtttcgccatgttgcccaggctggtcttcaacttctgggctcaaatgatcctcccacctcagcctttcaaatgcagggattataggcgcaagccaccacacccagtctaatttccttgttttttaaaataaaatattgagcttgtatatgtttttccagcaatatagttttctaggaagtgtctattttataattttatttaaaacatctttatttccttgctgagacaaaatgtggatatacacatacgaaaaaaaagtaagctcaaataattgactttggacaattctacacttttattcagtgtaaacatcgaagttcttccacactgatgtcactatcattcgctcccatttcggtcctaagtcttgggttgaataatgctactttcactgctgcactgaaaagattcatgaagttaactttgccatgctatttatttccaggctactgccataatcgtttttagtttgggtattaagaactcatcaggagatggcaggttattttttttctctttcctgtgttcattgatcaaattcccacttgctttaatgaatttggatttgcttaattacctttcttcaaaggccaaggaactcaggaaataataggtgaaaaagtgctttgaaaacataaagttactagacaaaaataagatgtgttacacttctgatatgaactattagtctcccacttgcttgagagagatgcttaatgaagatttgaatctggcataaattatgcaatgttgagacctttataaatgagtgaacagacttgtgtaactgagtactctcatggcctgaggaaggtgggaggaagagttgaaaggaatattctttgtgcaagcagagacactaactaatgttcccaggacctcctctgtgagtcagttttaacgggattgtaaatatgtgctccagtgagttttaacacagtgtgtcagttgctcttggcctttctgtttatcgattctatctacaagatgtgaaaccacagggaggtagaagctttattagccatttctgcctgccaagattgtgggatttactgacttcgtgccctccatgttccttgacagcctgggcctctcctactggattaatacctgatgagtacctgatcacgcaacagtgaaacaacacaaggtcaggggcttttgaaacacccaacccctgggtgtcagaaagcctgtgactttactcagataaattctattttagcgtgttggtggaggtactttgtggccttttgttgaagtgaaaagtagtacaataggccggccaggcttcaaatgagttattaaatctctcttcaactttctcatgatgccttattttcataaccgtttgtaatcagagcacttcagaagcagcacaaaatgagaaacttactctcaggaccccatttctattttttgtaaagggaaaatacatcctcatgtacacgtgaaaaaactggaaacgatgcatacaaaatgtaaaccattcgaattaagcgtgtatgtctgtttgcttatctgtattttctatggcagtcatgttttgcttgtatcataaaacgaaagcttattcaggaaaaataagcatggcgaggtacacatggctaattttgtctttcttctgttctgttctagaaattgaagccaaggaagcttgtgattggctacgggcaactggtttcccccagtatgcacagctttatgaaggtaagctgggaatgccactttttaaaagttggcataatcataatcccttgttcgcgagtattactgatctatgacttattttcagcagttttatcgtttaaatgttttatttttaaaaaaaatgttgtaagcatgcaagacccccaccgctgaaaacaaaagctagcaccttggtaacacgcccatgccactcccccatctgctgcctgccactccctacccaaagtaatcagcatgctgaagactatcattttcttgctttctttttgtataattctactccatttcctgaaaagtacatttttacaaagtaatttttacctttataaaaagggtagtgtgtcgtatgtaatttcatggggtttttatttttcacttaatattgtattgttaagattcttctatactgtatgggcctgttatgcatttgctttggctgctgtgtaatacaccattgtgtattacacaagaaaccactgtttattcatatccacactctggttggtgggtattttggctttctctgttttgcttttataagctgtgctgttgtgaacattcttgcatctatcttttgtggtacatgcataatgattcatcttgcttctatccctaggaacagaattactgggtaataaagaatatgtatgttcaattttaaaatgcaagcttttcgaaagtgcccgtaccaattttcactcttaccaatctgtgtatccacattccctcaacgcttgatattgtcagactttaatttttgccaaccaaatggatataaaatgatatacagattttgactgccatttccctaatccttcatggtaatgagcatttattcatgtcactcggccacatttgtttgctcacattatgcttctcttaatgatttataagggctctttttattctaaatactaatctttcattggtcacgtgttgcagatatctttcccaccatttgtaattaggcatttcacttttctctaggttgtcttttaatgaatattatgttttctgtggcattcagtttttcaattgagaaaaatggttcaaaaaaaaaaataggatctgtgctgaattcttaacatctcattttcttatcagtgccctggggattgcttggatactgaggtcattctctcagcttctgcgtaccctggggagtgcttgtgctccctgcatgtcaagataaataggctgttcatttatttatttatttgttttgagacggagtctcgctctgtcgccctggctggagttcagtggtgtgattttggctcactgcaacctctgcctcccgggttcaagcgattcacctgcctcagcctcctgagtagctgggattatgggcatgtgccaccatgcccggccaatttttgtgtttttagtagagccggggttttaccatgttggccaagctggtcgtgaactcccgacctcaggtgatccacccaccttggcctcccaaagtgctgggattacagacatgagcaaccacgcctggcctaggcagttcatttaaatgggagtttcattatactctatatgaagtcaatttaaaataattacagctatgaactaatgcattccattttatgggtaactttcaaacagaggttgggtgaatagcaaagtgattcccaagttagaatacccggtcttccttatgtagcctagactgattgtgatattttttccaagaagatggattctgaattgttttattgttagaccgtgtaaaatatcttactgtttcttcattccagagaatatctccaatttcttttgattaacttgcatgcttattttggtggagttacttgtctttcctttagagagaagttttaacctgttaacatttagaagggctttggggaaagggggaccagcattctattggattttcaattcatagctctactggagataaggaaagacaactgcattggcagtaacaccaaagtggctgtccttttgttctcctatttagaaactaagttttcttcaattatgctcgtttttggcattgatttgctgccaggtagcactttcttgtgatatatatgtttgctaagacccaattccattccctgtgtctcctctttcctaatcctaaaatgcagggtgcatttgcacaagttacatttggggtcccttcatgttcccaagtcttttgaagcataagactacttttggggtacactgcgtattgttctgggccattgcctccccccgtttttcctgccactgtgtgctgggtgagtacatacactatacaccccataccaacccacacatgtccccctgttaagcttgatttgcgtacttggcaatttatacttcctgcctttcaacccacagtggaagttgagttcagagaacatcttctatacatcagtaaactatcatcttttaaaagccagtcctttcagaaaggagtccaggcaaataaaagaaaattactgatttaattcttacactcctcacttgcatttaatacctaccagattttttaaaaattgttaatttggattagaaaaggaatctaaaatatggctctgggtatactaacttagaattcctaaaataacatagttactttctcacatataggtaataggcatatgaaaatttcaatttacatttatagatctgatattatactctgtaaatattaaaaaatattccttaatatcagctctgttatttcatcttggtgtgtattcagagtcaaatattggccaggaatggtggctcatgcctgtaatcccaggactttgggaggctgaggtgggaggatgacttgaggccaggagttcaaggccaacctggccaacgtagtgagatcgcatctctatttaaaaaatttgaaaacaaacaaaaaaaagcaaaatacagtgtcacaaccttcaaacaatgttacaacctgtcttccctcatttactagtgctccagtttccattgactataagtctttctatttccattataatggttccatgaatcatttgtctaagagagacttggtctataaattagtgaagaaatgtcattctgtgatactaaattttatgtattcataaatctctggactatagccacttccttggtctgcttatattatcatttagggaacaatgtcagtaatccaactgtagccttcagaaaaaaaaggatagactataactttatactcattctgatatattatctctagaaaatagattactaagaataagaaattccatatcattccataaaaccagtaatcataagaaacaataaaaacataatgaacagttgtgcacccgcaggagctggagcaggactaattacctgcgtctccaaaactgctgacagccatgtctgttccactgtgtggcattagccattttgaaggccaaagggatttttttactttttatttatttttttcagatagggtctcactctgtcatccaggctgaagtgcaatggtataatcagagttcactgcagcctcaaactctggggctcaggtgatcttccacctcagcatcccatgtagctgagaccacagcccgcatgccaccatgcccagtaaaatttttttagattttttttgtagagacaaggtctcgccatgctgctcaggctggtctcaaactcctgagctcaaatgatcttctgtccttggggcctcccaaactgctgggattacagatgtgagccacagtgcccagccaaagagaattttttagcttgtggtgattctagtttcctgctgtgatgactgatttcacccaggtctggtccaaagggttaccctacaccgagacactcctcttcctggtattgtagtagcactctactgaggaggcccatgatttgccctcatagttgggactccaagagggtgataacttgcctttatccagtggcaatttcagagctgttgtaaatttccacagcggctacctccgctctccttttcttgggtatatttacttaccaagggatctttttatgtagtccagagaaaggaattcctccattgagtcgactgttttccccctctctggttttcagttctgatacagcttcttcattgtctcgagagaactgaatgaactcttctacagattaaaggatttgagattctgttgttctatagcaacttcatagctagccctttctttttaggggagttatatcaattcctgcaaggccatattgcagtgctaatatttgtttttaaaaagcatatcttgaattctccttagctcttgatgccatgtgagtggattacattccatttcctaccacttttcattgttctctagatctttctgtggctcagttttctttccgtgacctttccctgatcacacgtgagcaaagacacacacacatacacacagcccagccacattaaaacggagcattcttctgacagtctttgtggcttaaattataatttctactggggactcattgcctgctgatttgtttaaacatataacaatgttctgaaccacttctccttgaccagaagcaatattttgagtttcccccacattaaagccgaagctcctttaggacagtgatgcccgattggcttcaattgccttatagtcccatagaacttgacggggaatgaggtgtcctacagtaggtgcttagtatattgctgaagagttttatccctgctttggtaaactgggctatttggcaaattgggttttaggcgctcaacaaatacatctgtttatttttctcatagatttcctgttccccatcgatatttccttggtcaagagagagcatgattttttggacagagatgccattgaggctctatgcaggtaaatggacacgttttgagtgttttccttttttattttttaagaacacagtacttctcacaaagataggctttgtttgcttttgttcttgctaattgtgttaggtttttattggcaaaccatagagtgatcatagaccttttaattaaaaactaagtaaaatattgttatttagtattgccattaaaatagcatccacgctgtcctaggaagtactcacacaatagcattccatatttgatataattggtgtaacaagtaacaactctcaggtggtttggaaacgtggattaaggtttcctaaaagggtacgatggaaattaagcatgttcagaggaataaatggggggtggcatataaagacaggagcatcatttgaattccaagaacgctcctctcaacctcttcagtttcccctcgtataaaataatgataggacgaaataaggctataaaataactcagcatggtctttaacatataggcaacagacagttaaatgatgagaaattgaataaaaccgtcagaaattcttgatcattgtggttttgggtcttcaagctgagaggcagcttataggttttagtgaggtggaagtaataaaacctgtagcagtcgatgatgggacactgataatcctttcaagctcttcaagacatgtctactcattttaagtttttcatcctttctaatttttctcaaaagctaaaatccctaaaagctgaattctgggggaaaaaaattatacacagacaaaactcacataggttgatttgattatgaaactaagtattattttaatttcagggtttttttgtttttgttttttttgtttctgtttttgtttctgtttttttgagaaggagtttcgctcttgttgcccaggctggagtgcagtggcgtggtctcggctcactgcaacctccgcctcccaggttcaagtaaatctcctacctcagcctcccaagtagctaggattacaggcgcccaccatcacgcccagctaattttgtgtattttcagtagagactgggtttcaccatgttgccaggatggtctcaaattcctaacctcaggtgatccacccacctcggcctcccaaagtccagggattacaggcgtgagccaccgcacccagcctgttttttttttgttctgttttttattttatttttttttatttttaaagacaaggtctcactctgtcgctcaggctggagtgcagtggcacaatcatggttcactgcagccttgacctcccagctacaggtgatcctcccacttcagcctctggagtagctgggactgcaggtgcacaccaccatacccagctaatttttgtattttttgtagagatgcggtcttgctgtgttgctcaggctggtcttgaactcctgggctcaagcagtcatccatctcggcctcccaaagtgctgggattacaggagtgagccaccacaccccatctcagtatttttttcaacttggaaaaacatcatgaaggtagaatgacacccagtatttctttcctctttgtaggcaaggaaagcagtggtagttctgttttctgcctttctcatataatacagtgttatatgaagcagccaaagtaagcagtggtttggggcagatagatgggatatttagcatagtgtatggactagactagttctcatggtttaagagaggaaaaaacaaacagtcctcttaaccacagaaacgctgtcacttttgtagtccaattaaatgactgatagaaacgtacagggtgtgtacccattttctgaaagaaacctaattccaagaacttcactgtggagtgtaatatcattactatatcatcgggaatgaaaccagatgcagtttcgggaggggaaggagtctgcatctggaatatgaactactccagacatttttttaatgttttcatgcttagctgtggagcagaattaatctgttttcaatccatcactgctgatcatgcatatgcatgaggtcacttctgagatgcatcttaggaaatatttaagcattacatcatttcacgcagttagagagtgggcactctggacagcagcaatagcttaggaattcttgggtcataaaaatatcactgcagcatttcaggccaaagggtcatgattaaattcttgaatgctttttcagaatatcagtttgaaatgttgttttccatttctgggaaaaaaagtatcctctgtactttgcaatttacactggctctgagtaccttttgagaagccacctttctctgaagcgaataagtctgtgctgctagatctttggtgaaaagaaaagcctagaagaagcagactctgccacatatgctagttgggcttcagttttctctcctgcatagaataacatcttataggaaatgcagtgatggatgtcagagcgctttaaaaattaaattatcaggccccaatttgagtatgtgcagaaaggcctagggttggattttcttttttaaaaaaggaaattcttcagagttcacagtaatagtcatcaactggtttgtaatggaaaaccccagggctcttgtccacatgtccacataaatggacttttcatgaaaatgatgcccctttcgagaggcctaaacaaatgttcagaagaaaagggacctctatcgggtgtatttcaagcagcttcctttattttatttttttatttttttgagatggagtctcactctgtcgctcaggctggagtacagtggcgtgatctcggctcactgcaacctccgcctcccaggttcaagcaattctctgcctcagccccctgaatagctgggattacaggcacccaccaccacgcccagctaattttttgtatttttttagtagagatggggtttcaccatactggccaggctggtcttgaactcctgatccacctgccttgggctcccaaagggctggggattacaggcgtgagccaccgcgaccagccagcaactttctttaaaacgtagtacaagttctgagctgtcagctgcatagtgtagttgagatagttgttgtactgattatgtgatagtcacttcatttgctagacctgcctcttccaaataccttcttggcctatggaattcaagggccagcaaataacgaagctccagtattatttgaaattttgccctgtgatttagaagttctctctagactgacagactttttatagacttttgtctttgccttgttgatattttctgaacagttgattttaaatacatgtggtaatatggttgcagaaattcagcttaaacattttacaaaatctttcccacctacctcctccccttgtactggaccatattttatgcagggatcttataagtgatctcgtatttactctagcattattcttagtttagagtgttcatgtacctgtgacatttacagatcttacagctcctttggtcaagaagtaagtaggagcttctttttctactcagggcaagaagacttgtagagttagtgggttttatgagaacaatgacatagtcttaaatataaagtttggcaataaccaaaagttacaagtgtgggactatagattttttggatttagattgctaaccagcatttttacattcacactgcaaggggttcatgtgtctgttcccttggagaaacggctttggcctgatcttgctagctttactatataatgcaattccaatgataaggccaatattatgagagctatactcaatggtaatcctggaggagtgattcgctttgtcttgaagcatgtgcacgtagtattgtgaactgtgattcactacgaggatacctcttgtgaaatgttctttctattgcttgccttcctacagcttctgaaaactattccaaattgctattttcctttggaattaaaaatgactccttctataaacacagcaaagaagtatgtacatcaagtgacagttgtataatgaaaaatagatttccacactgtcacctgcagtattcactttgttgtaaagcagtccatcagatgcctgagccatgcaaagcagcccaccttagagcagattttaactttgtcacaatttctggtctgttaaaaggtaagcacgtagccgggcacagtggctcaacaatttgggaggccaagatgggaggatcccttgagcctccaggagttggagaccatcctgggaaacatggcaagaccccatttctataataaagaacaaaaattagccaggcatgatggtgcatacctgtagtcccagctacttgggaggctgaggcgggaggatcctgtgagcccaggaggtccaggctccaatgtgccatgatagcaccattgcattccaacctgagtgaccctgtctcaaaaagaaaagaaaaggctgggagtagcatgtaattttttaaagcaattgcacagattccaagaaaatatctttaagaattgtaaccatttttatttgtgagagtcttacttggaaaattgtatctttcccccttctccctcttctcttctttgtttttggcttgtttttacttttaatacaatggggcccaggtccccacctgctgtgcttttatctgggttcctgcagctccatgcagagaagctcttgaacctctgataggccagccttgcactcctccctcttcagagcagggtagaagttgcccaggagataagagggacacattcctgtggagcccagcctgggagggtccttagggggatgggaaaggcccaggcttctggacggatgggttacgcccagcatatcagccactgtgtgaggaatcccttaggatataagttgctttcatttattactaccattaatatttatattagaaaggaacacagattgccgggtgcagtggctcatgcctgtgatcctagcactttgggaggccgagatgagcggattgcctgagctcaggaggtcgagaccagccgggcaacatggcaaacccccacttctactaaaaatacaaaaaattagctgggcctggtggcgggcacctgtagtcccagctgctcaggaggctgaggcatgagaattgcttgaaacggggaggcggaggttgcagtgagccactgcactccagcctgggcaatagagcaagactgtctccaaaaaaaaaaaaaaagaagaaaaagaaaggaacctagaagttactgggtttgagagccaccatgttttaatcgtgtggacttagacaagatctgtgacctccccgagccccatttcctcatctgtaaaatctaggttaatcataatatctgtaccatagggtcgttgggaagatgaagtcatatataggaagtgcctagcatagtgcctggcccgcagtaggcctcgtttgtgtagctggaactatgatttgatatcagtactgtctctgtaaggaaataaggtcccagcagagtacattctttgggggtcctccaggacaaatgaaaaccacagaaaccctagggtataactctgggctttaggtctgtaatgccattagctgggtgctaccaacataaaaaggtaatgttgacctttatagaactggcctcctgggtctttttagtttgactaaaatctggagtttgtgaggctaaacccctctccagccccataggcctctggctagtaaatttggttataaacaccattcaaccattaaagcccaaatgaagtcaagtgactatttgattacaggtttgattaatggaacccagacctaagactaactgtaaccattccggattctttaaatcttgaaagcatttgagaactaaaacactgtgggtgtaagtcatttaagtaattgatacccccaatagagggaccttatatccactcattttaaagtgtgcagactttttcttagttatttgttttcttttcttccccatcaacagagagaacttttctgaacctaggcgctctgggctatctttatttattctataaacaggctaccacctaaggtatgaaggcaaaatcgggcttatcaggcaggcaaaaatgctttctattctgttgcatcaacattgttaggcaaacagcaagaacaggatcaggaagataaagccctgaggaggtctcacggttcccaggaatttgtgtgaattaaatgatctgatcttatgaaaatgtagaattgcaattcgtaggaaaaactagaaaactggtgatagcagatggcaaacagacacattacaggttcatttgaggaagactaagtgatgatcatctgggagatggcaggaaaattggggccttgaagggctgtcattcatagttgtacataccgtttagttcagcatatttaaagtgtttcttttttcaactgttgcattatttctccatgaggttttgggttttttttttttttgtaagtattttattttcaacgaaactaaatttccctaattttaaattgatattgctgtttggcagaggtgaaagtattggtatcaaaatgacaataggatggctgttgcaaaaagagtcttacctgagtgcttaattttgaacccggtaagatttggatccttgaagttacagtacgcaaattctttaaatgatcatttgccgtgactatagcacacattatattgtcctataacaggaagctgttctaaatattggatattaaagagggcttcaatttccattctgtgcaaggactctaaaattttagacaggctgtccaagattatgattcatcggagataactaaaactaattttttaaatttgagttttgatttcaaatacaagacactgtttattttgccaaaaactctacttggttctttgttgctgttttgctgtttctatttctatgaaaggagacatcacaaacttttcttttctttctttcttttttttttttttttttttgagatggagtctggctcttttgcccaggctggagtgcagtggcacaatctcagctcactacaaccttcacctcccaggttcaagcgattcttcctgccacagcctcccgagtagctggcattacaggcacccacgaccatgcccagctaatttttgcatttttagtagagttggggtttcgccatgttggacaggctggtctcaaactcctgacttcaggtgatctgcctgcctcggcctcccaaagtgctgggattacaggcatgagccaccgtgccgagtcacaaacttttctttcttggctccatgtgcggcagtccataatggctcaacctaagagttattggaagaatgatttttcttagtaagaacaactcattgagagttgaagaatcagagagacttgacagtatcatagctgtgtgccatttcacactaaaatataaaaattaaagtgaaaaacttacaaaacataaaggtatttatttatttatttatttatttatttatttatttatttatttattttgagaaggagtctcactctgtcgcccaggctggagtgcagtggcgctatcttggctcactgcaatctccgcctcccgggttcacgccattctcctgcctcagcctcctgagtagctgggactacaggcgcccaccaccaggcccggcttgtttttttgtatttttagtagagacggggtttcaccgtgttagccaggatggtctcgctctcctgacctcgtgatccacccgcctaggcctcccaaagtgctgggattacaggcgtgagccaccacgcccggccaaggtatttttaaatgactcactttttaaataagtttctaatactcctctaggtattaggtattactgagtttcaagaaactccttaaatatatgaattgtttaaaaacaggtgtttatccactcattagagagtggttgcctatctttgctaacgttatttctttgctctataggcgtctaaatactttaaacaaatgtgcggtgatgaagctagaaattagtcctcatcggaaacgagtgagtatacaaattgcataatagaatgagggggaaaaggggcaaacaaaaaagtgaatgatgtgttttgtaataggttttgtttctccaactcttagtttgttgttccgtaagcatctacatcttgaatgatatcgcctagacttgatagccttatgtagttgaagccaatagttgcaactagtccattacattattttatctattgtttttgacctgatcacatcagctattattttgcctaattactaactcaatgcctattacataataaagggatcatgcttaaggaatcccagtggatttttgcattgctcatagaggaaataaactgaggtttatttccaactcttctgtcttcccaaatataacaataactgtgcttcaaagctgtagagatgaaagcgaaggccgatttgtgcaatattgaagaataataagagatttggagggaggaaaggaattggaagaggaagaggagaaggcaggagatcccacacagtttagtcaaatggtggtacacaaccgagctggatggtattttcttctgcgtgtgagttgtgaagactttttatgagatcttaggagaagaggtgggtgtagtactgggagtaagtgtcacaaattagagtaaacaggaatgagtctggtcaaagaacatatttctgacttccgggttcaaattttaattatgccagaatccctgagctgcaaaaagttgccttcttggggagtcaaagcttttaaacaaatgaactggaacctcagcgcccactgagctatgcagaagagtcctagaagccagcgctccatgcttgccactcattgtcctgtgaaacttgggccacaggatattttccacaccagtggaaaagacatgtatcataccgaattgtgccctttgatatcctgccgaaaaggccaagatgcaatagtccgtgtgacagcttatccctgagtcctgtacataaatcgggcataatcagcaaagacgttccttagtgtttatgaatgccgcgagctgtcagggctgggtatttgtgaagccttgttcaattggctggagcatgactgaggttgaaacttcacaggtcagctgtggcctgagcgctagccttcatgtcttgtgggggaggggaagaaaaggtactggtaagagtctccaaagcactgatagtggactgaatctgcttgatgacccaccttgatccagggcccctttactccagtgggagaccttatacatttttagtgtctagagatttaagttgccactcttcttagtgtttgaaaactacctttttaattgcaagagggaatataaacatacaccaacaaaagacagcacaatggaaggcagcccagaggcagtcctgctcattgctgacttcagttcaaaatattttgcatgcctggaattttcaccatctcagaggtttcctctatgagcaattaaagaacagcctatggatcccagagtttccataaaatagttcttatttaacttgcaacatttggtcaggcactctcctgttaaattctttaaatacatctttgttatttaaagaacaaaacaaaacaccgggcactgtggctcatgcctgtaatcccaacactttgggaagcccacgtgggaggatcgcttgaggccaggagtttgagaccagcctaggcagcatagtaagactactgctctctacaaaaaatttaaaaaagaaaaagaatatgtaagtggggctgggcacagtagcttatccctgtcaccgcagcactttgggaggctcaggtgggaggatcacttgaggtcagcagttcagaatcagcctgggcaatacagcctgtacaacagagtgagaccctatttctaaaaaaaaaaaaaaaaactttaaaattaaaatcatgaagtacaagggggaaattgatactactggcatattatgagcagcctcctgctcatgccctgctccctgctggctgccagccccagtgtgtgaatggctcctttctgtctttgcagagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggtaagaacttttctcctgcctccgggtgtggggcactgggggtcagaaagacattgcctgtgcttgttctgtgggaagaaatgggattaagtctggcattcttagccatgtccattcctaaggaaggtgtcaaaccaggaagcaccaaaattcaaagaaatcgataggattgaatgggtatagagttccggttggggaagatgaaaaaagttctggagatggttggcagagatggtcacacaatgagaatgaacttggtgccactcaactgcacatttaaaaatggtgaaaatggtgcactttatattgtgtatattttcccataatggggattaaagcatgggatagaaatcaagtcctatcagttcctaagataagatgccagcaagcagcccattgctaatgttgcttctacctattaaaaagcctttgggccaggcacagtggctcacacttgtaatccaatactttgggaggccgaggtgggaggatcacttgaggccaagagtttgagaccaagctggacaacatagggagactctatctctacaaaaaattaaaaaatgagtcagatgtggtggcacaggcctacagtcctggctactcaggaggctgaggcaggaggatcacttgagctgaggagttcaaggctgcagtgagctgtgatggcaccactgcactccagcctgggcaacagagcaagaaaaaataaaataaataaaatcaaataaaaaggcttcacactcattttcctctcctcttctctcgcaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctggtaagagtttaaatgatcagtcaactgtcgttgaaaatgatatttttggtcagttccttgaggttgtccccacagtaaaaaatgacacttctctcctttattaatatatttcatctgtcatcctatggcaatcactctctgcatttttgtttgtttgtttgtttgttttgagacagggtcttgctctgttacgtaggctggagtgcggtgcagtggtgcgatctcggctcactgcagccttgaccttctgggctctagcgattctcccacctgaggctccagagtggctggactcctgagtaggtgggactacagttgctttccaccacacccggctagctttttttttttttttttttttttcttttttcctttttgtagaagatggggtttcaccgtgttaactaggctggtctggaattcctgggctcaaaaaatccacctgcctcggcctcccaagttgctggaattacaggcgtgagccaccacgccagccactctttatttttttgaggccacatttgatattgttgaagccagtggagtcttaggaaattatcaccgtgggtgggttgattgagttttcagctctttgagtgacagattgccaattgatggggtgagaatgcattactcttgcatcacgtggtataggcacctccttcccaatattaagaataatccactataagtaaatgtatgcacagtatcagatcgtatttttggatggaggaaaaggaaaacaataagatttaatgagaccatctttgaaattcttgatttacagtacctggtcttataaccgtattcatgcctgtttttagaaatcattttggggcgggtgtggtggctcatgcctgtaatcccagcattttgggaatctgacataggtggatcacatgacgccaggagtttgagaccagcctggccaacatggcgaaaccccatctctactaaaaatacaaaaattagctgagtgtggtggcatgcacctgtaatcccatctactcaggaagctgaggcatgagaatcccttgaacccagaagatggaggttgcagtgagccccaagataaggctactgcactccagcctgggtgacagagtaagactctatctcaaaaaatataataataataataataataataataaatttggatgtgaatatttgtagcatccacctgtgctaaagaattcaggttactttttttctagcaaagactgtctaacagtgaataattattttaaggaattcactactctaacatattatagactcaaatgtagagatgaaatgcattgtacaaattgttcataattactttgaaaaatatagctccttagtatatagaatgtgaggggtaggctgtaaggctagatgggtcatggatatcacctaatctgggtacatcttaatttttctgctatcagtgccaagcagagaaatgtttctagattgacatctcagtgcatttttcagtgtcatctgggaatccttaagtcttttcagtaatctgagtgtttattatccagtcgcacactaccatatttgataaaaatggagaagccgcccatttcattagtagcactctgtagcaaacccaagttgcttgagaaagtcggcaaagcaaggaaactgttctttttgtctccagctcctcctctccttaggactcatagcagatttaacttcagcatcaaagcacctcccgttcaaaggctgttattatgtgagccttgctaaatacagaagttgtttgttctgaatgacagaaataagtattgaccggtttatcctcacatgcttcagattctcggtggggatcgtaatgtgttcttttcacattccgccgtcgggcttttctcccccgacaaagcgagtattatgcacacttatagccatgataccacacacttaactgtatggaaatacaaacttaactttgctctttcgttttacctttcctggagctataaacagtaacatgccatggctgctggtgagcattcaaaaggcaaagcagtctgtcttctctggagttcctctgtgcttagagtaatattttccctgctggctatttaaaactgcatattttagattctcatttcggagtggcccacccccatcccaccaaaccctcaagaatctgaaagtccataatacttcttgagttctggtcagtgtttccagtgactcaaaaccaactgtaaaagcctcacatggtgggatctgtggagcagggaggaatcctacacaaggttcttttcctgtttggccttgccctttcgggtcctgttcagagaggtcatttggagagctggaatttctgcttgacagcctgaaatgcatgacatgggtttcctgctgttgcatatagtgctggggtggacctggtttcaggacaccagggagcctggggtcggctcacaaaacccccattgttccttttccatcttcctttagaaacctaaagatgtaatgttctccgggtcatcagcagcagattttattttgacttcaggtcattcactgttgagctctggagttggctcccattgtgttaggctctcattgctgttttcccatcatgtgttatctgcgccttttgaccctaaatgctttcgatctcatcaagaactcagaagtgattcttacccttttttcaagacaaaagggaccttgtttttcacactctatcagatgcacctaattagggtattacatgttgttttctgcttgttccttcctataccgccattctgtaaggaaatccatcagcttccttaagactgtagaccccaattctccaggttcaaggtggaaggacgctcctaactgaggaaacggacctgtcaacccccactcttagaagatctagaacagcactgtccaggagaactgtctggatgataggaatgttctttatctgcacaggccaatacagtaggtactgagcacaaaagatgaaggagcacctgaagtgtggccagtaccactggggaactgaatttgtcattttgtttaatttaaatttaagtagccaccgtattagcacagatctggagcccacagggtttgcctgcagaattggacaagtgtagacagacaagtgagcatgtctccgccaacaccaccatctctgtgttctttaacagggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggtgagagcgctgcctgcgggtccacgtactcaggggagctcggattacatgcagcttcttctagttgtgtggtgtaaacactgcgtccacgtgaatgtaccccacacttagtgttgctcttccgacaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatgtgagtgtcctttgatcttaagattgttggcattggggaaaaatgggaccaactgaagcttgtagcttccttgatagcattctttttttttttgagatggagtctcgctctgtcatccaggctggagtgcagtggcgtgacctcggctcactgcaacctctgcctcccaggttcaagcgattctcccacctcagcctcccaagtggctgggactacaggagggcgccaccacgtctggctaatttttgcatttgtagcagagatagggtttcaccatattggccaggatggtctcgaactcctgacctcaagtgatcctcccacctcggcctcccagagtgctaggattacaggtgtgagccaccacgcctggccttgatagcgttcttttgacaagagagtctgcatggtgacctcttggaaacccatgtcatcaccttcttccttgccgccttgtttgtggaacaggtttctgtgtaattattgaatgatgtgaaaataaatttcccagtctctaatgactgatgcaattgtacgtttttacgtgcaaaatgaaaagttagactttcattagtttctagaacagtgttatctgagctggtcagataaagatcaggtacgaagatctctttctgtctccaccttgtctacagaaatttcagttgcttcacacccctcttggagggccgttggatttaaaatttcacaggtgtctgtgtgttttatcttgctgtaaaatgaataaataatctttttctgttattcatctcagtctctgccagaaatacttgggagaacaatacccatgcccttcttacttttatgtaaagcttaaagaaaacagttgtcgaaattaatgatcaagatcaggattatggcttttacagccttgtgtttttcttggctcagtgtggtattacagcaacgtaatttaaaagcagcctctcttagcgctcaaattgtctctaggattggcacagtggactttattttatgagaaatggagctggtctggattatttcattggttgtttcatcctttcatattttataaaaacacaggtcacattttcctcaccgaggtatttgttatgtgctgtaaccatggagctgtttaatcagtttgtcctatggagctacatttgagtgacttgatttttccaccacatgctcttttaaagagttatgtattcaaggagacctgaagatcgggatcagcattttctacctgtagattgtttatgggtttatttgcatttttatatatttgcatattcatatgcatttttatagcctctcgagcatgctttctaaaacttaagaaattactaattcagtgtattttatttattaattgaactgaactgaatattttcagttcagttcaattcagaactgaatattttagcagcttttcccacttcaagaaggaacaaatcagttaaactcatgcaaatctccagagatactgaacattttgtactcaaggctgagagatctctgttcttacgttcttgtacatatctcagataagatttttcatcaacactaaacaaaagtgtatagtgttttcagtaattgagattgataaattagggatttttttttttcatgcttaggaaagaaaaaactgttctgtaaactaaaagagcaggcatcctctagagccgaactctgaggtggatttaagagtgtttgggtattgtgggtgtttaaaaattttttcactccttcatgaggcaggaaatacttgaggatagtgacgccggtggcaattcataacttttaccgtattaacctctagtgcactttctacaagtgcttgttcagtactgggctgaggtatttgatgccgatatttgctctgggacatttccttgcaatgtccatgcaaattcaccaagctgatggagaaagtgctggtgtcgtgcagatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccaggtacgggctgcatgggaggtgcatgcacacagggggcagcctacattcttcctaggactctccgtagctgtggttttgtgggactctttcctgaaacaagcaagaaggttagaccgctatattagtccattctcacaccgctaataaagacatacctgagactggtctgttggcgtgcatgagaaaatagtctcactggacttaacccccacagacaaaatccatcgaactgatccttttcctcagctctaaaggaacttgaaaagtatttcttagctagaggcctggggcctagttatgctagtgcaggttaggttgcttctgaaagtcatataatgtttaaatgtatgtttaaatagttccttttgagacagagtcttgctctgttgcccaggctggagggcaatggcacgatctcagctcactgcaacctctgccttccaggttcaagccattctcctgcctcagcctcccgagtagctgggactataggtgcctgccaccacgcccagctaatttttatatttttagtagagacggggtttcaccatgttggccaggctggtctcgagctcctgaccttatgatccacccggcttagcctcccaaagtgctgggattacaggcgtgagccactgcgcccggccacatttaaatagttcttaaagttgactggggcattccaactgcaatgggatacagagctagagatgagtagaggagagagatcaaataagatgaagacaaaaggtcaaggaaacaatggacttagccctcacctgtgggagggggcctgtgtattcaggcagataaagatgatgacaccctttactccaactccctgggactcctttcccacactcctcagaagttgctcccccaccatgcaaacacagcccctacaagctgccctgttcccagtaggaacctatttaattaaatggtttgaatcacctggatttcatcaaaagcatatctctttaatgtttttttgtgtgttgttgacaaaactctgagatactctggtgaccaaagtaaaaacactcttaatccacttaacaataaacagattccagtgaaaatttttttttctctcttctttgggtttccttgaataataccttgaagaaaaatatataaatatttgaactgttcccctcctgtatttcctctacctagggtaatgcaaagaaaacaaagtttgggcaaaccagatcagaaagatttgaatgaaaacctagctgccactcaagggctggcccatatgatcgccgagtgcaagaagcttttccaggtaaggaattgagaagtttggctcctttattaaggataatgtgaataggtacaaaatcttaggcttgacccttgttcatgtcttacctgaagaccttttccacagctggagacggtataaatagcctgagaatgtcttatttacatatattataatgtatcagctagagttaatcatgtttaatgaaattgtccctttacttggaaaagcagccgggcgcagtggctcacgcctgtaattctaacactttgggaggctgaggtgggtggatcacttgagctccggagttcaagaccaacccgggcaacatggtgagacctcatctctacaaaaaaaaatttaaaaattagccgggtgtggtggtgcacacctgtagtctcaactacttgggaggctgaggtgggaggatcacctgagcccagggatgtggaggttgcaatgaaccaatattttgccactgcactccactaggtaacagaatgaaactctctctcaaaaaaaaaaaaaagaaagaaagaaagaaaaagcaacaaattatctggaattaaactgctgtatccacttccgtatctgagaaacctgctttgaccaatgtaattcactccccctactctaactttccaaagaccttacatggaaataagatttcagatacatttatggaggtgatctgttcatatcctcgtgataacacgtgcggtcagcatgatagcccacctccggcgggaagatgcctgcactgctttaaggaccaggccattgttcctacccagtcttttccactgatgggcattgagattgagtacaggtggactcacctcctttctgtctgtcatgttccgcacaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtaaggcttcaccctgttgtcggctagttgagtccaggagtcgaagcttgggtccatcagagataacacgcttttgccaactaatctgtctggggatctgtagcccacaacctcccttgtagagctgggcaccggggtgagtaagatccccgtggtgagagtggaaaccgggcaaagcaagagtaattttcttcctgtgtaacacttgggagaggatttcaactatttctaatgaactcctttggctctacagaatcacactagacttccctagaatgttttgctaatggcattgagatgcggaacatcctatgacacgcttcgatttttccataatttggtcagaatccctttgcactcttctctgttcttagttactgttctcttggccctttaatgagcggggatcccttagggggaaattaactccagttaggactggtaaacctcttgagggcagaggcatcttgtaaggctcagcaggataggtccatcggaggtatatgttgatgccgcctctaccatcttgaaaataaacaaacagtgggagtaggctgggtggccttgccggctttggaaatgagtgcaaatgtctgatgtttttgtttttatttatttatattttttgagatggagtcttgctctgtcacccaggctggagtgcagtggcatgatctcggctcactgcaacctctgcctcccggtttcaagctattctcttgcctcagcctcccgagtagctggcgctacaggtgcccaccaccacgccatgctaatttttgtatttttagtagagacggggtttcaccatattggccaggctggtctcgaactcctgaccttgtgactgcccaccttggcctcccaaagtgctgggattataggcgtgagccaccatgccctgccagtgactgatatttctttattgcatgcactctgatataggtcccagaaaaaaaaaaacaaatgtcatcatttttttcttttttcttttgagatggagtttcattctcatcacccaggctggagtgcagtggtgtgatctcagctcactgcaaagtgcctcctaggttcaagtgattctccttcctcagcctcctgagtagctggacttacaggtgcctgccaccacgcctggctaatttccatatttttagtagagacagggtttcaccatgttggccaggctggtcttgaactcctgacctcagatgatccacccgcctcggcttcccaaagtgctgggattacaggaatgagccactgcacccggctcaaatgtcatcattttgactcgagttgacaacagctttttttcactttctggcttgctcttaaatatgcttggggacagcagcctatttaagtcatagatttattagcccccaatatttctttatatactgattatatagtattatttatatcatttaatcaattaacgttgattatatgtaactaaaattgttagtctaactaacaattcgacttcaaaaactaggtgtgtatggattgccttggcactgaaaaatacatcctctttccaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaaggtgagcgcttcccagttgtttttttgtgacaaggatgactccatatatgaaccaagcctatatgtcactgatcttacaagatggtataattatttaaagtagaggccgggcatatggtggctcacacctgtaatcccagcactctgggaggccaaggtgggaggatcacttgaggccagcagttcaagaccagcctgggtaatatagcaagaccctatctctacaaaaaaattttaaaaatcagctagatgttgtggtgcatgcctgtagtcctagctactcgggaggccgaggcaggaggatcccttgagccaggagtttgaggccgcagtgagctgtgagcatgccactgtaccgcagcctgggcaacagagcaagaccttatttctaaataaacaaaacaaaacatatgcttccagaaaagtagtgaacaccttcaaatatggaaaacagatctacatttattctagcagtgtgttcctcgctgagaatggtctgaactctttggtaactgagctcagaaagagaggccccttccaatgaatatgctcattcgtagcagatttttgccccttttaggatagattttcttgtcagaaacagctagtgaatgaataagccaggaaataacatttgagtcccaagggagatgtggttaaggctgatgtatgtgtaattcataaattctctggagatattactgaaagaagaattccaaaaatctttgtggaaatgtcacattggaagtccagaccttttcaaacagccagcgctcctttaggtgtctgtgttccaagacatttgtgaaatagaaaaatggttttaagctacacttcaaatgggctcttttttcaaagaggagactgtctgagcacataaaccctctgtaacaacggctctgtacagagttcctcattcagcagtccttgtacagtgtcttcgtgcatgtaatgctgctctaacagaatctcacagaccaggcaattataatgaacagatatttatttggctcatggttctaaaggctgggaagttcaagatcaaggagttgcatctggttagttggttggttgtttgattgatttggggacatggtttcattctgtcaccaaggctagggtgcagtggcacactcatggctgctgaagccttcacctcccaggctcaagcaatcctcccccctcagcctcccaagtagttgggactgcaggcatgtgccatcacacctggctaatttttttgtttctggtagagacatggtttcaccatattgtccaggctggtctcaaaactcctgggctcaagcgatcctcctacctcaacctcccaaagcgccgggattacaggcatgggccacccaccatgcctaatgagggtctttttactgtgtcatcccatagtggaagggcaaagagagggcaagggagagcaaaagagcaaatgtgcagcctcaagccatttttatttttatatttatttattttgagatgggggggtatcactttgttgcccaagtttgagtacagtggcatgattacagcttaagcaatcctaccatctcagcccccggagtagctgagactacaggagcacaccaccatgcccggctaatattttttatttttagtagagatgaggtatcactatgttgtccaggctggtcttgaactcctgagctcaagcagtcctccctccccagcttcccaaagtgctgggattacaggcgtgagccatggaacccagccttaagctcttttataattggcattaatccagctcccattaggccccacctcccaacactgttgtattgggcattcactttccatcacatgctttttggggaacacatgtacaccatagcaagtagtttagaggatgccatttacctaggcctgggtcacacagcatggccactgagcctgacccgtcaccacactgcaaatagtgaagagtgaagcacgattttaaacttggcttctatgaaattccatcatttctgcctctggttttgtctctacagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggtatgttctgattctgatttttttatatggtgagggtcatgaaggaaattctgactttttgtctaatgcaaagaatgccttaaacaaacacgtcattttttcttggtgacttcatgaagaatggtgtttagaaagtagcatttcatgtttgttggtctttcagcgaccacttcgtaatttggttcccttagaaaatgtggttctaaagcaaagcaaatatggtagctcggccatgaattcaaaggcatgggaaatgatagattttatgcatttgaactagcaaacagatgtttctcattttatttccatgctttctaacttaaataattcatcagcttttctttcttttctctgataggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcaaattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctccagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttcttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctct

SEQ ID NO: 15490 - DNA, 32488 bp, Human
  misc_feature (1)...(32488): n = A,T,C or G
taaaaaatgcccaggtagctggtaaaatgtttttttctgggtgtgttagggagggtgtttctgaaagagatcagcactggaatcagcggactaagtaaagaattcccaccctcaccaatatggtgggtgtcatcaatccactgagggcctgaatagaacaaaaagcgggcagaagggcaaattccctcttcttcttgagctgggccatccatcttctcctgcccttggacactggagccccttgttctccagcttttggattcagactgggtcttgcaccattgccctccatcttctcctgcccttggacactggagccccttgttctccagcttttggattcagactgggtcttgcaccattgccctccttgatgctcaggcctttgaatgcagactggtctccaccagcagcttttctgagtctccagcttgcagatggcaaaccatgaaacttcatggtgtccatgagcatgtgaaccaatttctattataaatctgcaatatatatatatgaggagacttatttatatattggttcagtttctctggagagccttggctaatataaagtctatactctacaaagtgccctaggtactcagggagtacccaagtgtgtcatgaccagcccgacagccctggctgctggcttccccgcacacaactctgcacgctgccttcatcagcctttctctctcagctgaaccgagggcattgaagcgggcctctggcactgtacctatgagggagcaatatcttcccctacactgacctcttccgtgccgagatgcagccctccctgctgccactagttacagtggtccatgttccctttcaaagtgaagttttgataaaagcacctcttaaccaatgccaaatagctaagtctgggacaaagattgcaggtattttgcattttccatgtaacctcagagggattgccattcacactgatctgagctgcagaataccaggcagccacctcacccacccagcaggtccactcttatactttctcagaaagcacagccactctactcttattcagttgaaaagaatttccaggaaggtgtttctgcgattgcctcagaaaagtcagttccctttgggaatttcccttagggatcatctgtaactccatttctgccttttacctgaattctttggtttggtttgaattctttggtttaatttatgaattccctttattacttttctctgaagaaatggagatatcagctgtccctccccactgccatttattccttccttcattcaaaccttatgtggctgctacttaccgtgtgttaagtgttcactttttttcttggaattcaaaaaaagaaggacagtatttggggcacagatcttttggtgttctatacatttttttaaagtttcattttacatttgtgtgtgcatgtgtgtgtgtgtgtgagacagtcttgctctgttgcccaggctggagtgcagtggcataatcattggctcactgtagcctcaaagtcctgggcccaagcgatcttcccacctcagccacccaaaatgctggggttacaggtttatgccactctgtctgacctgaaagttttgggtttactttcccttctttctctttgctgaagtcagagatgatggcagcttccagattctctggtgcctgtgctgggctcgtgctggtcatggtcttgggtccaggattcattctggagactctcagggaagtttcccatgacaaggaaatgtaggagagtgtgctggctttgcgtgctcctctgccaagccctgcttctcctggtgggacacactgaaccacagccagggcattttggtggttagttaaaaaaaaaaaaaaaaaaaaaaaggaagaagaaggcactgtgtaattgtgccggggatcttcagaaattgtaatgatgaaagagtgcaagctctcacttccccttcctgtacagggcaggttgtgcagctggaggcagagcagtcctctctggggagcctgaagcaaacatggatcaagaaactgtaggcaatgttgtcctgttggccatcgtcaccctcatcagcgtggtccagaatggtaaggaaagcccttcactcagggaagaacagaaggggagattttctttgatggttgtttggaagtcaggcttaaacaattgtgtctgtgtgtgcgcatgcacaaacacttttaccttatctttattttcttctttttatttgaatgtatagggttgtgtgtatttctgtgtaaatttggggttttcctcctcttagtctttcacttttgtggtgattaccagtcccatttttagagccagggctgcaacttgaaggttttgctaaaaccctcaccgaagtgtctatgatcagcattttaactattaattaatgtggccaggcaaggggtggaaggtgagaagactagaaagggaacatgatatacacatttactcagatactgggcttttctaacatctgcagtgcaattgaagttaccagtcatctgcagtctaaaaagaaagtgattttgggaggtgcgtagaaaaaatcatcttattatttttcctctatattacttttttctttttttctcctgaagaaacttttttttttggtgataccttctttttctctagcacgtataattttggaagcatttttcatatgcagtgtatacttcagaaagagagagagagagaggaaaattgtcctgttcagcgtttgcatttccattattcctgctattagttaaaaacaacaacaacaacaaaaaacaagcaggatacctagatctggaaaagggagaattgtgtagagctgtcttcctaaagttctgagttagggctgcctcagaccactttcataactatctccagtggctttgtgttttatatttattaagatagagaaaaaaagagtaattactaagggcagctgctgtagctttatggtgattactgaacattgacatgctgtcacgtttttggaactttgagtatttaatcactttgggatattctattttcccccatcttgagtgtggacagatgctggtgatgtagccttctgggcacagagcaagcctccccctcagcctctgcaccagaaaggctcagcttcacacactccaagtatgttttctacaagaactacactttgtggctttctgacccaaacatttttatactaaattacacacaacaaagttgtagctcagagagggaacaaatggcttatttaggccaccattttcttgagccattatgatttcacacagggctcccttggccctgtaaattggcaaggattccattattcaacccgcatacatgtacagagaccctgctctggcccagatagtattctgggtacaggcggatagagcaggaaacaaaacagctacagtgatggacaggtcagcctgcagcaatgcctgcagtctctgcgaaggtagctgtatgggtgggcaggtggctagcacttattcagctctggaaggatctcccctctggcctctcccctgacacccatcaataaaactgaggagcatcggtggacaggggaccttgtgccccctccctgcctgtgcagttggggctgaacccagctacgaagtttgagctcactctctccagctccctctcaattcagagctgaactgtgggaagcttcagagctctctgtttcaaggacaggttctcctcacctctcctaatggaggtgcaccagggaactggccctgctctgcccagggctttctcctggactttgccatcatggtctagcaaaccctgttcagattgaggtgagtggtgagatttcgaattctttttgacagataggattaagtcttcttctgtgggacaagtgggaggtagaggtaagattaaagatggccaaatgtctgagtcctgacagccacaatatggagatctagactttttacagaccacagggcacaggggcctcactaacagagttcccggaagtgatgagtgtgctgggggcttcctggttgaagagacactagaatggacgagctgggagctaattttttgggctggagtgtgatggcctgcacatcactgcctctgtccctccattgtcacagctgccccttaggagccagctgaggcaatttgtggtcagagtgactttgcacagttgtcctgcctgtgttcaggaagggagtttctgtggtccctttgaaaccacagaagagcccctcgtatagctctcaatggagggggcaaaacattcaaataactcaggagataacacaactatttgtttttaactgtgagtttttaggcaatcacaaagatccagatgtatgtccaagcctctctttgcaattctaattaacctcaatgttgcaaccatagacctaccttacagagttcaaaaaaatatgcaaaaaccctgcctttcttcttcctcataccccaaaatgccattctgaacatttcctgttagttaaaaaaagatttccatggtgttaccaggcactgtacacagtctgtgtcccaagacaaggaggtacagttccacatgcgcccatgactgggttgggctctgcactctctctatactttgagagcctgattttctgtgattgggcagagctggcccacctggtgcaatgtcctcctctgcctttcaaacatgttttagtcatcaagatcttcaaatttgtaaccctttccagcttgatccagcagaatgcagatttggaaaaacagaacgagtttaaaatacatgattctaagaaacctggaccagaactatcaaaacttggtttcccagagaatatagcaaatgggctcattggccaatactatgacattggcttttgagaaaagaaaggctttattgcaaggctggccagcaaggaaacaggagttgggctcaaatctgtctccccagtttggggcttagggcaagttttaattatacagacgcatttcttatgagtagcaggcagagagcctccaacttcttctgcctaggtaccagcagcttagacatgatgcaaacctgggaagcacatactgtatttggagaaagtgattgggaagaaatgtgagctgaggggaggggctcagtgcccctgagctacacttagtgatggcagaggaaggatgtcctcccgcaggaggctgttccacatctgctctggttgtagggggagctggcaggcattagcagcggcctctttcccccaagagaggcagcctcctccaagttttggcgacattatggccctgcaatcataagggtttgtgagcatagtgctaaggagggaaatggagctgctgttactagttccaccccaacacacacacacacactcacaagaaacctcacaagcaccgtattggaagactttgccatccaacctgggatttgacaggctctagaagcagaatcatagactcatgaagttcccccaaagcaggaatcttccttacagtaacccccaaccacccccctccaccgcctccaccagctgcttcttcctgaacactgcagtgtttggaaaactcacaaacttccaagcttgcctttcctattgttgcatggattgaaagcttgcgttgtgtgaagaatggcgcttcctgctgtgcttagttttatctcatataatctttgcaccatttaatccttgcactcacccactcatgcaactgcctttgcagagactggaggggccgctgtaggctgacctttccttcactgtacctattttgttccctgctttattcccctgcacccaggacactgcctggcacaaagacaggtctttataagtgtatgcaagtgaataaagatatatatattattattgttatttttgagacagtttcactctgtcacccaggctggagtgcagtagcgcaatctcagctgactgcaacctctgcctcccaggctcaagtgattctcatgtctcagcctcctgagtagctaggactacaagcatgtgccaccacgcccagctaatttttgtatttttagtaaggacagggtttcaccatgttggccaggttggcctccaactcctgacctcaagtcatcctcctgcctcgacctcccaaagtgctgggattacaggcatgaaaccagcctagaaatacatactattatttattcctgttttacagataagcaaagtgagtcatggagaatttggttgaaagtcccaaggtcaggagtcgtgaagctgggattaaaacctaatcatctgactttagagagtagacacttgctccatgcatattgcctccaattcattcattcaagcactccctgctcaagaagttctttcttatgttgagctgaaatctgcagccctatgcgttttacccagcagtcctggtgctgttccctaaaatcacttagactgtgcctgctctttctgtgtttacagtgtcagctgtaatatccccctcttcggcctaacgtttctgaagtcccttgccactgggtctcctctcctcttcctgtgttctttctaagaacacctatgcagataggtgtcttctgtacagggaagctgttcctgagatccgggcatcgactctgttagaataatctacgtatgagttatttttttgagaactatgtgtcattgctgactcatattaactctgtggttaactaaaatctcaagatctctttatgtttgttgagaaacttatttaacttctctggccctcagtttccttcactgagcagtggagtgattgataacctccacctgtggttgctgaaggtcttgcacaagatgatatagttaaagtagctagcagtgcccacgtacggcggatgcctcacaacggtttgcagccatctctctatctgtgtctttgtctctctctcacactggttttggcttactgttagcagctagccgagataagtgtgtttatggtctttgcatgcattgtttctgtagcatactggaggattacaagaggttggggagtgagggggcggtgaggagtagacaaaggcagccaactcttccaagtttagcttagaaggaaggagcggtaaaccctagttgaatgttggactgaagcaggtttgtttttgttttgtttaaaggatagggaagatctgtgcgtgtttccaggataaagaaaaggagagaatatgatattaaagattctggaagtgggagaaggagcaatgaaatacagacttgaagtcagtggcatggacagggtcaagatcacagttagaggatgcagccttagagaaaaggaaggggctcggttctctgagcaaggagggaaagaagagaggcagatgcagagaagtacggcacatcgtgctgctggttgtagaaataacctctgacttttaataaagtcatccctcggtatccctgggggattagttctatgacctccctcggatgccaaaattcgtggatgctcaagtccctgatataaaatggcatagtatttgcatttaacctacacacatcctccatatcctttttttttttttttttttttttgtgagatggagtcttgctctgtcgccctggctggagtacagtggctcgatcttggctcactgcaagctccgcctcccgggttcatgccattctcctgcctcagcctacaggtgcctgccaccacgcccagctaattttttttttgtattttttagtagagacagggtttcaccatgttagccaggatggtctcgacacatcctccatatactttaagtaacctctagataatctctagattacttgttttgtctttttttttttttttttctttttgagatggagtttcactcttgtcacccaggctggagtgcaatggtgcaatctcagttcactgcaacctccgcctcctgggttcaagcaattctcctgtctcagcctcctgtgtagctaggattacaggcccctccccaccccccccaacaactggctaatttttgtatttttagtagagatggggtgtcaccacgttggcctggctggtcttgaactcctgacctcaggtgatctacccgcttcagcctcccaaagtgatgggattataggcatgagccactgtgtgtggcctagattacttataatacctgatagaatgtaaatgctatgtaaacagttgttatactgtattgttaaaagacagtaacaagaaaaaaaatctgtacatgttcagtccagacaaatggttttctgtttttttttttttttttttaatatttttggtcagtggttggttgactccaggaatgcagaacccgcagatatagaaggttgattatgcgttcagaggcagggaataccatcttgggttccagaaagaaaatgatcagcattttctgtcatactctggtaaaaacagatcttttgaatggacaggtgtattaaaccctgtggagctggctgggcctggcggctcacgcctgtaatcccagcactttgggaggctgaggcaggtggatcacgaggtcaggagttcgagaccagcctggccaatatggtgaaaccccaactctactaaaaatacaaaaattagccgggcgtgatgacgcatgcctgtagtcccagctactcgggaggctgaggcagaagaatcgcttgaaccctggaggtggaggttgcagtgagccgagatcacgccactgcactccagcctgggcaacagagtgagactccgtatctaaaaaaaaaaaacaaaaacctgtggagctgatgaaatcctgcagggagcttcacggtgacagcaagaggagaaacacatccccatatgccccgcagagtttgaagtcccggctgcacctctccccagcagcaggttgactctggaaagttgcagcgttcttacctacagagtgggaacagtactacccattgcacagagtgggtgcaaagctctgtgacggaatacatggcaagtgcccaccacattgcctgggatgaggtgggcccttcctttacgtaagagagccctacagatacactcaaagtgggcacattcctacagaaggagtgttatttgtgtagaaaagaaaaacatgaaaggcttttattcctatacacaataaagcacccctttaatgtctttttgaggaggataatatgaaattgatgaaaaggaaccctgtggttggatccctgacaatcacatgtatcccttttttcactcttgaaaaaggagtaaaggaataaaatagaaggggagagggggcagagagaccttcaccgcccccccccaccccccatcatccaatctatagtcaaaccctccagactgtgtctccttggcatctctgacacccccaccgccaccaccccagtcaattcctatcttatccccctatcctggatctgattctgctaagttcctgccacactaaagacagggtggctttctgatgacaacattcctctgcttaaacctgtcagtaattccttgttgctctcagacggaactaagttctgaatttcttcacacggctctcagcaaggtcacagtcaccctgctaggccccaggggcaaatctcaatggtcatcttcttgaagacctggctcagttatttctttctcattgaggctcacgaccccaccttcttgcatgcctcaaacggccccttaccatgctcttctttcgcccatagctcagcacaccgtatcattttaatttatgtattttgcttaatgtggatgatctgtctcctcctctgctgtcctcaccagagcatcagttcctcaaaccaaggctctttgttttgttcttggatgcaagctaaatgtctggcatgtggcaaatggtcatagatacatgtcattgaaagaatgattcatcacctccctctttggccttgtctgtggttctaccaaatcccattccctccccagtgccctccattccccctccttggctgaacattctgaaccacagacagttctttaccctgaacctttgcatattttgttctcttagcttagagcggcccctctccctccgtctgcttggctaatttctacttgttcttcagattttatcttagatgtcattccctcaaggaatccttctgtgactcaacatggaattaagttgcctcctttgaccctgaaagcaccatgtactcaatctcatcttggcatgactcactttgctgtgtggaatgtctgctttccttgtttgtctattcctttagactgtaagatcctagaaagtgggggccgtgccttgctcatgactgtgtttctaacaccaaacacaatgttcagtagagagcagctgctgagtacgtttctgctaaatgacagttgatggaggacatttagggttgcttggaggtcaagtcaaggaggcatttaacattctagtaaaacaaggaagtaacaggctcctgaacatgcccacaatgaaccagatgcaaaccttttcccttggcaggattctttgcccataaagtggagcacgaaagcaggacccagaatgggaggagcttccagaggaccggaacacttgcctttgagcgggtctacactgccaagtgagtcctaaacctgatgttgctaataagtgggggcatgggcaggggggcctccttctaggagtgatgaccacccttaataccacatgtctgtctgagccaagtttctgagcgccagggaggtgaggaaggttggacttcaccagagaggctttgtggacaccctttatcatcttagtgagtgctagtgtcaaaacaaagggagtggggatatggggcacattggtggagggaggtgtgatctctgcagcttcagaaagatctgaaagagtcatttggttagagaagttgacctatttcctgtggggttagaccagggttgctactgtgaacaccagccatgactcaccagtcaccttcagaagccacaggcaggacatgctgacgacagccttcaactcacccaccccttgctcccctgcgggtggaagtctggaggtgacaccactgcattttctaacacgggggctccttgagcaactagaacaagaacagaaagaatggggacattagcaggtgctttccccctctctcattcttttctttgaataaaaaggttgtttgaaaacacctgagcggctcctaaagatgggtgcaatctattcgggatgcaaatccgaatgaatgttattcaaatgctcctctcttctttatgcagagtgtatttcaaggctcagccagtggcaggcatgctggggactatggactacggactaggggcctgtcacagaggaaggcctcatgctagagagctaagggaggagctggccttcagttccatcccaggagcaactttgatgttcccagagatccttccaaagggggagtcatggtcacccaagaaaaatgtattcagaatgccaagaatggtgcaaactcaggacaaagattcacactgcagggttggagtccctgggcttgctgctggcaccatgggagggagggtccccttcaggggtaccgttggtttcctgtgaattaaactggcttcaagggatctcgactgaacaggcctatatcacactcactgatatactctctcttcagtccttctcctcatctaggtatttttaattgtttcagtgaggtgtaggcatgaggggattggagggggcatctcctccattgcagtttttcattggctgctttgctccctcagctccgaaatcgctgggccactctcgaacgcattagtacggtagtcacaggttgattgcctggccccttgccctctgtgggcattttccctctcagactgcccctgagtactcacagtgctgctacagtgggccacctagatctccctctttctccatgctcccacgtgctctgggctccactcccttctcccaagcacttctgtccagggctattccagcagtctgacctcaaggaaatcctttgctaaactgattatagagaggtttctattttaacatttaggccttccatgtattaattctcagaatcaatttaagatgtttaaaggtgtgatttaagacattttaaaaccatttggaggagagtacagaaattatgtcacttgctgtcagcctctttgcaccatctgcagagaaagatactagagtcccgccttggacacatccacatgcaagaggtgcaaagaaggtgtctttgatgaggcaaggtcaaaactcctccccagacgaaatccaaagaaagcattcctactatgctatatcagtttggaaagaaaaacttctgccaggtgactgcattctcactggtcacattgtgttcctatggactcctcagctcaaccaatttggagaagttatggtgcaatttcaccatatctggctagaagttaagtttccaatttgctggcaatgaagaagaaatggagcaggccaggctgtgtagtttctgccacgtgcccccgggagtgaacagctctgtttgtaagaagccatggtgcttagacctgggcttgctagttgccagcctccaaattgcagaagtgccctttggttggtggctatgctgtgtcacttgggaaggtcgtttggaagttccacagtcgttgtggggtgccagagattaaaaagcgtaagaggagagtggaaagtgattgttgctgcttgggcatccccaccgtgtgggtgctgcagcccagctctcaaaacccatgggtctgtacactcaacctccatgagagggaaggagaaggatgagggaggggagagatagccatggaaaggtaggaactaagcaggcagggtggaaagttttctgtaagacaaaaactgtctggacactgctgcggttctgttacaaagaccacttcctccctgggccagcaacatatctgtgtgcctgtctgggttgtaaaaagggtcaaagatcaatgcagcaggcagctacatgctggcaaaagccagaggcagctggtctgtttgcctgtgccaggaaaccactgggaatggggttgtgtgttattctaggagaaagtcgtcccagcagcagcttctccaggggcatccaagagcactgaaaagggttgcaagatgacccatgaggctgcaggaagaaaagaacatgcatttaatcttgctatctgaaaagtaagacatgaagctttcctcatttttaatatacacatggacagtagtatgtgtatatagtttatatgcaaatatacttgttataaggttgcatgctcaaaatttttggttcatggggtgtgggatcataaatgtttagggaccatggctatcaaggaaaaacagcatgaaggataaatgatactggcggattaaaaagacagatgcatgtatttttagcataaaacacaactgctgactgatacagatagctcaacattctggggcagctgctgaacagatacactagccagtgtggctcatcggctcagacttggccttaattaatgggctgtccctccacccatctcccatgagggcagagctgagccagggtttgagagctaaaaggaattggacctggactcagttcacgtgtatattttaattctaattaattcattcttttgaaagacagagtcacactctgttgcctaggctggagtgcagtggcacgatcttggctcactgcaacctcggcctcccaggttcaagttattctcctgcttcagcctcctgagtagctgggattataggcacatgcccccatgcctgactaatttttgtatttttagtagagacggggtttcaccatgtcaggctggtcttgaactcctgacctcaggttatccacccgccttggcccctcaaagtgttggaattacaggtgtgagccaccgtgcctggcctgttcacatgtataaaacacagtttaatgtcctattcccagccaatgagcatggctagagcagccttggtcaaagtttggtttttggagaaaaatccttgttagctgacctaagattcctctttgtgagtgtaagtaagcacaggttgcagagaggagaagggtctctggagaggtgtaattttctaaatggattacaagttcatggacttttaacaggtgttacaggggataacaagttctttatagacagacttttgaggacgtttaagggtattctgattcttggttttctaagaggggaatgtattatttaactacagacacccctaccgcccactttttgcagagtgtatcaaaacatgtttttggaataccaccctcatgtcgcttctccctgcatctcttatctcttggtgtccattctagactcactttctttctgttttttatttttatttttttttgagatggagcttcactctgtcaccaggctggagtgcagtggtgcaatcttggctgactgcaacctctgccttccgggcttaagcaatttttgtgcctcagcctcctgagtagctgggattacagcatgcaccaccatgtccggctaatttttgtatctttagtagagacagggtttcactatgctggccagcctggtctcaaactccttacctcaggtgatctgcccgcctcggcctcccagagtgctcagattacagacgtgagccactggtgcctggcctagactcactttcaagtggcatagacttgtaaaattatttaaaggtgataggtctacaatgatcctgtcaattagtattgacactattattaataaactgttattaattatatttacttactttaaattaatccaaactaattaacggaacactaaagagtttctatgttttattcccagaggtggagaaaaatgaaagggaatatagcaacgaattcttttctccataaaaacatgaatagtgcagcacatcaagttgaacataccacagcaaattgttgcaagatctgctgagtagctcctatttagacctcaaggaatgagactcaaaatgggttcatcagttctgttttgcagaaaaaatagcgcaaaatttctcaaaagaaaatccagaataataataatttgtcaataggaaagacatttccactgggggttaagaaggaagacattggaacaatgatagccaccacttattgaatgcttactgtgagccaggtggcacttcaccttgtttcattctcacaacagtctagggaagtaattactaatgtctccatccacctcttgtagatgagcaaattgaggctcactgaggctaggaaatgcacccacactcacatagcccataagaggcagccatggcattgggcccagaccatgtgaacttcaaagactacacgagcagccactgggcagctgtcatggctaaagccacttgaattcagcccagcagcaaccccctctccaggaggggcacataagcttgcagctttgggtagaagctgcacttgaagtcctggatggcgagagggactggcttgagccagagccaggaacaaggctctgagaatattctggaaatccacaggaggaacccattttcttacagctgggagaatttcattcaactccaggctgaccatgttttattaggaacgaaggtgacttgaactaatagtcaggaatggttgaatacggacccaatgtnnnnnnnnnnnnnnnnnnnnnnnnnnnnnnnnnnnnnnnnnnnnnnnnnnnnnnnnnnnnnnnnnnnnnnnnnnnaaacatgagaaagagaaggaagcaggggaaatctttggtactaataagtttttaaacaataagagcaccagatattttaccccatcagacacagaatgttattcgaataaccaaaaaaggaattttttctctaagtttcttgaactggaaaatgaatcatattttctcagtcctgaggctgcaattttgtgcctctagtaacatataagaatagatgtgatgccagtgcccagtagctgctgcaattgttacttggggacctgtttattcactaagcacttcaccccagtgataaatttgtaggggcctcctgccctttggagctcctaccgtgtccattagatcagtggaaattctgggattcagagcactttgcaaggtcagcaggggtctgctctttctgtcctgttcctggtttttggttgtgcctggattccagggtaggtttctcatctgttaccttcatagacttctccagaaaaggatcttttgaccatcagaggaccacgaagattccattggtgaggcgcagataacctgatctctctgggttctctgcagggcacagatgaagggctggccattcccaagttctcagtggtaccactgaggcatgagaccctaatggtttgcatgagcagtttgaaaattgcatctttgtttttacctatataatcacatgaaacccgtggttctcaaacgtcagcaggcatcagcatcacatggagggcttgttaaaacagatttctgggccccaacacagagttttaaattctgaaggcctgaggtgggcgtgaacatttgcatttctaacatgttctcgatgctgctgccgccgctggtcccgagagcatgcctggagaactgccaccttcgaccatggactgtgagaattcacatggacctcagaattataatcagtctctcagttttacagataaggaaactaaatccagagagattgttttgccaatggtgaacagctggttaaagtcaggatggagactttaatcctagtcaagtgacctttcctctgtatttatttccctccctttttatgcctctcaagtctagttacactgtttttcatggatgggcatatttattgtcctgatctggactgcagacttctcaggaggacacctatgatttaatttagtatagttgaagagttaacagacatggctttggagacagactgattatggtgtgaatcccggctttgccactccctagctggatgaccctgagcaagttattcagcttctccaagcctgagttccttattggaaacatgagagcaattgtgataggcagaataatggccccctcaccaatcatgcccacatcctaatcctaggaacctgtgaatatgttatgttacatggcaaggggaaattcaggcagctagccagttggccttaaaataaagagattatcctggatgatctgggtaggacctgatgtaaccacaagggtctttttaatgtggaagaaggaggcataagagtagatgtcagagtcattcaaaataagaaagatttgatgggccatccctgactttcaggttggaaggaggttctgagtcaaggaatacaggtgacctctagaagctggagaaggcaaggaaatggtttctcccctagaagttccagaaggattgcagccctgctaatatcttgactttatagccctttgagatttattttggatttctgacatcctgaaccatagtaaaagggtgttttttgtttttttgagacagagtcttgctctgttgcctgggctggagtgcagtggtgtgatcttggctcgctgcaacctccgcctcccaggttcaagtgattctcctgcctcagcctcctgagtagctgggattacaggtgcttgccaccacacctggctattttttgtgtttttagtagagacagggtttcaccatgttggccaggctggtcttgaactcctgaccttgtgatctgcctgcctcagcctcccaaattgctgggattacaaggcgtgttgttttaagccactcagtttgtggccacttgttacagcagcaagaggaaactcatacagttatcatgtgaactcacaggaatatggtgagttaaaaagagaggaagggtgcaaaacatccacggtagagtgagaactctccagggagtgaggactgtgcacagcatacagtgatcaccctcttagtaagctaagtttctgagcaccagcttttttgagttgactttgttgtctttaacatttgaagatcacccttctttgctcagcctggcttgcagacctgggctgatttgtggatctgatagaaaagtttccttagttgggctcttctccccgaccacccccatgccagtgtggccacatcctctgtctgcattgctcactcttcaattccaagaagcgcaggggcaccgccaggaacaggaaccctgccagaggaatacatcaagaaaccaagtctcccttacgcatcaccgtaggaacagagttaatggattatgaacatgtgtttgctttataccattgtttgtttcccaggtggcagctggctgccccatcttattgggtagatgtaagtggaattacgaatgggatttatgtttcatgcacgatggtgattattaacttcaactttcaggtaattttcagaccacattgcactaacttggtctctgattgtttttctccttgtttgtttattctgcagccagaactgtgtagatgcgtaccccactttcctcgctgtgctctggtctgcggggctactttgcagccaaggtaactcagacttccctttgttcattctccttctataaagtgcatctcaaggaggttcaaagggcaggctttttgttgaaaggactttgcctgacctctggctcccatctgtgaagccctggagaggtgagagccctcgggaggccgtgtttcaggcatgctctgcacccgtgcagagcgcgtgtgataatgcattgctaatgcttgctccctggtggctggctgagagctgctgtgctgacaagggtggtttaaggctaaatgtgactcagaatccttaagcagtgttagttcagatacaagggcattataaatgagagtgcctgagggatctattttgggaccgctgtcacttggctcttctgctaataagcttccagtgtggtggccctccttcaggcatgtttccactgagccacgggctggatgccacatccccggccttcccacagttatcagcagcccacaggcttgacttgagcaagttggaaagacaaatcaacttccagagttgatttaacattgagtggaaatcagtcatacttttggtcccctttcggggccacgcctggcactgtgcctggtggcagatcggcatgaactggccagcttctgtggccctggagggcacaggcagaaaggccacactcagtcccatgatgaactgtttaagacttattgttgtctccccgctctgtaaagtagatagagtggattttatgtcccttattacctttcaggatactttgactcagggagataaagtaacttgggtacagctactcagctggtgaagaacacaggcagaatgagtgcctgggtcttttgacttaaaattctggatttttcacaaagatcctcttactttattcatttacataataaatatatattgaagagctactctgtgccaagccctgtgcctagatatacagtgataaataaagagtagcttctagaggtcacctggcggtgaggcacaggccagctggcaagatggaccacagaagtcagtgaatgaagacaatgacaagggtgggaagcgccatatgggaagagaaccaagttcagtgatagagagcagaggtgaggcggcagcagaaaccacttaagggacaccacgtggcactccttctgtgctgagaaggctgtcagtaagctcaccatttatttcctattttctctcctgagttaaataggaaacatgtctcgcattacttgaaaaatcaagtcaaactatgctcttactaggagttatggtcctttttatgtcttagatgatgcttgatctagatgaatgcggacttgctgtagctagataaatacaatgggagtttgaaggtgtttcgtagccctggaaatatgtatttcctgtcaaaacaagctttgtcattgccagcagacaaaagcatcagtaaccttggttgataatcgtcatttcttaggaataaagtagactgtagaattttttttagcagaaaggaaacccaaagataattctagtgcaaatccctcactttatagagcagaagctcaagtcccagaggaacaagtggcttgaacgaacatcagaattttaggggctggatttgtaccctcctggtgccagcagcccacttccctgcaggaggcactcaccttccttgcacaggggtatgagtgtggccattttccacccataatctctgttagctcatgttcaattgggttcccattgaaagaaaaatggaccagtaagttggagcagaatcattcagatggtataacataaggaaaaactttgcccaaggcaaatcgtgattgtgacagctttgtgatttttagagaatagcatgggccaggcacagtggctcatgcctgtaatcccagcactttgggaggccgaggcaggcaggtcacttgaggttgggagttcgacaacagcctgaccaacatggagaaaccctgtctctactaaaaatacaaaattagctgggcgtggtggtgcatgcctgtaatgccagctactcgggaggctgaggcaggagaatcacttaaacctgggaggcggaggttgcggtgaaccaagatagcaccattgcactccagcctgggcaacaagagtgaaactccgtctcaaaaagagttcacagtttctcttttgctttgattttcttatctgccggataacaatagtattttggaaggcaggaggaattgtggaaagaaatgggttttggggagtggctgattggaggcaaatccaaggacactcattgctggtgtgtgactccaggcagttactcagcttttccaagcctcagtttccttattgtaaaacaggaccatggtctagctagtagcattcctatggtgagtgaaataatatgtataaagctcctgacacagtgcttggcatatatcagattgagccatgtaaaactgccaatatctggctatttatgacctacaaaaatagcatttcatatgattccacctaacatctgaagcgcaataaatgttattattgataatgcaggtggtggtgataaagttttgaaatcagaaagacctggcttcaaattccacgccttcactggcctgacttattttcattcatttgacaaatattattttgaacacccctatgtgccaggcactatgccaggctcagagatgatctaggaaaaagacagatgtcctcatctgtcttaggctcttgtggcctaagcctaaatttcctcgtctgtcaaatggtgacagtaacacactccttaccagagagctgggaggattggagactcaagttcccaaaacgccaggagcactgcggcaggtgaaaagtattccctcaatggcggaagtgtttaaattgcttttatatctgtagctctagataacactagttccagcttagttaactcccagctccaagccttcaggacttcatagagttattggggtgctgctcttggcagtttcccaaaaagctagaatgcagagggaatctccttcccaaaaagctagaatgcagagggaatctccttcccaaaaggctagaacgcagagggaatctccttcccaaaaggctagaacgcagagggaatctccttcccaaaaggctagaatgcagagggaatgtccttctcttctaaatggtagctgttagttcaagaaaggttaaacattgtgctgtggggaggctcaggggtgaagggtgtacttttaagagaaccagtttcagagctgggtttggggtttaagccctaccctctgcccccttttacgagctgacagccttatgcaagcctggttgaccacctgaacccacgtttccacatctggaaatagaaatgtgggtactagttatgttgaaaggactcaggttagatgatagatatgcaaataccttggaaaccaggagtgtccagtcttttgggttccctgagccacactggaagaagagttgtcttgggccacacatagaatacactaaccctatcaatagctgatgagctaaagaaaaaacgttgcaaaaaaaatctcatatttttaagaaagtttatgaatttgtgttgggctgtattcaaagccatcctgggccacgtgcgacccgcaggctccgggttggacaagtttgttgtaaacaatgccatgatgccggcataaggtcgttaccagtattaggaaggttctcaggtttcctctagcccttgggctcttttcctgaagtgcgtgtgtcttctgctagattttgtgaccaatgttgattgcctaattgggctaacagcatgttttggtggctacgaaactgacacaggtgttttcatttctccacttagttcctgctgcgtttgctggactgatgtacttgtttgtgaggcaaaagtactttgtcggttacctaggagagagaacgcagaggtaggtaactgggactactaaagaactgtggagcgattcctgatttttgagcaggaagagtgacaattcaaaacagtatttgactagattcacggctccgtagcatccccttgggtgggagggggaaggctgactaggacctctgattcttctttccctgagctttgaaggctctgaaaatacagctggggggacttgcccagttttcttattaagcaattcctccgcatggtgctggctttcaaagggtgcttcagtgctgtttgctgcacgtgccttgcagccccacaccctgcactcccgccctgcagagtctggcgctggaatgacattttaggtctgggttcccaggcctcctgagagtgaaatgtttcattgtttgtctagagaaatgagaactaaagcttgcaccttgtgataagttgtcctgaggaacatatctttcagggaccagaagaaagaatgttgggaaaataagatgcagtaagatgcagacatgacagcagggtgcagcggctcacgcctataatcccagcactttgggaggctgaggtgggtggatcacctgaggtcaggagtttgagaccagcctggccaacatggtgaaaccccgtctctactaaaaaatatacaaaacattagccaggcatggtggtgggcgcctgtaatcccagctactccataggctgaggctggagaatcgcttgaacccaggaggcagaggttgcagtgagccgagattgcgccactgcactccagcctgggcaacaaaagcaaaactccatctcaaaaaaaaaaaaaaaaaaaaaaaaaaagatgcagacacgagactgtgaaactgactagcatcaccattgcattgtttatagatgttgccagacagaaagccccaaagcagcacagtaccttcctgacatctggactaggaaatctagattttagtaaaatacatgctaatacttacagaagaaatgtcggcgttagagtatgccgtcagttccttagagattgcaattcctaatgcactagtatggtttcaggtgccaggaacacgttctgtgaggctgctgccccaggtgctgaccccagccttccacaccattttccttccttgtgttcacagccgctctgtcttttacaatagcacccctctctagtggctaatgggctctatgattagatagcatccttcagtagtgataaaggcagtgacatcctagggaggtcagcgggtgaaagcgctatatctggaaaacctgagagcctgtgaagctcaaggacttgacggggttagaccgtgagccgggctgcagctggaaaaagaatgactgttctttcagcagatccttccctgtgccatctctttcttcattcctctctagtggcattcttatttatcctctaaaaccacaattccattatctctcctattcttatcaacactgccctaaatgatattctttattctcttttgccctggaaaacctctatcatgccttttcccatgtgattacctcgttaagagtgggggtggaatgtctagcaatgaaataagagggtcttctcttttgcctggctccctatgcagccctatcttaccccctgcaaagtcccagggatgtggctcagtcactgctcctctcttcatctgtcaccacttgcttgagatcctacagctgctttaattccgagaccatctgcagaacatgacaaaatttgtccacctacccacatgtccttttaactttaaaggctttactaactgattcctattagggaatgaacagaggtggcaaaaataaacaataggagattgatttacaagaaatctttaaaatagtagatttcttcggacctcattgaaatataaatggcctgccttcttgtgtccctccctggtctccctctttaggtgataagaagaagatcctgccagccccataacccgccatctgcgcgggttctagacccccttctcctcccctctggccgtggtaggcattactgatgaatcatggtgctctttcttccagagaccaaacctggcctcggaatccttcttaacacagatactgcttaacacaaccactctgagcagctgtcataagtagaagtaatagatactagaagaaatgtctaagcctaatctagaccaaaatacggcctgatatagatgcaagccagaggggctttatggttaaatgcaaggagattttcaaccctgccgtctagaagctacttgctgagatcttcttcagttgggcccatctcctccccaggcctctcttctgttcctgggctatgtcacacttggactctgcagacacctaatgctcttgggacctgctttagttcttgacctcaccaaccgaggaggaattgctcgatgagatccttcccccggaatttctctcttgaaccccagatggtccgttgcccctttccagaagttgctccagccctgtccgcttaggaagttcagtgtcatccttgatccagtgggtagggaagacattccataatgtatgccccagtctgagcttcttccttcaggcttcaggctgccctgcgaggattttgcagctccctttttaatgccctctagaagtttctggctcttattttcagcccttcatcctactctctctgaccccttcctctatcctgtttagttcacctgtagcagttactacccagcagtgaaggatgaatcttggtttcgtttcttttctcttcttttcttttttctcttctcttttccccttcccttcccttccctcccttcacatcacctcatctcacctcaccttacatagtcttgctctgtcacccaaactggagtgcagtggcctgatcttggctcactgcaacctccacctcttcccaggttcaagtgattcttatacctcagcctcttgagtagctgagactacaggtgtgcactaccacacccagctaattttttgtatttttagtagagatagggtttagctatgttggccaggctggtctcgaactgctgaactcaagcaatctgccatccccggcctcccaaagtactgggagtataggcataagccacccatgatgcccagcctgaatcttggtttcttccccattcatttaagctattacctgggcctgaactcaatggcacctggcaccaactggcaactgactcttggtcttttattacctaccttccctagcaggcactgggttgctccctcttcctatcccatggagtcctgtcctctgttggggctcctactgatcctcttggcaatatgaagttctcagctcaatggtgggtgggcaatgactgccaactcttgaggccaatgaactcaggttaccccactcctcctcctcctgagttgctcactcactcctcattcactcaacattgattcagtagatatttgctacctgctctgtgccaggtaccaggtcagttgctgaaggagtaacagtgaacatgacggagtctttgtccccaaggagacccaaggtgtctcctagagccaggggcacattgcaagaccaaatatattcaacttaccaaaataatcatagacctagttctcaaaaagcaagaagactgattcctcgttgtcatttctcctcctcagcatcaatgttttagagtctgtgggcccctccaagtgtggagtatggtgttacttcaccagagtttgaggagaaacattcttcttttggaaggccggggagcatagatggatatcaaggctgctgtttctaaaagcgaaacccaccaaacaacagtattagaatcatctgtggtgcttattaaagatacagattcctgggccccatcccagacttatgaatcagaatctctgccagaggaagcctgagaatttgcattctcagatgattctgcattctcagataacacattctttaggtgattcttacacacactggagtttgggaatcgctgaaggctgttcacttctcttttctgagaaatgattcattcatttcagaaatatttgcagaggtccttatttattggagatttgtgggtgggcagaggagaaatatcttgtcctcacagagcttacaatttttattttctttagaggtcaccaggcttaaaatgacacttccctaaattctgaaaagaacagatttttaaaacaagaagggactgtaatgttttctgttcctacctcgtattttgttcacattaagaacctggggtgggaagtggaggagggggggtgactggcggggggccacagagagctgagctggggtggtctcgaactcctgaactcaagcaatctgccagcctcagtctcccaaagtgctgggattataggcatgagccacccacgatgcctgggtggaactcagggctctggatgcctgggcgcccccatctcccacactacggcgcctcatcctagaagtggttagcacctttgagatgggaattatttagcaggatgcttttgtgttttcatgtaagttttatgctgcctgtggagggcacagctgtttcaaaactaataaccaaatcctggtctccgaagtctgaaggcatcctttgccctgcagtgcaaagcacgggattctggcctcacacaggcaggtctgaactcctgtgttgcctcttgctggctgtgggacctgaggcaaatcatgcaacctctcttttctgtttgcctagatggaaaataggtttacaatacgcccccataggatggctgtgagaattaaaggaagtcatgggtgtacaatacctggccccgaaagatgcttaataatttaattctgaccttcctcactcatttaggattatgtaccaacttttagaaacaatgaaagattagtgagtcttctgtggttggtataaaaaaaaaatagaaacatgaaagagatgtcctccttgttcaagggctaatgaccctggtgtgcgctgtctaggcccccaaggtcttccttccctgctcacagcatttcaggttctccgcagctttgctgagcctgggtcaggttcggtatctgcccaccatgctcacttgccacagctgtggccccatttccaaacttcagagacttaaaggtgcagctaatgatgtgcccggcctggggtcacattccctgagccctgcagacaagggagcaggaggctgagctcttatcttccacaccctgtgcacagcctgggaagagttaaagcaccctagtcctatgctgcgagggccacatgccctgagaccttggaaaaaatcctacctgaattgaagagcatcactatttcatcaggaggcgctgccatttcatttttcacttcggttttatcttgagtgtaaaacagcttcgcaaatcactttttcttgtttctgtaatgagcatatggtggcctcattcgtgtgataaatctgagccaccacgatatttgacttttcacaatttaatttatctgaaccctctattctctggctaaaaaatatcccttacttggacttctttattttattttcaattcccttaccagcactagcaggggactctgtactcatctgctggcgctgccataacaaagcactgcagcctggggggctcaaaccacagaatttattctctcacagtcctagaggctagaagtccaagatcaaagtgtgggcagggtcggtttctcctgcagcctctctccttggcttatagagtgccaccttctacctgtgtcttcacatcatcacctcactgagcatgtctgtgtccaaatctccccttcttataagaccccagtcatactggatgaggatccacccatatgagttcattttaccttaattatctctttaaacaccctgtctccaaatacagtcccattctgaggaactgagagtaaagattcaacatatgaattttggaagggacctaattcagcccacaacaccctcttttgggatgtttattttcccccttaaggagctagttaggatgtcttatctcatgaacatgactgtgaacaggaaaacagggagagaatgaagctggccaaggaacagggctggtgtcagctagcagtgcttttctgatgtgagtgggtcccacagggagcttgttaaaatgcagattctgattcattaggttccagagggacctgagatttcccatttctgacaagtttccagtgtgggggctgatgctgctggtccacggaccatactttgagtagcaaggagcttgatacataatggctgagtgactttcagactcctgctgtagaaaaattatgagttggctgggcgtggtggctcacgcctgtaatcccagcactttgggaggccgaggtgggcagatcacctgaggtcaggagttcgagaccagcctggccaacatggtgaaacaccatctctaccaaaaatacaaaaattagccaggtgtggtggcaggtgcctgtaatcccagctactcaggaggctgaggcaggagaatcgcttgaacccgggaggcagaggttgcagtgatctgagatcgtgccactgcactccagctgggcaatagagcttgactcagtctcaaaaaaaaaaaagaaaagaaaagaaaaagaaaaattatgagttatattatcagcatatggggtgcctttcaaattgataaaatttctaatattaaacctgtggatgccaaatgctgctctctgattatggcaggaaacggcacttggcagtacgaagttagctgttgggctgagctggctcatcttgttgtgcggtcctgattgcctaaagatgccttcccaggatctttactaacaatcctcctgagtcatttggactttcccaacctgttatcacctctcagatgggccagccatggaggcagtcagaggagggctctgcagagggagggcagaaacagggtggcctctgcatgccattaggaggtcacatctcactgggggatgcagtttaggatttagtgccttggagagaaggatagagtgtattaaaacatgtctccgctaggcatggtggtttacgcctataatcccagcactttgggaggccgaggtgagtggattgcctgagctcaggagttcaagaccagcctggctaacatgacgaaacctcatctctactaaaatacaaaaagttagctgggagtggtggcgtgcgcctgtagttgcagctacttgggaggctgaggcatgagaatcacttaagcccagaagactgaggttgcagtgagccgagattgcaccactgcactccagcttgggctacagagtgagactctatctcaaaaacaaagaaacaaacaacaacaataacaacaaaaaccaagtctctccctccactcaaaaatgcaagggcctgtctcccattgctgggtgcccaggtctcatgaatgtagacatgaattattccagtcagcctcaggagaatagaatgagccctcagatgccgaagcacctttcagattccaccggttttatcggctcatttaaacttcacttctaacacagtcctgcattacacacgtgtctgtcgttatgggcagctgcagagagggtcttaatggtcctaatgctcagtgaggatgcccaatggtcaacagaacctgccatcttcaggccatcaaggagctctggagttaaggaaatcatgagagcacagaggggcgggtacagcagagccctcgtggtaatgggttttgaggtctaggctctcttcgcttgggtttgaaataagttcaatgactagtaatagctgagacacttctacccttcaaatgaagtaaatgggaaaatggagcattgttgagtccagggagctataatttaaaccccatatatctaaaaggggtaacatttttgtgtgtgtgaaattggtgtcattcgcactgcatctacagttttctttttccttctcttccagcacccctggctacatatttgggaaacgcatcatactcttcctgttcctcatgtccgttgctggcatattcaactattacctcatcttctttttcggaagtgactttgaaaactacataaagacgatctccaccaccatctcccctctacttctcattccctaactctctgctgaatatggggttggtgttctcatctaatcaatacctacaagtcatcataattcagctcttgagagcattctgctcttctttagatggctgtaaatctattggccatctgggcttcacagcttgagttaaccttgcttttccgggaacaaaatgatgtcatgtcagctccgccccttgaacatgaccgtggccccaaatttgctattcccatgcattttgtttgtttcttcacttatcctgttctctgaagatgttttgtgaccaggtttgtgttttcttaaaataaaatgcagagacatgttttaagctgatagttgaggggttttgttaatggcttttgggggatttatctctatacccacaaacgactagtttgttttcctcaaactaaatgataatattaaaaatacacatcctggccaggtgtggtggctcatacctgtaatcccagcactttgggaggccgaggcaggtggatcacttgaggtcaggaattaagaccagcctggccaatatggtgaaagcctgtctgtactaaaaatacaaaaattagccaggtatgctggtggatgcttataatcccagctacttgggaggttgaggcaggagaattgcttgaacccgggaggtagaggttgcagtgagccaagatcatgccactgcactccagcttgggcaacagagtgagactccatctcaaattaaaaaaaatacacatctggcttctggaaaaattacttgaagatcttttatgacatccatccctcttcacacagccatgtgaattaggttggtatcttcatatactagcatcgtgcccagcacttccatgttatacagtttaaaaggttctgtaattccctgtgggaacctaagataatgcgaggaccgtcatacgtgcccccaaatattggcaaaccaatgaataaatgaatgaatgagtttatgaatcgctaactggctgtatttaatgaagtatgtgtgttgagccatttcccacagtgtggacagatttgtcccacaatatgggcctcttcccaaaggccctaccacctaatgccatcacactggggatttgatttcaacatgtgaatttggggagagtgcaaacactcagaccatagcaccatctcagtaaatgtcccactggtcactcagttcatagtgacagtgatccagccactgtcatgacaggtgccacttggcagaaacagcacagcttggaagatggcggggtgtagtcaagattccaggatccccaacagagaagccagctcttataggggagccattcatcaggattgaactctcaatcgagctggacagtaataggtgggtctgtgttattccccaggtgagtatcatgacagtcacaatcctaggaaggatgtgaagcctcccccagctctcctccagttgcctgcttgggcagcagagatgatggaatgtggagtctggcgtggtctgaggcctgaatccatgtgcctcatgtatgatgctcaggcaagaggatctctcaattcaagggagagggcctgaatgagccttgctttccaggcctgtctgatggtccaggctgaagcccctcctggcttgcactgccagacctcatccagcaggagctccttggcattgactgcttcaggatagttgcttctgctctgagtgctctctaaagagcagtgctctaccatccaagctgggcttttcttttcttcttgctgatagggaaggcatgggacattgcaggatggaagtggcccccaggccttctcatgcctgggcttggtttggaaggtggtcaggtgatcaataatcctgattggcctggcattgaggagttttcctgggatgtggtcctttcggttttttaaaaattatttttattgatacacatatttgtaggtatttgtggggtgcatgtgatactttattatgtgtgtggattgtgtaatgatgaagtcagggcatttagggtcttcatcaccttgattatcatttctatgtgttgagaac

SEQ ID NO: 15491 - DNA, 86877 bp, Human
tgtaagcaacatttactgagctgctatgtggcaggccctgtgtttattaaaattgtagtttttgctaattgactgttttttgacacatccgtcttgttcatcattgtctacctagcacctagctttaggcttgccacatattatattggcaatgaatatttgttgaacaaacaaatgcatgaaatgtaatgagtaagacaggttttcgctttcaagtaaaacatagtctgggggaagacggaatgtcagaatgtggtgggtgctataggagtaggtgttatcagattctgatgctatggaataataaattgttaaaatatgtaatcttatgtttcagaagctaaagcacagtatgggaactattagaggcttagaaggcctcactacccactagactcagaagttgaatagtgtctgagaaaaaagagaatagaagtaacagtagatgaagagtccagaagtgagaccctttgaggacatgaggacaggtggaaggactgcatctgtgtgttgccaaagagtaacagagactggtataggacttgagttcaattcagtcatatccttaagtattgtgccatcgtgtctggattactttgtagtataagtaaatttccaagcatggggaggaaaggagaagctcctttattgagaattcaactgaatatagagaaaactaattttacacaactgtaatcactgtagtcatttggacaaattagcaaacccaagttttgctttaacttggattgccttaataaagatgttttggggcttaatggcacagttgctcaactcccccactttattccgtgatgttcagacccagccagcatttccccatcaggctcttgcaccatgattgacagggacacttttactagtccccttgaagaatgaatagttactcaatggagattaaccagatatatatttattttactcagaatatcacgataagtataattcagagaattattgccttctaatatactgccctgtgtgggggcgtctttgaaagtccgcaaagtcactgcaattctaataggccactcatgtgacaagacctgctcccacatcggtaatttggcacagctagtatttctccttgccaaaaagggcaaaggccttgagcaagaagccagctttttcctgattacaaaactgaccacaattcctcgccaacctaacagcgtaagtctatttttttctggtggtgtgttattcttctcatagagaactccattttttcattatgacatagcacttatcgtttaaacatcaattgatgttcaaacatcagctggtgtaacattgctgcagttgctattgatggataagctgaagtttttaagaaagcaaacccgatgtataaaattgaaaccatatcaaacccttcttcattctctcagctatttaattttacagaatttagatagcagtcagtatcattttgggcttcacaaatcagtagagtaagtaccttaggaatataacatttcagtagcatgctgataccaacgtttaaactatggatacatatttgaattccaaatttttcttcaaataatgtgattagagattcaaccaggaatagacaccgaaagaaaactttgcccaaataagctttctggtatttcataagcaagagatttaagttttccatttaagaagcaattgtgaattttacaacaataaaaaatgcaagtggatattgaacagtctctgctctgataattctaaatacagtacagttcacgcccctcacaagacactgaacatgtgggtcaccggcgagacagtgtggcaatattttccctgtaatgtaccaagtcttgccaaagcagtgaacattatgacacaactttttgtcacagctggctcctaataggacagtgccagccaattcaagcccagtcctttctgtgtttattcccatctctcccaaatatttggaaactgatgtcttgactcatgggtgtattcacaaattctgttacttcaagtctttttcttttaacggattgatcttttgctagatagagacaaaatatcagtgtgaattacagcaaacccctattccatgctgttatgggtgaaactctgggagattctcctattgacgcagaaagcgattccttcactgatacactgtctgcaaacatatcacaaggtaaagttccttccagatacggctattggggacgtgggggcatttatgtaagggtaaaattgctcttgtagtttgtcttccaggttgtgtttgttttaatactatcatgtgtacactccagtattttaatgcttagctcgttgctatcgcgttcatttaaaaacatgttcagaaccttaaaaaaggaaacctaacctaatctattttatctctgtgcatggctcccatttcctgaattttaagcattaaaggtatagttatatccaaaaacaatcctgttcatttttatttcctgagtttgcatagatttcccaagaatacataagggctttttagacttgaagggtcactttttcctcttttcatctcatatgttagagatctctcataactgtttttatccctcttgcagcacttttattcctcttgaagtactctcagctcttttctgttctattttgaaatctaggtattgtgtgtgcacttcagctctcccaaagaattgtaaattcccagagtgtaggaccaagtggtgctctttattagatttcttaggatacttcctagcatagtgcctaatgcattgcagaatagattgtcggaaccttgaaaaatatctgttccaagcatcacattttatgcataaagaaaatgaggtccctaaaacagtaaatgcctattgcaagtgactacctattaacttctcttcagatgtgtcagaatcagatacctccttttcaatatttctttcttggccattgcaaaatataagttctccatttctatagctccttctactggagtttcttagcacagccttttctgttttgtattgtctcgtattgatgtctatatttctattcattttatttttctcttctcagattctgtgtaaaaatagattgttagctagtgtgattcatgttttataatataagtgctaaagcattaaaattaagtcacttaattgctgaaatggatggctttacattttaaccttttaattttcctggaagcctgaagtttgaacatattagtcaccgtttttaaaatataaagctttttaaaaatgagtaagaaaatgtttcctgaagtactgttttattttattacagtaatttgattcaacatgtatttctatcatctaagcctcttaactaggagttttgttttattccataaattgttgttattctgtttttctgcaagccataaaaattgttgctatctttcttcagttattaatttagcctgcctcagggcagaatgtcctggctatactgtgaaatagttcttgagtcaaaatttgatagttttgtctattttgaaagaacatgtctagaatgcagtgcaacaaatatcaacaaataggttaactgagaggcaagtactgtttgtggtaagggatggttatgtgattcaagttagttttcattctgtgctaatctctaattttatgctttgaatttactctgagtttaatttttttgagtctcaatttcctctaaaagaatgatccagtacttttcttcctaattaacatagtgcagaatgaaattattagcaattaaaacattatattttgtaccaataatttaacccttgtcttatagggtctctggctactacttcttcataagcactgtttctctgttaaaaatgtgagttcctaaaggcccaagacctatgattgttactcctattgcattttgtaaatgacctttaaataattactccacctcttccaaaacagacagacttaaaaataaattagctatatgatcatcattagccgaggccagcagagttgaacactgtggagttgaggtatttggcatgggtacagtagtcctcttaggtgctccttcttcctcatcataggcaaagtgaaattgggggtgttgcaaatggttgggtactgctatttaagaaaaagtggcacatttagtgtgaatgactcagatatccaggtagattggtcatattcatgagattaaaaatctcgactacacttagccactatgcccaaagaggacttccatactttttccaaggctccatcattgctgtgacccctttatattattcccctttctctttttatcaagagctcctcaagcaaccccaagtaacctcatgctggctctgaaaccatttccactagtaaaaattggcaagattgaagggaagcttccacaagctcaagctgaatatgcctcctgcttttagtgccagacttagtcctgtgtgaattctacaattttaagtcgttgcaccagagccttgaaagatgatgacacacttgtcctttggagctgattgagcaatggaaatatgccttagagacatgataaatgctgcaatagacaatccttcaaaacgagtctctcctgagataggagtgagtgattgattgcatgccatttttattgagggatacttaatctgtggttacatatctccaggcaactgtatattcagaaacatttagataactgaccaaagttttcacctttccagaagtttaaagggacccatgtagtaccagggaatataaggaccagtcctttgttggccacatatttgctgtgtgaatttaagcacgccatttttcttctctggccttctgtttccacatatattaacagaatacacaggattaatgggaggattaaatgacacaatacttgtgcaagtagatctaaagccctatatggaatttattgctttagccttgtagcgttaatcacttgtggctagaatagaaggctccgtttaaaaaaagaaaaggctgggtacagtggctcacatctgtaatcccacaactttgggaggccgaggcgggcagatcacgaggtcaggaggtcaagaggtcaagaccatcctggctaacacgatgaaaccctgtctctactaaaaatacaaaaaattagccaggcgtggtggtgggcgcctgtagtcccagctactcaggaggctgaggtaggagaatggcgtgaacccaggaggcagaggttgcagtgaggctgagattgcgccactgcactccagcctgggcgacagagcgagactccatctcaaaaaaaaaaaaaaaaagaaaagaaacctacattttaaacactttatggatatggaaaaacaaaaaccgcagaactctttattgcacaagagtaagtggcagttatatgaatgaagcggggcatccgcatgatctcctgtgagtgttttgagaagatgatcaaacttagagaaagcatctttgtgtctaatttttttaaatgatgaaattatttcccactttcattaatattttcctgtgaagaaattgaagttattctttgggcctcaataaaagggacaattacatgttttcttctcagagcattgagaaacttggattataatgtttttcgtacactgaagtagaagtccagaaaagatttgagttattgacacagatcttcttttttttttgagacagagcctcactctgtcacccaggctagagtgcagaggcctgatatcatatttcaccacagcctcaacctccctgggcttcggtgatcctcccacctcagcctcactagtagctgggactacaggcgtaccttaccacacccagcaaatttttgtaatttttatagagacaggatttcaccatgttgtccaagctggtcttgaactcctgggctcaaggaattctcccgcctcgacctcccaaagtgctgggattacaggcgtgagccatcgcagcctgcccctgaattccataatttcacgtgtaattagaattcaagacctttttcttgaatattactcttgtccatattaatttttttctgagtatggctctagctttatcatttttttctgacttaactctgattaacctcttttttcatcaccagtacttggcagattttgtagatttctaaactctgaaaatcactgtttttctgaaaactgtcatttgtctcatactttcctccaaaattatgaattataggaaacaccccaaagaagtatcatttacattagctgtttacaagaaaatacagggtttcatttttaattttattttcccctactatctctaaggaatacaacttgtcttgaaagctccctgacagcagctatccatttaatctgccaattgcagtataaaaattggttattaaatgaaaaacaattgtatacctctcacagaggttgtcatatattactatttttgtcagcattctcacttataactctgttaggataatcctgggaaaatttctaaaatcttcatagctctttcgttaggtacatattccttgagacagaggaaatctgagcaaagtaaatttcttcattatcttagatcaacaaaagtgatacagagcttctgtcctgttagctccctttggacgcttaaaataggcactagaggttgtccagtaaatgcttcatatccatctactagtgctgaatatttgtgaaaatataggtgataatgaattagactcgtttgaatggaattaagtttctgtaaagttttaccagattgtcttttttttgttttttgttttttgttttggtaaaagcagttttgcacctgtaactaatttaaagacgaagaaattgcacatgtaactgatagcaactgccatccaactcttataacctcagaatcaagatcacgtggctatttgagtacacagtgttttaaaccgtgtaatttttatttgagcaagggattgccaacacaagatcgaggttcccacaagtggtgaatggcacttgtggttaacactgtaaagcagatttaaaacagtcaactgtcaattgcctacaagggaattattcctcatcacctcatgccaggtttttatatggccttttagctgaccttctaaatgagaaactttgccatccagtgcaaactgccaatagtcctaaaatgcctatctttattatcagtctaataatatttattgagtgccgattttcaaggcaccatagtgaatgctgtgaaatctagacactttttccctggctttcaaagctctttataatccaggcatattttatatattttaccttatttctcaccacattccaggcattggcctgtcttgctctgttcacactaatctctttgtcccaagagtaaggccgacccacccttgctccaagcctagtatgtcttgaaatgcctttcctaattcttccatcttttcaaatcgtccctgtccttcaaggtcagcttcaagtaacctctactccgtgaagcattctctgaattcattgctgttcattgctccctctctcctctaaactgaaaatgtgttcagaatatctctcttctgccgcttccactgccttcagcccagtccaggacaccgtctgtgcctggctgctagtctcttgatggggttttcagcttccatcctaacctcacaacagcctagtctcaaccggtcacccacagagatgatgctcaaatgtgagtcagatccgtcactccacccatagccctgcagtggttccccatttcacttgtaacaaaagtccaagtctggcccctacctcctgccctaccccagctgacccctctggtcttctctctctcttccacccactctgctccaagcacgccggcctccttgctgttccttccacattccagatgctctcctgccttcgtgcacctgccccagctcttgttcctgtccaggaccctcttcctctggcattctctgggccacctctgtcaattccctataatcttggctcaaatcttaccttagagtgagggtgaccttggccttccctatcctaggacaggggaattacatatcctccccattgcccttcctcctctactctacaatttcctatttaaaaagcatttatcgtcttctaacatgccatgtaatttattggtggattctatgtattgcttactgtctgcttcacctccctggaatgttaaccgcatgaaggcagagatctttgtctagtttgttcacccactgatgtattccaaatacctgaatagtattgctcattaatacttgctaaatgaaagaatagaatcctctaacacttacggcttctatcacacaatttagccctgagttcaaactgtctggtattatttcctgttttatgtattccctaagccaaatcatatagtcactgaagaaaagatccatgttttattctatattccacaaatgccaaacacataataagtataatcaggtcttgttgacttattaataccaagctgatctcctaaggtcagagactggaatatatttagcaaataaatacaaaattttagtgtatgttaaatattattctaaaaccaatgctaatataaacaaaccaagtactggatatgctacaaaccaggcacaaatatgttttgaattatctgttagttaatttgcaccgtgtccctccattagtttgagtagcattcattgaatatcatttgaatattaatttaaacatcatttgtttgtgagttacccaaatccctggcttcttctgcaaatctacccaccttttgatacttccattatttatttgaacatccaaaacacttatttgctagcaatgtttaaaaaagagtagcttatttaattagctaatatctaatatatgaagcacttaaagtattaattgcctgatatgtaataggtgccaaacacgtcagttctgtcttcttctcatctttaaaatggaagttaatacagacataatgtctccccttgggtcttttaagtcagatctttaggaaaaagtaaaatattctcattattcttattattttgcttgcattagcaataaagtatgcctgatttaagttcactggacattatcttactattatctatactttacctaaagccctgcctttagttttgtaaataaaattatagacctattagatagattgagcaagtttgcttagtggattaaaatatgatgctaataagagccaaagtgagtttgataatgggttggccagatttacacagaagtctttgccatttacaaagagttctgtttgccattgatacagtcacatttctagccacaattacccaagatatgtaaacagttaactcaggagaaaccaactcaattttcaggtatatgccatatacaaaatctcatcacctttgctattatatacacttagtattatttcttaagcaatatcatgtaatataaggggcacgttgatgacagggacatgtacctttttcttgggatttcaatatgaatgaccatccaaatcttgatcatcccaatggctccacataatttggacaccatgtctaccagaaagctatccctgattatttcaggacatgttagtatctttcttttccacatttctaaagtacttactatctctatcacgagtctggtctctgtacttccttctgctactaaacatctctcaccttggtaagcttctcaagaaccacaatactatgtgtttcttgtaaggcctgaaaaacaccttgcacgtagtattaggtgattagctatcttgatttaaggttttagattactgattgaacatttactgagctgaagatatagagaaagaaaaatgccaaagaaaataaaatgaggaagtttggaaaagagaaacacactagtaaaatatgatggtaacttctaagaagcaaggtttataaaatagattgttgatacaaagaaaacattataaaaaaatgggtagcttgaatggatttaacccccaactttatttaatttaaatggaatgcctcaaaagactactcagctgatccaaacatagtaacttcccaaacacaagactcttgacgtaggcctcagaatttggggaaaaaaattcctgcattgtttaaaaatacagtgtccttgtaaagcagaataggccttatatacaagccaaatatatcagttctaaagcaaaaacaaaacttttcctacttactcttttatttcttttttttttttttttttgagacagagtctcactctgtcacccaggctgaagtgcagtggcgccgtctcagctcactgcaacctctgccccctgggttcacacaatcctcctgcctcagcctcccgagtaactgggattagaggcacccaccaccacgcctggctaattttgtatttttagtagagacggggtttcaccatgttggcagggtggtctcaaactcctgatctcaagtgatccgactgcctgcacttttcaaagtgctggattgcagatgtgagccactatgcccagcctgcttcactcttttagataaaatgtacaccctttgaatttttacttccgccatttacactgatttgaagtccttggttgaatatgtatttagccttcactgtgcaaggaagctggttacaaaaacagatagtttattaaaatacttgtgttggtttttaaaaaagaataattttaatacagtttttctcttctttctttttgctctttttgttattttttaatagagacacggtctggctatgttgttcagactggtttcgaactctggcctcaagtggtcctcccatcttggcttcccaaagtgctgggattacagatgtgagccaccatggctggccttaatactgttttatgagttctgaattgaataatttttaagtgaatgtcctaaaattctatgacaatccttttaacacaactggaagagtttttgttggcttacttggtttgtctgcatgtttccttctgtcatcccccactcctaggacccatatggaacattctctcttaattaactcttttattgaagtataatatacttagaggaaaaatgtccaaatcattttcacaagtgaacatacttgcgaaattagcacccagacaaaaaaaaaaaaaaacagaacaataccagcactccagaagccctctgactattctaatttctaactcattgttaagttttgcccagttttgaattttatataaataaaattacacattgtttactcttttgtgtctggattcttttgcttagcatttattcgtgagattaatcacactattgaatgtaattgtacttcattctcattactgtatagtgtttcattgtataaatatatcacaacatatttatcctactgttgatgggcattcagatggttttcagtattgcaaatagtactgctatgaacattgtcctgtaggtctcttagtgaaggagcgtatgcatttctggtagctatatgcttcagccaataatagagtatgttgagcttcaggagatgttgccaacagttctgaacaggactctagaaatctatacttctactagaagtgcatgagtgttctagctcttctacaccatcactggtacttggcattctctgtctttttcacgttagccattctggtgggtgtgttggtatcatattctaattttaatctccccttttctgatgtctaaaaagttaaacactttaaaaagcgtttgttgtccatttggctatcctttcttgtaaagtacctgttcaagtctttcacccatttttatattgagtactttaggtaaacgttctaaagcataccttgtcagatacatgtattgtaaatatctcctcttactctgtgtgctttttcgtttacttaataaacagatatttctaatcaatatagtctgatatactagatttttcttttacagtaagtgctttttatatcctttggaagaaagctttgcctactccaaggttgataaagtgtgtttttattttaaaagttttctggttttatatttcacatttagatccataatccacacagaattgacttttgtgtatgttgtaaggcaagggtttatctctttcatggggatatccagttgacctgcttcgtttattgaaaagatcatcctttgcccactccccagcattgacatttctgtcataaaccaggtgaccatataggtctgggatttattctggacttactcttctattgcattgtatttttgcaccaattaagattgccttaagtactgtaactttataaatagtttgatatctggtagtataaatcctccagcgttgctcttccccttcaagatttccttgccacttggcctcttgaatttccttataaattttagactcagcatatcaattaccacacaaaagtgccgagattttgattggaattgttctgaatctatagataaattgggagataattgaaagctttacaatattgagtccttcaatccatgaacatgaactatcctttcacttatttattctttaatttttttaaatagtatatttgagttttcattatggagatcttacacatattttgttagattttttcccctgggtatttgattgttttaatgctgttgcaaaaataatttttaaatttcattttctacttgttgctggcttatagaaatataattggtttttgaatattgaccttgtacccagcaactttgctaaattattttattaactataatgagtttttttgtggatttttaaaaacacagtctgcctaacatggtggctcatgcctgtaatcccagaactttgggaggctgaggtgggtggatcactttgagctcaggagttcgagaccagcctggccaacatagtgaaaccctgtctctactaaaaatacgaaaaattagccaggcatggtggcatgcccctgtaatcccagctacttgggaggctgaggcaggagaattgccctaatgccagaggtggacgttggagtgagctaagataatgccactgtactccagcctgggcaacagagtgagacttcgtctcaaaaataaataaataaataaataaataaataaataaaacgaacaacaacaacaaaatacagtcatgtcatctgtaagtaatgttagttttagttttatttcttcttttccaattattctttgtctttttcctttgttgcattggatggatttccagtacagtggtgagtagaagtaatgatagtatcattaccttgttgctgatctcaagaggaaggctttaaatatttcaccatcaggtatgatggctactctaggatttttgtttgtttatttgtttgttttttatagattttctttagcagactaatgaagttccctttccttcctaagaggttttttatttaaaaaaaaaattatgagtgaatgttgaattatatcaaatgctttcatagtttgttgtggtggtggttgtttttgagacagggtctcactttgtctccaagctggatcatggcgcattgcagcctcaacctcctgggctcaagtgatcctcccacctcagcctcttccagtagctgggaccacagcacatcaccacacccagctaatttttaaaaaattgttatagagacagggtctcactgtgttgtctaggctggtcttgaactcttaggctcaagtaatcctcccaccttggcctcccaaagtgctgggattacaggtgtgagccactgtatctagcctagaatattttttatagtgctcaggagaaagattaaaagtatgaaaagtgtctactatgtatactttaatatcatattgtaatacatttgaagatactatatggtataactaatgaaaatcttcaaatcagctcataaccactagagatctggctgtatctgttttgacacttttgttctcagtatctgtttagcttaagacccttgtcttctcattaagagtgcttgacacagtaagttgaaaacataatttcaaaagagcatagagtgtcacatggtttgccagactaaacaactctgagtaagaaagtggctttccccctatggtaatgccaagctactagaggaccttcagtggtaaagtatgatttaaaaccctgaccccatctgtcttttcccatttgcagtaagtcctttatagtgtttgaaggtgggcacagcagggaaacagtactctggcagatctgcggtggctccctcctttctgagtcattacacactcttctggatcattcctttcatttttccttttcctctcctctcccctattttcattcccctatcactgcaaagccaaaaccaaaacgtggaaggggacctagccgaggaaaacattccagcttcttttttctgatctaaacaccgttcttcttcttttttattttttaattaataactttatttttagggcagttttagtttcagagcagaattgagtaggaagtacaaagagttcccatatacttcctgtcccccaccacgcacaatctcccccactatcaacatcctgcacccaagtggtacacttgttacagtcaataaacccccactgacacatcattatcactcaaagtccatagtctacattaagattcactcttcgtgttatattctctgggtttgtacaaatgtataaggacacatatccaccattgtagtgtcatacagaatattttcactgacctaaaaatcctctgggatccacctgttcattccgttctcccccaaacttctgactaccactgatctttttcctgttttgatagttttgcgcttcccagaatatcatatagttggaaccatacagtatgtggccttttcagtttgacttctttcacttaccaatatgcacttaaggttcttccatgtctttccatggcttgatagctcatttctttgcagaactgagtaatatttcattgtttggatgagccatagtttatccactcagctactgaagggtgtcttggtgcttccaagttttggcaattatgaatagagatgctataaacacctgtgtgtgggttttttgtggacttaagttttcaattgatttgtgtacctaccaaggagtgtgattactggattgtatggtaagaatatgtttagttttataagaaatggccacactgtcttccaaagtggctgtaccattcatcagcaacgaatgagagtttctgttgctccacatcctcatcagcatttggtggtgttagtgttttagattttagccattctatttgtagtggtatcttcttgttttagtttgcagtgctctcgtgacatatgatgttgaagatcttttcacatgttcacatgccatctatatatcttcttggatgaagtgtctattcagatattttgctcatttttaaaacagggttattcactttcttattattgagttttaagcgttctttgtatattttggataacagtcctttatcacagtagtccctgacctttttggcaccagggaccagtttcatggaagacagtttttccatggactggggtgggcaggaatggtttcaggtgaaactggtccacctcagatcatcaggtattagattctcatacggagtgtgcaacctagatcccttgcgtgcacagttcacaatagggtttgtggtcctatgagaatctaatgcagccactgatctgacaggaggtggagctcaggctataatgcttgcccatcagcagttcacctgctgtgcagcctgattcctcccaggccatggactggtactggtctggacctggaggttgggaacccctgctttatcagatgtgttttgtacagatacattctccccatctgtggcttgtttactcattctcttgacactgttttgcacagagcagactttttttattttaatgaagtccagataatcagttatttcatggttcatgtctctggtggtgtatctaaaaagtcctatccgtgctcaaggtcatctaggttttctcctatattgtcttcagggagttttatagttttgtactttacatttagatctatgttccattttgagttaatttttatgaagagaataagctctgtgtctaaattattattattattattgttattattatatttttttgcatgtggatgtccagttgctccagtcccagttgttgaaaagactgtctttgctccagtgtattaccctggtttcttcatcaaagatcagctgactacatttatgtggtcctatttctgggctctgtattctgttcctttgatctatttgtctattcttttgccagtaccgtactatcttaattactttaactttctagtaaggcttgaagtcaggtaatgtcagtccttcgactttattcttcttctttaatattgagttggctattacgggtcttttgcttctccatataaactgcagaaccagtttgccaatatccacaaaataacttgctgggattgttattgtgattgcattgaatctatagatcaagttgggatgaatgacatcttgacaatactgagtcttcctatccatgagcatgcagtgtctctccatttatttcattctttgatatctttcatcagagttttgtagttttcctatataggtttcatatatattttattaaatttatacttaagtattttacttttcggggtgctaatgtaaaacaaaacagacattatgaggaaaatgtaatgtctgtttgggggtaatgtgtttttaatattaaatttcgcttgttcattgctggtatataggaaagcattatgacttttgtatattaaccttgtatcctgcaaccttgctataatcacttactaggtccaggagattttttttttttctgttcttttggatttttttatgtagaagtcatgtcatttgcaaacaaagacagttttatttttaccttcccaatctgtatcccttttatttccttttcttgtcttgttacgttagctaagacttctagtatgatgttgaaaagcagtagtgagagaagatatccttgccttattcctaatcttagtgggaaagcttgagtttctcaccattacttatgatgttaactatatgttttgtttgtagatgttcctaagtttaggaagttttcttattttgtcaaattctttttctgcatttattgatatgatcatgtgatttttcttctttaggctatgggtgtgatggattacattaatttgttttctaatgttgaaccaaccccacataccttagctaaatctcacttggccatggtgtataattcttttcatacgttatcggattcaatttgctgatattttgttaaagatttctgcatgtctgtccatgagagattggtctatagggtttattttccttgtaatgtctgttttgttttagtattagggtaattctagcctcattgaatgagttaggaagtattccctctgcttttatattctgaaagagatttcagagaattggtataatttcttccttaaatgtttggtagaattcaccagtgaacccagtccggtgccttctgtttcagaaggttattagttattgattcaatttcattaataaatgtaggcctattccatttctctatttcatcttgtatgagttttggaaaattatgtctttcaaggaatgagttcatttcacctagattatcaaatttgtgagcatagagcctattatcctttaatgtcaatgagatctgtaatgatacccctctttcatttctgaataactttcattcattcttcacgtactagacaaagtagaatttcaactaaaccaaagcaactgttcaacagatttagccttagtcctaatcagattattagtaatatctccctttagaaatatatgaaggtacttttagcagaggaaccaagcttgagctagtttgaccataatgaatttttgctgaggaagcagaagaaatgtttatattggtgagggcataatcctgtaatcttttctgtgtcctgatacctcaggaccagcgtaagcaaactccctagacaagatgtggctcatgcaagaggaaatatgcttttgaaaatgaacatgggccaagcatagtgactcatgcctgtaatcccaacactttgggaggctgaggcgggaggattgcttgagtccgggagtttgagaatagcctgggcaacataatgataccttgcctctacaaaaaaaaaaataaaaataaaaaaataaaaataaaaaaattagatgaatgtggtggtgaatgcctgtggtcccagctacttggaaggctgaagtggaaggatcacttcagcacagggaggtcgaggcttcagtgaaccataattgtgccactgcactccagcctgcatgacagagtgagaccctgcctcaaaaaataatagtaaaattaaataaaatataataaaaaacatggtctttctaataccctttgttgatctgaatttgaaaatttcctgtgagaccttctggcttattataaagaaatttgcatctaaagatacatattggaatgtttcaatctcaaagctatcaatgggaaatcaaacttcagaaacattgaatttggttttgaatatagtctaagtagacaataaaatgaaaatacatttgtttatattgaagaagcaaatgacacaccaaatagttaatttctaatagttttcatttttttctttttctttttttttttttttttgagacagtgtcttgttctgttgcccaggctggagtgcactggcatgaactcggctcactgcaacctccatctcccgagttcaagtgattctcctgcctcagtctcccaagtagctgggactacaggcctgcgccaccacgcccggctaatttttgtatttttggtagagacagggtttcaccatgtaggccaggctggtctcgaactcctgacctcaggtgatcctcccaccttgtcttcccaaagtgctgggattacaaacgtgagccaccacgcccagcctctaatcattttcttaattcatggtgcccaaaataaaagattctatattcagagaaaccatgacagaatttaaactctagccccaatacctatttaacattgggcaagtcacttaacctttttatgtctaatatttttaatctgttaggtggtaataatacttgtgtataacaacataggactgtttacaacaagcacttaataattgttagctattgttactaaattgtatttctgctgatgggttccagagtcttttcctccttcactaaacaaaactcaggatactatgtgaaggaaaagaagtgagttggtagaatttattttttaaatgcttgagtcaaaaggagagccatttgtggctgaagcatcaaaaccattttctgattttctttcattctacttgaaactacattaaaattttctccaattttccagatgattgcatgataattccttttaagaggactttaacacatgtaagaaatagagttactccctctgttaggagaaatcatggaaagatattataattaaaagatagtgaattttagcttaatttttacctttatctaaataacactcgtacacagctacagctttcagtgaagaagagatactcattcccacagctaaatcccgctcctcataggcagtgattttacctctttcacatatttcttctggcatttaccttcctatctctagaataacatacttacattaatggccaggcatagtgactcacgcctgtaatcccaacactttggtaggtcaagatgggcacatcgcttgagcccaggagtttgagatcagcctgggcaacatggtgaaacctcatcagtacagaaaatacaaaaattagccagcagtggtggtgcatgcctgtggtcccagctacttgggaggctgaagttggaggatttctcgagcccgggagtttgaggctacagtgagctgtgattgcgttacagcacgacagcctgggccacagagagagaccttgtctcaaaaataattataataataataacttatactattatttttaaaattgtattcttatccattgacttcttactgtgggagataataatttagtccttttactaccatattcccttttccaaaacacatacttctccctcccctccatcttcacaatgtagttacttgtaatttggggttaaatcagttgtctgtgcttacattgtagtaactgaaagtgctgcttaaggttgagccaagcagtgtgctatgattctgtttcctctcctgcttagctatttacttttctggagttaatttttgtcacttagtcattgctcattttgttgtcatttcttgctatgtactcatcactaattcatcctcaaactctctgacagagtaataaaaactcctctgaaagtggtcagacatatcgggcattctggtttctcaggtgatcccacctggccttcttcctcctgcattttctctaggctgctctgtatctgtagcctgggactaccttccacctctctcctgtctttcagatcctttgtttcctggtcccatcttttctcttcttggttctggtggagaactctgggaaagagtacgtgggaggtaacttttctggatgccttatcattctgaaaatgtctttactctcatacttgatggacgatttggatgagtctaaaattctaggttggaaatttttttttctcttgaattttggcaacattgttctattgattttctagcttccagtgttactgttgagaagttcagtgtcattctgattcctgatcctttctatggtactttttttttttcctgtcaggaagtacttatgatcatctctatagaaggggtattaatcttgacagtgttcctttctgtgtggtttaagaaatcctttctctcttgggttttgttactgttttataaatccttgatcttagtcattctaaggttaaagaaaaactgaggaacaactcaggaatacgtttcaagtacatgtgataaaaggcaaatatgcagaggatgataactatatgtttaaaaaatgggaaaaaagagatagtcgcaaacttcaacataggttagatcatcatttctcaaaccatattccatcacatattaaactcctcaaatattgcacactgtgcttttttctctcttttgtgtattctcgtgaacattagcctgttagtttaagaagtctcacagtaaacctatttaaccttgcttaacctagcattgcctaaatttacttgatcaccagattttttttgttttgtttttaattatttttaaaggaacattattaacatatgtataacacagttggggaaatgccagataagacatagactttcctggctgctaaagagcaattaagcattggaatgagtaaccaagaggagctgtggactctccttttccagaggcctttaaaacaggacatctgttttaggcgtagtcctgtttaaacaatagggctttgctggcggttcttcctcttcctgtcccctagtggtagtgttggaggcttttagcccaccttttatatgactgtagtactctggtgactaatgtgtacacaaattactgttatactattaatattaattatatttattgagaacttattaagtatccagccctatggtaagtgctctacatacattatctaatttaatcctcacaacaactctaggagggagacaatattaatattctacagatggagattagatatgaagagatacgaacttccagcaatagggttggattggaacctcgggcatctgacatggagctgtgcccatccttcttcaccgttaatgttcaaaacagcaaacggcacaaagcaagcaaacaacatttgtatatctgtacttactatgtaaaaacaaaccaagataatgcttactttattagactattcaagactattccctacgccttttgattaattcagagttcatgacttttgttagaaacaaattctgttacagatttagttcttcgcattttattctgtgataatttgccatccaggaaatggttccttacatgagactttttccctcataaatttgatgacattcatatacattcactaaagacccccaaaaaataaatctggatctgtgaaaagtggcaaaggttaaaagtcccattttcagcatatttacatgtagtaacaacttgataacacagcgctgagaatgccaggctcagaggagccaagctgggctcccgtccagtcagcctctagctcaccaggaaaccctgagcaggtcactttgcctcattttctttatctgtcaaatgagaactcagatgatctcaaaacagccttttctgctgtagtgtttcaggatgattcttgtctctggatgtcgctgtcatgatgggagaggaattagtaaattcccaggtcagtttacactgcagagtgatcttgatctgcatgaatcagtaaggatgggctggataaacaagttggaaccacagttatgagtaccatgacattaactgaaacaaatgagaagggattgaaaaatcggcggttaagtgtcttttaaggtcatttccaacaaaactacaaaggacctatgaaaggcttttcaggcacgtactcttgttgcctagctgaacacatttctccaataaagctttcatttgagagttactcttcatagtacatcccctgcccccctgcctgcctggcacattataggtattcatgaagatttgttggaactgttaaataattgtttaatatagaactggaagatcaggaagaaataatgtttttctaaccagtatccagtgtaaagtcacaagtgtgggctatggagcttcagaccatctggattcaatgccagttctactgcttagttactgcgtacttttaggcaagttacttacttccaggtccatgcctcagttttcccatctttaaagtaaattataaatgcacctacttcctcgggctggttgtgaggattaaatgacacaatccgggcacaatatttggcgtagtactttgcacagatttagtgtcctgttagtattagctaatgtaaatatgaagaagatgtaacattttaccagctattctaatcatagcttttcttttcttttcgtaagggacaacataaaaccccaaaggtaaagcatatatttctggtgttcaattttacaatttagcatcttttccaacccacttccatactcccaaataataatgcctatcagattaaagaagttactttatttttgcatgaaattggttgtatttttgttgcactacttcatcctttgagtattgtgaaaagtctgcgcattgactataatagcatttaaagccaagtttgaaggtctaagataatggcacacatccatgtcctttgctcacaagttctgcctaaagactttagcctgcttgaaacactctaaaggttgtgaaattaatggatataccactgatgcaacacaactcagtgtcaccagctagggagttaagacatgttcttgttactgagaagggctgttgttcatgcaaatattttgttcatttgttctttcatgggtaattgcacggagtaacaaaaaacacctcctcaacttacagcttggcagaaacagtagcttatgttttctagagacaaaattagaagcaggctttctggacccatctctaagtcaaaataaaataaaatgtctagggaaccactgtgcctcccagtaactatggtccatggaataatattgtttaggtcaaggtgtcccagagtaaaagggaagggagaagggcaggggggaaggggaaaagtgtgtttgggcaatgttttcatagagatgaagaggcaagctgtttttctttcttactttgtcctttcaacttagaaaaataagaaaaccatctaggaccacaaccttcctcttgtaatcagcaaaagagaaaaaactgaatatacatcgttaaggggaatggttatggcttaagttgtattttattgataatgttgaagattaacattttttggagagaacttaagtcttaacaaaactaaactattgagaaagtattgttatttttccatctttagtagcaaaatgaaaatttactctactcttctgcataaaatatgatcatcaattggcaagaatttggttaaaaaaaaaaactgtgcatagaatatgcacatgggaagatagaataataagatgctgtccttttactccagactggaagtctaatggtggagatagttatccagataattatatctgagttaaaggaggaggtacaaagtgctgtgggaacacagagaatggagtgtttttaagttggaggattcatagatggttttacagagaaagtagcatttggactgggttttgaaagacaaacaggcttgtggcatgaagaggtgaggagtaggaagaagatacagcagcctcagtaacctgtatgactaaaagaggcagggcatgtttaacctgggcagatagtatgatatgcccagccaccagatatgccaagaatgggagcgaggtctgggataaccagtggaaataagactgaaaaagtaagttagggctgagacatagagggccttgaatgccaagctaaaaggccagtgtttctcctgcttttccaccagtatgcccttactagtagaggacagcaaaaccataccattcttgggtggaggaagggaggaatgaataggtggagtatggggtatgtttggggcagtgaaactattctgtgtgatcctctaatgaatgcatgatattatgtctttgtcaaaacccatagaacttggctgggcatggtggctcacacctgtaatcccagcactttgggaggcagaggcaggtagatccattgaggtcaggagttcaagaccagcctggccaacatagtgaaaccccttctctactaaaaatacaaaaattagcagggcatggtggcacacgcctgtaatcccagctactcaggaggctggggcaggagaatcatatgaacctgggaggtggaggttgcagtgagccaagatcgtgccactgcattccagcctgggtgacagagcgagactccaccaaaaacaaaaacaaaacaaaacaaaaatgtagaactatgcaacagaaagagcaaaccttgatgtaaatcatggactttaggtggtaataatgtgtcaatattggttcatcagttatagcaggtatactacactgtgcaaggtgttagtaataggggaaaaccatgctttgtagagaggggacaggaggctggggaagggctattttaagagctctgtactttctgctcaatttttatgtaaccctaaaactgctctcacaaaagtaaaggctactatgaaaagcaaaacaaaacgaaaacagaaaacagcatccttttagccatgagatgtactacaagtacagagttttctaggaatttcatataatatttttaaaaattacatgaacttttccttctttccttaacacatagatggctattttcacattaaaaattttcccaaaatttccacaatgtaatacacgacccctagggatatgacttttgtaataagaagcatgactttggctgggcacagtggctcacgcctatattcccggaagtttgggaggctgagccaggaggaccacttgaacgcaggagtttgagaccagcctgggcaacacagtgagatgctgtctctttaaaagtgaggttggggaggtgggagagagagagagagagagagagaggaaagaaagcagcatggctgtgattgataggaagtcactgaaattgtatgttaaaaatgaaacaaagcaaaattaaaccagtaaaatcatgagcaaccaatttctctcccaccccagatatttgtgcatccttattttcatttcccagtattcatacaaaagcatatccactacctttaactcactttgtcagcctttattctgtatgcagaaaactttgcaatagcatagtgagaaataggtgataaacccacctttgtggatattacagtgtagacaagggaaatatactttaatatgaaaataagttatactaagaaaagtagatacagaaatgaaaattaagcctgccaaggagacagacaaagtaaatggaatgacctgggttagacaggtttggacgaattttgaaacaaaggacacagttggatgggtgccctgtccttaggagcacagacttttttctggatgtcattgagacctagaatgacctttaactatcaccagtacacattcccctttttggtgtgcagtgttgacactgaaacacagataacttaaggttgtttgggtacttatttatgtagatagacatgtgaacccatacggtacctaattagtcctcttgaaaccacaaacgcgcattcacaggaccagtcttgtttatattttcaaggctttttttttttttcttttgagttggagtttcactcttgttgcccaggctggagtgcagtggcgtgatctcagctcaccgcaacctctctctcctgggttcaagtgattctcctgcctcagcttcccgagtagctgggatcacaggcatgcaccaccatgaccagctaattttgtatttttagcagagatggggtttctccatgttgatcaggctggtctcgaactcctgacctcaggtgatccaccctctttggcctcccaaagtgctggaattacaggtgtgagccaccgcacccggcctcagggcattttttcttatgaagatgacagccgaaatcttcaatcttcaactcatgcaaaagtttgcctttggagtgaatttcttggcaatctgcttggtaagaaaaagcaagtggtgttaaagtgagagcattaaaataaaattgctccaaaaaaatgataaataaataaaagaaaagaaaaaggaaaagcaagaggcccatgcacagatacacagaggagagtggcccctcctccataagcctgtttcatcaatgagagaatcaagagagtatgtatatacagaagagagtttcagggtcagtcttgagtttgcatcttctacttcctagctagaggaccttgaacaattcactttacttctttggtcctagcttgcttatctataaagtgggaataatatttcagattatgcagaagaaaaggtaggatgtaccgggcacatgggaagtgcttgatcaataccaatttgcttccctccttccctgccccttctgctgaaacttcacagctatctcattaagtcatcaatgtatttagtatttaataaataaatatttaacgagcacctactatgagacaagccctttgttagccagtggggatatgactgcaaacaagaaagatacgcctatgatttgatgaatcctggagtttatgagcagctcatctctgtctcccgtgtgagcagtcctaaatttacacagctctccactggtgtttttgaccacagagttaacatttaaaatacctatgactgcttttttggcaccactttgaataatgaactggtgtcaggtaaacagagtccaggtacctattgcagaaagttttccagtctgcaccctcggtggctcacaagtttacatgaagtgaaccaaaagagttttgttgcacttactgtgacaataaatcatgtttagaaaaatgcatgtggcatacatgatattgggcaaatgattcatgaaacttgctattctgtggccttagaatccatgtaagcatttttcctttgtcttttatgtgttttcttgtttctatctctgttttgttttgtttttgttttggggatggtttaaaattaatgctgggctagagtctgattttgacactctcgggtgtgatcaaatgtttccacatatctctctaacctttctattctcaatgtggggaaaactttctccgctttaagaaaaggtgtatccacagaaaagattattgagtaatttttcatagtacagaagtaataattgagtgatttttccctttaaaatttttttatttttgtattattttaagaacaaaattattttaggatgcaattaaagaagaagttcatttacctaaatttaatttgccaacttttctattacacaaaagcattataaatacaagtagaatagcaaaaatttcatcctaaagagaaaaatattttgggcttctaatttcaagagagtaaaattgtcctggaaccctgtgcacactttaaaaacaatcattaacagattgcatcaaactagaaacttcttcaccacaaaggaaataatcaataaagtgaaaagccagcctacagaataggggaatctgtacatctgatatgaagttatggattgcaaatcgtacatctgatatggaattaatattccaaaatatgtaagaaactcaacaaactcaattgcaagaaaacaaataacccagttaaaaaatgataaaggaatatccatttccagaaagaagacatacaagtggccaacagatatatgaaaaggtactcaccatcactaatcatcagggaaatgcaaatcaaaaccacggtgagatatcatctcacacccattagaatggctgttatcaaaaacacagaagataagaagtgttggcaaggatgtggataagagggaacccttgtacactgttggcaggaatgtaaattggtatagtcattatggaaaacagaatggactgcctcaaaaaattaaaaatagaactagcatatgatctagcaatcctacttctgggtatatatccaagggaaatggaatcagtatgttgaagagctatctgctctcccatgttcactgcagcattattcgcaatagccaagatatgaaatcaacctaagtgtcaatggatgaatggatttttgaaaacacagtatatatctgtatatatatacacacatacatatatacacatacagatgtatatgtacacacccaatagaatattattcagccttaaaaagagaaggaaatcctgtcatttgcgacaacagagatgaacctagaggacgttatgctaagagaattaaactgggtggtatttgacacagaaagacaaataccacatgatccacgtggaatctaaaaaagtcgaactcataaaagcagtgagtaaaatggtggttgccaggagctggagggtgagagcaatggggagatatcagccagagtttcagttatgcaggataagctctggtcaccttctaaggtgatcatctgctaagtataggtcaccttcagcatggtgactatagttagtgatactgtatggtatatttgaaatttgctaagacagtagatgttaagtgttctcactacacatattcatactcaaaaaggtaactgtgaagtgatgaatatgttcattaccttgattatgataatcatttcatagtaaatacgtatattaaaacatcacattgaataccttaagtgttttgtttgttttttggttttttgggtttttttgttttgttttggtttaggttttttttgaggtggagtcttgctctgtcacccaggctggagtgcagtggtgtgatctcaccttactgctacctctgcctcccaggttcaagtgattctcctgtctcagtctcccaagtagctgggattacaggcgtgctaccacacccggccaatttttgtatttttagtagagatgaggtttcaccatgttggccaggctggtctcgaactcctgacctcaggtgatcctcctgcctccgcctcccaaagtgctgggattacaggtgtgagccactgtgcctggcctgtataccttaagtttaaaaatttttgtctattatactcaataaagctggacaaaattttaaataaataacagcagtcattaacagactcaattgatgacctaatgtagaagttaatgagagcaggcctgttggcaaaaaggcatttatatggatacactgtatgtatctgcactgtttcaggatcctctattatgatacctgggtaaagggtgacttcctttctatcataaaacagcctagacagcactaagaaggtggttatgttcttttctgttgttgtgagcgcccagatgagattactttgccaaagactcttttcatttctctttctgaaactctgtgagattgctgtgttctctaggacttaacttcacagctagtctatttttcctttcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtatgatgtttattttcacttttcagactactaggactagaattggactcatctctcagtaaccctgtaataaataatgctccagagactagaaatctaatagagaaggcattcaccattcatttattcacccatttatccatgaaatattaggtatctatgaaatgccaggaagggagctggcacgaggtcaatcttgccttccccgccccctccttccttcctctcttctttcctttcttgcttacttccttcttagggacattttctaccttgattacactgtcagttgtatctcaggctaagagtccatcatccaaactttgaattattttggccccttataagttaataagtaacaattccaagtcactttgtattatataacttatcttcactatattactgctactacagtacattttttctagtatgtcctttcaggagtttatactgaaacctacttttaagcacaaatttgttttaacattgtagcctattgataaattttcatgccattaactaaatcaacatcaaaacatcagactcaagaaaaactagaactgcactttttgagataaaatgtatttctgtgatgctatttccttgatttttatcatgtgtgggctgacatgctggttttccaaagccaccactatgtaattggcaatcattacttgacaagtaagaacttcctgtatttctagtggcttttaaagataaataatatgcttagttatatttatctatgcggttttcagttagagcctaatatggaaatttagtagccctgagcccaactagtaaaaggtagggcttacttccataagttccgccacgctctgtcaaagattatttcacaaaccacctcctttgactgaacactaatggtaacctgggctcatatttttcatgcacctcaagctaggcataccatgaccttttcacagtggtgttccttctgtggttcttttgcaagttgtttcaaagtacttataaaatggaatatttaaataaaatgtataatttaatattgtgatgaataccaaagacagaacatttcctagcaaaataagcttccttgtctcaaatcctctatgttgtctgttacagctgtagtattgcaggctactgggggtcatagaaccacagacttaattctcattcccattttatatttacaggtgaggcttagagatgttataacttgcctgtgattacaaacctttctttttcttgccttaactccagtgttttttcatgttccactgtgcttttacactgaaacaatacaaatacagcatgaaggtgtactatggtggcttgccctgttgcctttttaggactgttttcatgggataattatcctctcacatgtctccatacacaggtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaaggtaattaaaaaaaaagtcttcaaagaaattgttgaaactttattatttcatttcagcagaaccccttttttaggtgatacaatatatgaattttttttcttcatggaagagtatcttgctctgtcacccagaccagagtgcagtggtgctatcctagcacactgcagccttgagcttctgggctcaagtgatcctcccacctcagcctcccaaaggatgatataagatttgaaagcctaagaaagtggataaaagttgggctgctttgccccacatttgtttctccaaattgattctttgagacactgatctaatttaatccttgcatcttgcagatttttacaaaaaggtgacttctccaaggtgtcatggcaagacagtgatgacctggaaccaggatgcagatttcctgcattctctagttgtttatttatttatttatttatttattttgctataccgtgtaatattgtatagacagaagattttacagattatttatatatgcatatctttggatccctagagcaatcctataagattggacttctttatggccacattgcagatgtagaaattacaggttagtaaaacttgccaaggtcatcccttagtaagtggcagaccgcagtctagaccctgactccttaggtggtgttggctctcaaagcagtgcctcatgtttccttattccagcatcaatgtgagccacatacacggacaggtaaggaggtataacagtgtgggaaaggagatactatttatcctcatctctttcctttgtgaaaagggtattttggaaaattcagacgtttagtaatttattgcttaattattaagaaaatatgtgaatccactcatattttgatatgcagtcttttaagataattttaatatacacaatgcaaaaatagtactaatttattatatacgcattgcacagaataaactgttcataaatattcactttataaaataaatacctgcttattgggctttttattcaacgtaaagatacagaacaacagttaggaaagttttaggacatcttggttcctaaatggatggtgggccaaaaaaggaaactgatttttattgaattcttactacatgccaaatactgtatgaggtaacgttttcatacatcagtatttaaccacatcctacccaggttttctcatctataaaatgattgtggctgagtgtggtggctcacgcctctaatcccaacactttgggaggccaaggcaggaggatcacttgagcccaggggttcaagaccagtctgggcagcatagtgagaccccatccctacaaaatttttaaaaaattaaccaggcatggtggcacatgcctgtagtcctagcttcttgggaggtttaggtaagaggatcccttgatcccagaagttcaaggctgcagtgagctatgatcataccactgcactccagcctgggtcacaaaagcaagaccctaactccaaaaataaataaataaataagtaaataaataaaatgacactgaattacatgatctctaaagtcccttcaattgaaacagtttttactctaaaggcaacctaatacagtgaaaagggacaaaccagaggtcagctctgccactttccaaagtcattagccagtcacatacacattgtatccttcatcaggccccccatatgtaaaatgacttggttagattggctacacaaggtcttattcatctctaagttctgtaatttcaaaatgacactttgaaacactctggcaagagatgctttcatttaaaacactaaaacccgtccgttctgtaatttaaaccaagttaaaatatttatgaccttatatgaaatcattgtattaagtcagttatctaagatcttgatgagtagtaagaacatgtcattttattgacttagattttttattgaatgttttgtggttttattgagttttattttagatttaatgagttagagtttatttttactgagttggataccatttttgagtgagtaaactgttgctaaattctgagccatatttatctgaagaaaccattctgttttggtcatgttgataatttacaactataaataaataaaaacagcatggttggtttaaggttccacaataagttattgttttttatgggctagtaaagcacttagaaaactaaaacttttaagcaaatagttccaccataatcctattagtcacaaatttgtggaaagctaacattactgaaaacagctgaaaatggaaagacaagaacattgtcagtagttggttatagtgataaatctgagttctgagggcactaaaacttaaaagcaagcagggaagaagagtagcaaaaagagaagagagaggaggaaatccaagtgccttcaacttaggattagaaagggtagaaagcagggagggagaaaaaatacttaataaaacctgaagactctaggggagtccttaacctatcatagattaaaaagcaaacatagaagaaaactaagcgtattgtatactaacctgcagtaatttgcaaaccatccaaaatgtggattccagaattcctagactaaaatgtaaggaaggttttactcccttggaaagggaaaatagacatctacacgttttaaaggtaagaataagaaaaatattattcttggaaaatttaaacatttagtaatatactacttaatataaagaaaatatgtgaatccacttatattttgatatgcagtctttcaaaataattttaatatactcaatgaataaaatagcatttattgtatactgattgcacagaataaatttttcataaatatttaccttataaaataaaccctgcttcggctggggtttttattcggcgtaaagatatagaacagcagttaggaaagaattaggacatcttgattcctaaatggatgatgggtcgaaaaaggaaactttttttgaattcttattctgatttttattgaattcttagtatgtaccagatactatgtgaggtacatttgcatatatcattatttaaccacatcctactcaggttttctcatctagaaaatgattcagatgatattggtaggatgtggttacataatgaaacattatcatttggcttcttcaagtatacatcagcagttcccaaagtgtggtctggggcttggaccctttcaaggcatccatgaagttgaaactatattcataataatgatttttattacttttttcactttcattctctcaggagtgtatgtggagtgttctggaagctacatgatgtaggatgatgacatagctctggtagctaatggaatgtttgcttatgtgttcttgtatataataatttctcagttgtaatttctagtgtgataaatgtcagtaaagatagcccacataaacaaaatctctttggggtcttctataattttaaaaagagtaaagggatcttgcaaccataaagccttcagtctcattctgaagaaatgcagttactcattctttgctactttgaaactagacaaaattgctgccacattctgaatactgctgcattagaccagtggctgtcagtaaagacatctccttagcttataaccaatacgcaataaaaagccaggaaaatggaattagcaaatgtgtttaactcatctgcatgtattttctgagaggtgttttggaagcttcacatttgctgttgtagtaaaatgtgggttatattcataattaaaatacagttgaccacaaagctgcaggcttatctatggattgaaaagaataaacacagcataaaacaacttttggtagatcttcctaaacaattttacaatgtaaatggaacaggtttatattagtgattcttgccaaaaattcagtcagacagatgagaatgagtagattgggtttgaattaaggtgaaatagttacagattcttgggtatgttaatattgcaaacttatgtaaaataaaacctttagcaactgaaagatatatataatttagagcttggaaagctatcatttatttgttgtttacatgttggagatatatttttttctttggtaagttccatcctattttttatctttagtgaaagatcattttggaaccatagccgtacctaaagatataagtaaatacagtctaccatacaatacaatgtaatctaagtttgtatttctgtatacaaaagaatgccgtatgcttgttagccacttgtatgtctattcatccctacttcagaaagagttttaattcttctcacctgccagtcgtagcttattaatccaacttccaggggccagactgcttcatgggaaagccaactgcaagcccagcacagggctgttaatttcattgtaaaatcaacaacaccattctgaggtctcattgtccctgatgttttgttaaaattaaagcaattaaggagagatcaaagaaaatttttcaaatgatatgaaaaatttgtctgttactttctagcagacaaatgtgcagacattagaataaatatatacacaaaacaattttctcagatggtgactgatgcatctctaacacaccacatcacagacttcctgatcatcagaagagtaagttgttgaaaatacattgttctatggactctaaaataataaaaaagtgttattagagtgtttcttcatcagtaatatgaagaaaatttggagaagccagccttgttctgtaaatcgataaataattttacagaaaagcactcgataatatccttacatcttcctctctagattccttgagtcacataacaagaaaacacttggttatcggtgtaaaaaaagtaaaagcaagttccaagatgcatgctaggatctgtgtattcagttcaagattttatttacatatacagtgtataatgttcagaatgattattcattgaaagaccttggatcatcacaaaaaatgtgatacacttttgaaagtcatcagctgagtcatgtcagaaatttccattataagagttaaacttaattctctttttttttttttgaacatgtgtcaaagatttatttaaaacccattaacgagggaaaagcaggatggtaaatctagttcaaagaagaacttgaaggaccaagaatatatagtcactgaaagaaagaatcctgagataagattcagaatggttaatgttctacagggcaataaaaccataaccttgaggttatcttttcttttttttattattcttatactttaagttctagggtacatgtgcacaacgtgcaggtttgttacatagttacacatgtgtcatgttgatttgctgaacccatcaacttgtcatttacattaggtatttctcctaatgctatccctcccccaaccctccaccccctgataggccccactgtgtgatgttccccgccctgtgtccatgcattctcattgttccactcccacctgtgagtgagaacgtgcaatggttggttttctgtccttgagatagtttgcttatgatgatggtttccagctccattcatgcccctgcaaaggatatggactcatccttttttatggctgcatagtattctatgatgtatatgtgccacattttcttaatccagtcaatcattgatggacatttgggtcagttccaagtctctgctgttgtgaatagtgccataataaacatatgtgtgcatgtgtctttatagtagcatgacttataatcctttggatatatacccagtaatgggattgctgggtcaaatggtatttctagttctagatccttgaggaattgccacactgtcttccacaatggttgaactaatttacacttccaccaacagtgtaaaagcattcctatttctccacatcctctccagcgtctgtttttttcctgactttttaatgatcatcattctaagtggcgtgagatggtatctcattatggttttgatttgcatttctctgatggccagtgatgatgagcattttttcatatgtctgttggctgcataaatgtcttcttttgagaagtgtctgttcatatcccttacccactttttgatggggttgtttttttcttgtaaatttgtttaagttctttgtagattctggatattagccctttgtcagatgggtagattgcaaaaattttctcccattctgtaggctgcctgttcactctgatgatagtttcttttgctgtgcagaaactctttagtttaattagatcccatttgtcaattttggcttttgttgctattgcttttggtgttttagacatgaagtctttgcccatgcctatatcctgaatggtattgcctaggttttcttctagggtttttgtggtgttaggtcttacatttaagtctttaatccatcttgagttaatttttgtatatggtgtaaggaagggatcaataattctcttatcaaaaaaaccttcctctcctagccatgccaaataactgagcactctgtgagccatccagctgtcagctagccaagtagcattttcacccactaatattagtctttaaaaagcaagaatcaaaagagaagtcaaggaatatcataaaatatctatgatcacaatggcaaacatcaggattttcaccaacatttatcaatgagaacagttctatacattagcattctgttcatctgtgaaaaaaaaactttttgatatctgaaggtcctcagaaccctttgagaattaaagagacttcaactgccagcaaattctacatcgggcatattctttaagacattgctgatctcacaagaggtagtgaaaactctccaaaacaacatcaatgaaacaaaatgaaacaaacataccctcagttccaagctgtgagctgcaggcacacttagcaggtcagggttttccccatgatagatgcccagagaggtacagtggtgagcattgccccaaaggcagatggctgtagcagttttctgagcaataagtgagaaggagctaagtgtagggcttctgaattaagccaggattctcaatagtgtctgaaatagtcataagtcagtaacacccctggctactgaattcctaattcagaccttgtaggagtcccccagtttaaggtcaagaaactagttccaaataatatcagcaagcatgtgagaagctaaccatcttgaatgacattcatcatcaacaagaaaactgatacagactccctgctcttcccctacctggggaaagcagaaattgggattgcctgatacagaatataaaaaagctattatgaattatttaaaggaagagggcataggcttgcaacaataaactattaggaataaccaggatgatttgaaaaccaagtgaaaaaaaggtgaagcttctaaaagttaaaagtataattattgaaataaaaattcagtggaagggttagatagcttactggacacagcagaagaaaaacctgaaactgaaagagatatgcaaagaaattaccagaatgaaagcaacagtgtcttaaagaatatgccctatccaggatctgctggaatttgaaggcttttagttcttgaaggattcataggatctttgaatattaaagaggtatgtcttcttcactgatcaatggaagagtaaagtgcagaactgttctcactaatgaactttagtgagaaatgtttgtttttacttttgccagtgtaattatatattttcatgttattttgcttctgttctgatttttactttggcaatcaatattagtgagtaagtagtgagaagaagatggaaaataaaaaagaggcattcagaaatgtgaaggctagaataagaaagtctagtacttatctaactggagtccagtactgatgaacatgtgaagccgtaatgcataaacaacatatccaagaaggtaaatgaaaagaaattcatgcccaaacacactgcggttaaactgccgaatactaaagacaaatagagagtataaaagcaaccaaagagaaaaggtagatcaccttagaagtaaattgacaagagacttctcaacagcaaaatggaagcagaaggataatggaattcaaagtgttaagagaaaatgactgagtacttggtaatctctcaagaatgagagtgagccaggcgtagtggcacatgtgtgtaatctcaggcctttgggaggccaaggtgggtggatcacttgaggctgggagttcaagaccagcctggccaacttggtgaaaacccatctctaccaaaaatacaacaaaaaaaaagagccaggtatggtggtgcatgcctataatcccagctacccagaaggctgaggcccaagaatcgcttgaacctgagaggtgaaggttgcagtgagccgagatagcaccactgcactccagcctgagcaagagagcgagactctgtctcaaaacaaaaaacaaacaaaacaaaaagagtgaaatgaaatatctattggttgaataaacaaaaatactgaaaaagtacatttcaaggatagtaagccagagaagatatttgaacatctgtaacagacaacagattaatatctagcatattttttaaaaaagtctaaaattcaattttaaggaaaagacagttagaaactgggaagtgaaaagccagggacatacaaatcaagatttaaattcaattttatacatttcagattgtcaaaattaagaagtctgacagcaccaaatgtggaagagactacaattttcataaagcgcttgtggggagtgtacattggtagccactttggaaaacaatttggcattatcttgtaaaattttaatactcacacattgtacaacccagaaatgccacttaaacatatttacaggaatatttagagaaactcttctcataatagcaaaaaattgatatttcaaacgtccatctgcatacaaataggttaataaattatagtatagtcatacaatggaatactatataattatgaaaatgagtaaatcatagtctttcactaacaagaacttaaatgttagaaacctcataccaaattttaatagtgtcccagaaaactacatatagtataataccatttaataaagcctcaaaacaagcaaaattaaatagtatattattttgttttacatagtatgtgataaagctgtattttcttccttttttttttttttttttttttttgagacaatgtctcactctgtcacccagactggagtgcagtggtgcaatcataacttggcttactgcagttagacctcctgggctcatgtgatccttccatctcagccgccagagtagtagctgtgactacaggcgcatgccaccacacctgcctaaattttttgtatttttttatagagacaaggtttcaccttgttgcccaggctagtctcgaactcctggactcaagcgatcaatccgcctcagtctgtcaaagtgttgggattacaggtgtgagccaccacacccagcctatattttcttaaagatcaaggaaatgacaaacccaaaattgagaataatgattactttgtcaaacctatcgcctttgtaacatctcagtcacaattgggaatcacaaactaccagagatggaagtgctttctcattttatagttgaaaaaggtgaggcccagaaaggaagttacgtgacatctgtattaattccacaaattttaatttagcactatcataggcatttggattccatccaggggtataagagactattcctgccgctgaggaacttataattttaattgagcagtgagggaggggcagaaaataaacactaaaacaataataagtaaattctgtggtgtgttagaaagtcataagtgctattggaaaggagaaaaactggagcagagtaaagaagatcaagagttccagaagagaggtggggcagggacaggccacagtattaaataggttggcttagccccattgagaaggtgagatgcaaaacttgaaggcgatgaaggaaataggcaagtgtgtatttagagaaagctttcttcttgaggaaagaaagaagtcaagagtgatttcaaggattttggcttgagaaactggaaggatggcgttgcgtctgctgagatggagaaagccgcaagtgaagtgagtttgtaggggagggtcaggacttcaatttggacaggctggcttagagatggctattaattatttaaatgaagctgtcaagtaatcagaacatactcatccagagttctaaatggacgtttggagaaagtcaaaatgcatgtcaatgaccaaagcaatactaatgcagtgctttttgcaccaaacagggccagatacatttgaaagaattagcaattaagttttatgaagatgaacacaatagaaatgaataggaatatgatgaacccaaaaaatggagtcagaaaacacgtccagttcgatttttttcagctctttccaaagatgtaaatatagcagaatattcagttggcctcaaattgacatatttgccattttgagatagcagtcgattttgtgaggatttatctgattacttctcatgttattcccatagtctctttctgtctgtaagccacaacaatgatggggcacactttaaacaacataaataagtgaaacaaattctgcaggaaattatgcaacatagagaattccaaaaaaattatccacatgtggatttttattggccctgatcatgttttagaatgaaatgattataactttgccaggctgcttagcacaattacaaaggctggggcatgctgttggaatgatttgcagagagacttaactgattacacggtgttttatttgcattacattaaatccagagcacttcttagagcatgccgaaaaccaaatgtagagccaagatccaatgaaagccgcagctggatgtggtcagtgtctaagagctaaaaaagggacctggagatcctctggttctttattttatagcagagaacatttagttccagagaggttaagtgacttgtctaaagtcaccagtgacagaatcgtgtcaagaacctgccttttctgattcccaggccagtatacctttcgctgtaggttgctgcttccatgtgtcataaagacttaaaatttgcttcttttttatccctttgcagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatggtaagtaaacagtcatcaccatatactttattattctcattatagctgccagaccagtggacactaaagccattgccaaaaatgtgtacagtttttccaccaaatgccagaatttagaatattgcatggcgataaaacatttctcttttaggtcagtgtttttaaagttttattatagaacctttctctctgtggttgggcatctgccatgaggagaaaagagacttgaaaaatctgggggattatgggaaaaactttagtgttagaacaaatataatgatcatcatgattaatttttatattgcctcatgcattaaaaacagaattaaaatttacttttgtgtatcagtagtgtcattctgctttaaatgtaagaaaatcctgaagatgtctgggtctgaaactttaaatggcatatgagaatttagattcatttaattttttttttttttttttttttgctgtttattatgcaaagacgagtattcgtttccttcacttcaaggaacgtccatgagttgtggaaagggtaaaacaaattatttttatagttctgcaaaacttcaaagccatagaaacataagagaataaaactttctacttttgaaacctgtgtctaaagtcaagcttatgactttgggtgtcaacttaagggaaatgatgtagaagacctgagaaaagacccatgttttcatgatctgtggaactaactcagtaaggtcctggaagacaaacgtgtttgaaaaaataattcttggtcactatttggttctgattggttgcctggctgacaaaataaattttaggtgtaacttgatagtattatatgtgtctagtattaatcagttattttcaatgcactcaaggaataaaaaatgccaacatgatcaaattaaatttgaagtttcatttcatcagctatcctattttttctttcttttgttttcatctctctcaaaactgatctagtaagaaggcagtcttcatctatatgtactctaaagcatctgagaaaattaaatttttgctctatcatgcagatacttggttttcacagtggaaaccatcaagatatttgagagtcactcattgattaataacctaccctttaaaaatagttcacaaaattctatctgtatgattactaatgggtcagttcctctaaaggcaagaatgtattttgaatagagctatcagcagtactgaacaggatggaaatttggtccaactttcctcaacaattgactacatctgctgtatacaactgtagtcatggattgcaaaataatttgctggttcagttccatcagtttcctttttatttcagacctcataaaacataagggcaagcttccaagtcaagggttgtattttaggtgatgcaatcaagttgcaataaacttatttcatcttcatgaagaaatcattgactttgaggtcattatcactgagacagcctaggaaagcatgccagttccgcttttaacactaatttttgcctattaaaaaattatcacttcacacattcatgtaaaatataattcctgttacttacaggcagtgcatacattgatgtaaaatatatttcctgttgcttacaggcattgcatacgtttacttaaaatcaatctgcaattgcttattgtttataggcaaatattatttaaaccccaacctatgtagtatggatggtataattttctcctcccataaatgtcaaagaaagctatcataaacttgataggtcatattttgacttcatatgacaatttattttatttctagagagggtcaatcttgatagggagtgtttgttcagttctagcaaaagcaagaaaatatatgaattaagtgtcatgacatcagagacttaggcagttcaacacttaaaaaattgcaaacataactaagaaaacctcagaggtttttatgggagtttgtttgctgcacagaaaataaacatcagactaacaacaaggttttgattagttttgcctgttagctgtatgaagaaaacatttctaaatacaaagttttctaggaagttgagtcactatttaaaatccattgctttgaccaatgtgaagccaacagggttttcattcatatagaatgcctttttatcaaaagaggctctgagtgttataccaaaatcagcacccagctgttttcagtatgcgcaagaaaacatgaacgtcccccaaagcaaatgtactccattccgtgttaaccttatttctgctccctggtctctgattagtctggttgatgaatgtagcttcccctttggccatgcactcacagctttgaaggaggcttctgaaggaactggtagggaaccctaggggctcttgctaatgttgttggatagtcactgaaatcagtgatcaccatgtcctttcactttgaaaattctatgattctgtataatcaaacaacctaactcactggatttttcacttttcaaccagctattccgtgtcttacagtgctctggtcttcacagataggtaggcacctggcatgtcagttgcctgaatttgaaagttttcacctgtatgttttggtacgataaaaataaaaatgtaatttatatatctgaatcaggtctgtatgttatgatcaattgctcagcaatttcgggcagttggtttgatggttatgtagtaatgtagcctgagagcagaaatacagagcctctgggctagagaaagtataaatggcatcctaggctatgtagggttacagctcttcagaaggaactttcattttcattgtgacacatcgtctacatgttgtagaagaacatagtttcagaattcttccagttagaaacatagtttctcaaatattcactttcagcattgggtagaaaaagtacccaggtgatggactgattgatatgcttcagaaatatgttttttcctgcaagtaatgaaaataaacacacgttcttaattattttggtcatttaacaacccatcatttctggaccatgggttaattccaccgattgctcagaagccttcctgagtcatctcaagcacaatcaattcactactgtgtctagacactgcccttagaggaaagctcaaaatgaaaatgaagcagaaatacagacccacttcctaggccactcagcggtgtatgtaacttaccaagtgatcattgcatcaactactctttgttagtgaagctggtgtctgcagaatcttgataaaaagactcatggataatgttgcttctttagtcaaatgggctcttgcatgcatttttatagattttcaaagtagtcatttttgttttaaaatcctgctgccaagtcctttatagtaattgcattttaaaaatatgtcttctttattttttattattatttttttttgagatggagtctcgctctgtcacccagtctggagttaaatggtacaatcttggctcactgcaacctccgcctcccaggttcaagcaattctcctgccttagcctcctgagtagctgggattacaggtgcccgaaaccatacccagctgatttttgtatttttagtaaagatggggcttcaccatgttggccaagatggtctcgaactcctgacctcaggtgatccacccacctcagcctcccaaagtgctaggattacaggcgtgagctaccacactggccttgtcctctttatttttaataaaattatttagtcattaagaattttggcttgtgggccgggcatggtggctcatgcctataatcccagcactttgggaggccaaggtcagaggaccacttgagctgaggagttcgagaccagcctgggaaacatgacaagactccatatctactaaaactacaaaaaattagtcgggcgtgatggcttgtgcctgtggtttcagctactcgggagtctggagtgggaagatcgctttagcccagggggtggaagttgcagtgagccatgattgcaccactgcactccagtctgggtaacagagcaagacccagtctcaaaaaaaaaaaaaaaaaaagaattgtgactagtgaataattcatattcagagctctttttaatgtatgaactaaataataaaatagtaagtttaggctaagtgccctttttatttttaaaattttctgtatttattattactatttttagagatggagtctccctgtgttgcttaggctgggctcacctcagcatctggagttgctgaaactataggcatgtgccactgcacctgacctatttaagaaaataatctagagaagaattgacatgttatttatgaatcattcagttaggttttctctataacattgagatttggttaaaaatatgtttttcataaatttaaaaactattgaaatcttagctttgctgactaggatgtcttattatataaatgagagagagtttgtaattttttaaaaaaaactgacaactttcaaaatagtttctcagtggcttcataaaaatccagaaaaaaagatttcacaaatttttgtgacactcaacatttttaaggtagttctctcagtgccttgcaaacagcagctctagtgtatattgagaaaaggaaaaattctgaatggcaaatactagatttcaactttaacctattcctttttattattattattattattattattattattattattattattattgagacaaagtctcgctctgttgcccaggctggagtgcagtggcgcgatctaggctcactgcaagctccacctcccggattcacaccattctcctgcctcaccctcctgagtagctgggactacaggcgcctgccaccatgcccggctaattttttgtatttttagtagagacggggtttcaccgtgttagccaggatggtcgcgatctcctgacctcatgatctgcccacctcagcctctcaaagtgctgggattacaggcgtgagccaccgcgtctggctaacctattccttttttttctttagtcttcttggttgtgtaaagaaaaattacccaaatcttaactttcagaaaaggtaacaaactcctaatgcatgtggcagtacatgtttgctccagctgccctgtccctctaccctgcgtggactccagaaccgcccatgttggagcccacctcctttccccacccctgcccactttccactcacacctcaggcaaaccctgcattttgctgttcctggaaaatggcttatgcttggatacctctgggcctctgttgatgcgtctgtctgttccttgtggaaattcttcctgacattcaaggctgcattcaaatgccttccttcccatgagacttttctgattccctgctcttccttttctatgtgtttcataccttcctgtgatatcacattctgccttaaaaagcaagagagtgatcagatacatattaccaaaaaaaaaaaaataccgatagcagtaaaaatgatagagaaaagactggaattgggaaatccatctgaagaccaatgcaatattaggaaataagacattgagaagggtgagaagaaaggaaattgagagaaatatcagagcagtgaccaatgaataaaagcgcctgaagggagagaagttgtcaaagattatttaggatatctaatttgggtgatagaatgaattaaccaagagaggaacacaggaataagagccagtttggaggagaaaattttaaattcagttttatattgtgttagagatgcctatagagtatccagcaactacgtatagaggaatataggaggatgtgaaaaataaggctccaaatttcagtgaagagagagcaggaatcatcagcacccattgtaggttagagaggtcacactagggaccacagaatacaagctaagggagaggcaccatcagagagatctggagagcagctggcagaatgttagaggacccagaacagcaggaaccaggacaagaaattttggaaataagagggcggagatggtcaccagaattaaaggctgggagaatactgaagagctcaagtctattgagaacttagaagaggccattagttctggccgagagaaaagcattcaggatttttacaaagttttggtaaatcccagtgagcgcaaagctagactgcagtagatcgagaagtgaatagaaagtgacaaacacagacggagtgaaaacaactctttcagtaagttcagtggtggaggaaagatagcttaaagaggaggtaatagtagagtcagaaccttcaacctgggcagaaaggccagagccagtacagagaggcacactagagaaagactcatctgtgtaatatacccagtctcccctaccagacatgtcctttccatcctttcccccagccccatctgtgcagcacagtgttgcatcaacgaagtgttcagtgaatgaattaaaggttgtcaggaagacttcagggaatcagagattgagttagaaggtgagctggtggtgttttgctcatcttcatttttgaaagaaacctaagaaaatgtttaaatgtcctctacaaatagtgtgaaaaatggtacctctgcataaaaataatttaatattagtgctaaagttgctccttgttttcctttagaggaactacaaaaggatagttattagattgccaaatcctgcagaacctccagcaggcacaagttggtttttctccctcaagaaagagaagtgagccaagcgtggtggtgcatgcctgtggtcccagctactcaggaggctgaggtaggagcttcccttgaacccaggtgttcaaggctgcagtgagccaagatcacactactgtgctccagcccaggcaagagaatgagaccctgtctctttaaaaaaaaaagaaagaaagaaagaaaagaaagagaaaggatggaagggaggaaggaaggaaggaagggagggagggagggaaaaaggaaaaaggaagggaggaaaagaaggaaggaaagaaagagaggtgagccaggtgtagtggctcatacctgcaattccagcactttgggagactgaggcaggaggatcacttgggccaggagttttggcgagatcccatgtctaccaaaaaaaaaaaaaaaaaaaaaattagctgggcatggtcatgtgtgcctgtgggcccagccacttgggaggctgaggcagaatgattgcttgagcccagaaggttgcagtgagctacgatcatgccactacactcccacctgcgtgatcgagaaagaccctgtctctaaaaaaaaaaaaaaaattttaaaaagagatgggaaaacaacttattggcaatagcacatgttcttgtttgtatgcaacaaacatataaaaagtagaaaaattgaccataagacatagccttactatttttcaaaagcctgataatgattgcaaattcatcccttagatgtggaaagacaaaaataagacttgtcttatttcattctgttattttctattgatttattattttgaaaacctgctttaattaaccttagtaattaagtagcatttgtctttaatgcttctacaattaggtagatgttttaaaaacatgccgattaattgtttcttagcgttatacccagatccaaaaagcaggacatctaactattccatgtgcttggtgtttgtgtgttcagcaatatcagtactaaatacacaatacaaatctataacatgctagtagtagctacattcagctcaatagaagtgtgttgtataaaggaatgccaatatgctttcccagaagttaatgagtctctatcaaacccagtcttcctgaagggagcctaccagctctgatatggataattttttttaccaagataccagatttctctgtaggtgatgaattattccaaataggaaactgcgtgccagtgttctggaagttgctctgtgtgacaggtgccagatctgtagaacagacagaatgtaattttttttgagcctcaaaaactagacaaatactgcttttaaaaagagagcagagcattttcttgagtactatgtagacatttgtagaactttagagctaaatttagagctagaggaaggaaactttagaatcttcttttctaagttcctcattcagtaaataaatcagttgaagaccagagaagttcagtaattttcttaaagccacatagctagtttgtcactgagctgaaactagaaattaagcttcctgactgcattcagtgcagtattcattcccttgctttccagagaggccaaaagttcttgctcagtgactcacagtaagacatgaagcattttccttttaagattaatcagcagtggtagaagatttggaaaaatacacttgtatatgagtacactcagcctttatagttctgacccccaatgcagaatgttcatcttctatttctaaggtctgacttcagtctttcaggaaacacctcccaacctccttcgctttcctcctcttggttgtcagattctccacatgaagggtagaacctgaggctcaagaattacttaactaaaaaacaccatctcacaaacaatttaaagatggaaagatagaaatagagataggcagacagatggacacatagattagggtttcagattctgttctttctctgtgggagaggtcagcgtgccatgactaccagcctggtctagaacccacagcagccatagttaccaagaccacagcaataaaagctgtgtttgttaagcattgccatgcacctagcactgtgttaaacacttcctgtgcctcctctcatcacctcacgtgaggtagataggtacaattatgtgggactcaaaagcaacgaaataataaaactggcttttttcccccttaaaaaaggtatgcgtgcctcagctgaaagacagaaaaaaaaaaaaaagtaggcaaataaaaatccttgttttctgtacaatttcagatttgtgtatgttttatgggaatttagtctcaccaaatgggatcgatttttcattccttttatgaacttctggtgtataaaaatgttaaaatcacctatataattggttgcactggtagttaaatggaacctaatttgtagcatgggcatttaacaatacagataatttattcattagagttagcctttggggggaacttcaacttacaaaaatacgttttagtgagattatagcagagggatctcactttaatatatcctaattctaaaatggtttttcggggtattttttggttatatttgttaggtgatagaaaagcaagactagtaaatgtagtaagtggctatctttggctgtttgtccatttaaattaacttttttgattacccattaggaaaaaattgcttttctaggtgtgtaaagttttgcatatgattatagcctcttacctgtaaaaactgaatcagagcttagaaccatgcctggtgcacaatagtcattcaacaattattccttgaataaagagacagtattgtgtggtctgtgaaataacaaaagttcaggagcaacagacacttggtgattctagtcacctctattttgttataggataactggttttctctgagttttacaccagaatgccttcttcttttaatacgccttcttacttagtgcttttctcatgatcattttcccaaacttcctaatggacatagtgtctcattttctgtctgtttttaaacctgatactttggagtttaatccatcaaacatttattgttaacctactatgtgtattttgttacacctaggaacaaagatgagaaaacatgttactcatataatttatattcgagtagaataactgatataaaccaacatcatagtatagtaacagtttaatacatgagctaatgtatgcatacaacaggagcccagcatttaggaagctttttataaactgtcccaaaccccaggttttttatatactcctaattgagtggatggatggcccatcaaaatgtcccgtggaagacatataatgtcagaagttaccgagtgactctgataggctctgcctcccctaccctccgcactcctcaattaggaactactggtgaacaagaaatgaatgtagtacagccatccctccttattccctgggattggctccaggacccactcagataccaaaattcctaaatgtgcaagtctctgatataaaatggcatagtatttgcatgtaacctacacataccctcctgtatactttagatcatctctagatggcttataatatctaatacagtataaatactgtataaatagttcctatggccaggtgtcatggctcatgcctgtaatcccatctctttgggaggtggaggcaggaggatcccttgagcccaggagttcgagaccagcctgggcaacatggtgaaaccctgtctctacaaaaaaattaaaaattagccaggcgtggtggcacacacctgtagtcctagctactcaggaggctgaggtgggagaatcgattgagtctaggaggtcgaggctgcagtgagccatgattgtgccactgcactccagcctgggtgacagaacgagaccctgtctcaaaaaaaaaaaaaaagttgttatactgtatttttttatttgtcttattttttatcattgttttatttatttattttagagacagagtcttgctgtcacccaggctaaagtgtagtggctctatcacgactcactgcagcctcaaactcctgggctcaagggatccttccacctcagcctcctgagtagctgggattagaggcgcacaccaccacgcccagctatttatttttatttttatttttgtacagacagggtctctctatgttgcccaggctgctctcaaattcctggcctcaggcaatcctttcactttggcctcccaaagttctgggattacaggtgtgagctaccacacccagcccatattattttttattggttcttttttccaaatattttcaatccacagttggttgaatctgcagatgtggaacctgcgggtatggagggccaactgcataaggaattctatctgagcaaagtggtcaggaggtcacagaggattttgaaggaatatgctatctggggttttctttccattgtatttcaaaatacagtagacaaggacttaatatgtgccagaaattgtactaagtgctgaggatacaataatgaacaagattcctgcctttgtggagattatatggcaagggaggaaagaaaacattatagattaattcctgtgatcagtgctgtgagataaggtcatatcctgagggacccagacaagcctagcaccaggggctggggtcaccagtagataaaaatatgaacaaccataccccagccccatggaacaacacagaaagaaaatggggaagagtgagtagggaacaggatttttgaccaaaacctcctagtttaaaggtttctatatgaagaggccatgtaccaaggatatattcactaaaagtatctaaatataggctaattcaatttaaaggaatcccaactgagaggtaagattttcttcccctctaacacccaagtctggtctctaaggaggcccctacaaaacaatagttgtattagtcagcgataaaatttatttagggtcaatggaaatgaatttatgaatttgagactcaagggtacatgtcagtttcttcttgggaaaatccaaggtaatattcacagagtactcagatgggaaagttgtcgtgtgctgtcatgtctcatggtagaaatgctacccttagcataataacatgtaaaataactatctctggctgggcacagtggctcatgcctgtaaccccaacactttgggaggctgaggtgggtgaatcacttgaggtcaggagtttgagacccacctggacaacgtggtaaaaccctgtctctactaaaaatacaaaactgagccaggcatggtggcccaccccttgtaatcccagctactcagaggctgaggcaggagaatcgcttgaacccaggaggtggaggttgcagtgagctgggattgtgccactgcactccagcctgggcgacagagcaagactccatctcaaaatataaaataaaataaaataaaaatctctttgttctgggattcagcagagacagagtcttgctagagacataaacaaatatgacagtctctgcgctcgaggagcatatagtctagtgaagccgatcaccataaaaacgcatggctgtgataccacatcgtgagtgtaagaacagagctatgtatgcatggggaacagtggacatgatggccaggtacccttattatgggaaacatagaacccaaagtgtgttcccaaaggaacatgattcaaaataatattttgctgaacatattggtaagaaggaaagaaaacatatctgagttgaaaagttacagtttattttttccccaaactagtccccactaacccctcttacattttccttgttgcttttctttctttcattatcttctttgacacttcctcaccctacaggcagccagtttgtctttctgacaaacatcattaagtggtaactctggagagtcgggagataactatggcttctctccgctacatgtaaaagtgctctctggactagtaaaatgtgataaagcaccatccatatttctttttaacagagacaaacaaatcttataaactccctgagaacaaagcctatgtctgtacaactttgaattctgcacagtttcgtattttaattcgtgaaacgtgttgatccttctagtgcctgaccttaggtcaagtgctggggatacaaagaaggtgacctttgaattgggtcttgagggatgagtaggagttggttctcaattatttcacgtttaagtcgacatacttccctccctttgctaaactcgaattctttcactttctcagcaggattatgcattaacttttaaaaatgaaagttaacggtttaatttttactgatggtctgtgctacttttgtgaaataaaaacatgagcaaagtggtagacagaaaccaggactcaagagcagtggaggaggagggcttctactgtgtgggaacgagggctgggagagcacagtgtgtgttcagagcagtagtaatccaatgattcatcctgtcattcctcttcctctatagccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcagttagttctcttctgctgtcttcattgggggagcgggaagttgttttgggtttttgtttctttgagtaaatggtttactgcgctacaaatgggcccccagaatattgttcaaatgttggccgttaaaaaaattcaggcttagtctgaaacccaggaagttttttcagatagcccaagtcaacattatttttaaaagggggaaaaatccctaaagtttttgagaatagtgtaagaatgtattggtcatcctaactttaatgaatgaacttaagccccctgagcctatcaccctcttttaggatccatctcctttttcggcatcaaaataactggccacagcaatattcattcaagcagccttgctttcccctgggaagaacccgacctaggtttagaaaaggtattgaatcccactatttcacctttcaggagaactaccagagttacctcttttttttttttttttttttttttttttttttttttttttttttttttttgagatgtcgtctcactttgtcgcccaggctggagtgcagtggcacaatctcggctcaccgcaacctccgcctcccaggttaaagcgattatcatgcctcagcatcccgagtagctgggattacaggtgtgcacgaccatgcctggctaatctttgtatttttagtagagacggggtttcaccttgttgatcaggctggtctagagttacctcttaagaagttcaacatgaggcataaaaatagattctagatattatgttacctttctttccttgtagcattcttgattattccggggcaactagaagctctatccttttattacatatgtgaattttatcttctgcaaggctctgagctgcctggactacttcagtggactctccaacatctgttcactcattgagcagcactgtttagaaaacccagaatgggttgtaattgttactgagttaggttttccaagcagcagagctcttctctgactggaaactgagaaaacaacatggaattatagaataaaattgtacctgaattctagtcccaattctgccatcagcttggatgacctggatcatgtctctgtacctcagtttgttgttgttgttgttgttgttgttttgagacagagtcttgctctgttgccaggctggaatgcagtggcgtgatctcggctcactgcaacctccacctccctggttcaagcaattctcctgcgtcagcctcccgagtagctgggattgcaggcgcatgccaccatgcccagctaatttttttgtatttttagtagagatgggttttcaccatgttggccaggatggtcttgatctcctgacctcgtgatctgcccgcctctgcctcccaaagtgctgggattacaggcatgagccaccgcgcccggctttgtagctcagtttttaatgacagggtttggctttgattctgatgtctgcacaacgctcccagggctgtaagaactgcagaacacactgagaagacaccgtcccagccatggaaagcccttctatgcagtcatttattttcacatgaacacctcccagagagctatgcaatgacttgatagatatgtgtaacttttcccctattcagatatattgttaggaaaatctcattaacctttcatgtattttgatgactatctcaagatggtagttcttctgtttagctaaactagtaagagtagaatcagttaatagaaaaaggaaacttatggcataaagccatatggtaataaggacaatgagttttctgatttgaaaataggtctttgatacctcaacaataatatacctggattcaattctttacagtataaaaaaaaccttgcacatttgttaggttcgagccacatgcacctgactactgctattattatcctctttattttagagatgaggaaaataaagtccagagaggttaaacattttgccctaagaccccacagcaagtgggtagaagacctgggactataatgcaggttttctggcctctagttcagagcattcgtagcatgctagcccctcagtagcatagtactttaggaagctagtctttcccacttgctggtagtaagccagggagacataatacactaagaaagcttcggtctgagaaaactttccatgattgttttttctcaatttttagaacagtaggaattcttcacctcatctgctatcccaacatattcacaattggaaaatttttgtgctgttctgttcttttcaaattacaaaagtccttgactaggactgctggcttttacatgcacaggactgcacaacactggtgtttataaagctcattcgttcaatgataaaattggccatagcaaatcaaaaataaatgaagacctctgcgtagctgattggactacagaaaataagccattcatatccaggaagaaaaaattaaaaggattgctgaaaaggaaagagccctaaagcaaactatctacagttttggttagttttcttttcttttcttttctttttttttttttttttttgaggtggggtcttgctttgttgcccaggtgggagtgtcttcttatattggtcaggctggccttgaactcggggctcaagccgtcctcccacctcagcctcccaaagagctggtattacaggtgtgagccaccagccatggttagttttcatcaactgctttctcaccttcttttcatcctctaattcatacctgcaatccttattagaaatcctgtcaacttaatagtaccagaaagtcaggcaaaagactgataaaaaaaaagcctcggtggtcaagaacttaaaattacactactggtgtgcaacgtgctcttatctgtgttactggaggacaccctcaagatacctcactccagttgactccttggctctaaatctttgagttaaaaaataaggaggttctttatggaataaacaggtattaagctatttaaaggagagggctgcgaaatgcttgattatgggcttttcaagttcagaggccaagcgtttgtcattttcttccagtaactaggactgtgtcttgcccctaatagttactcagactatatttgcttaattgaattaaacacagttgcctatgccctttgaaattctggactttcaacagagggcctctagcccaatatttgcttaccaaactggacatcattgatgatctggattcaggcagggtctggaaaaagagagactgggccaaattaaaataatccattcactgatgacacaaaactaaactacaattgtttggcaccctctcttctccttatcttgcaaaatcaaattaagcactagtggaaagaaacagttcagagaggaatatgggaaaggaaaaaaaaaaaccaaaatgtgatttccaacgagactagagatttgttctttatctacatggtcatgttactcatttgatagcatctatctcaggggtattatgttatctcttggccaggactcatgaaagttaagatttgcattgataggaaaagttttgcagaaatatggactcttgagagggtgggaggtatataaaagtggctatggctgtgcagcagagcaatttgcatttcttatacaccctgcttgagactgatgtcattagtgttggttaggccaaggctgggggaggctactcagaatagtgggtgaccaattacccagaacctttggaaaaggaaatgacttgattgaagaggccattctttaaatgtatcttactgctcaatttcaccattgcctattgtagaatgcgccctgcccgctcagcatttgcctctaggcagaccaggactccttcccctccccaactaatcttccttctcctgtatcttattccctagggccacttgcacctttcaaaatggataaattaaattcccctgctccccttctaccaactttaacatcatatccttggtgtatgatgccctacttttcattgttttgcctaaataagagtatgcttgggaattttaggcttagggctgggaaaagatgggatatggaatcgtcagctatagattgccggacaagaaattttaggagcagtagacctttcaaccgccctcaataggatggaactgactgtccccacaacctatttccctttcagtggcttgctccagccaaggccccttatttaagagatctttgtgcgctctgaaaaccatgcatatgccagaactaggtgctctgtttcatgaaggcagtttgataactgaatggactttggaagtgcccagtgtttgactattaccctggtgcgatgatcacactgggcgtatcattgtcacatgatcccatgtttgttgatgaaaataaacagtggttttcaaaaaccattttcagtgccatggtttgtcataaaacaataaatagaaaagcgcttgatgtacctgccaacttttcacccctatctaagagatggcgaagctccggctgcactctgtctgcaaataaggaataaaactttttatttgtgctatattggactttgggttccaaagcatcacattgtttatggtaggtacatgtggagtcactgtatttataattataagagcaaactggtgccattggaaaaaatggtctttctaaatagtgtgtgaaatatgaaactagtgaagaataaaatcaatatggaaatgtaaacttctatgaaaacatttccttacccatttaagtttgtgcattctgaaatttacaatggccatcaaacccagtgactcaaagctattggaaagatatctgtccttttaaatcctacacttacagctaaacaacgtatgggttcttttccctttatctctggaaaagcccgactgagctggaatttgctccccaaaggaaagacatcaggcagaatcctcagagaaaggggcttagggaccccagtagaaataaaatcaggatagtagtgccaattcatttctggggctgctggagaagttaggcttctgggatcattcatccatgtatcaatattaataaaataaattcttctattgccaggactgtcaggaatagctaaagatgtaaaagatctaaaccagtgtgttctttcagagaataagttaaaaataatattttatagagttaaaaagaaaagcacttggattttttttttccaatggctggactcagttggccaatacccttgtttgcctgctgagtaactctttggctggcaattgatttttttaagagctgtggttatgtgctagttcattagcatgtgaataattcttcatattaagttttcatttgtttgtcgtaaatctctaaaccctgcaggaaagcagaatatctttgacagctttcaaacttcacttctatcacacacagcactccaccagcacctctaggaaacagtggttcaaaaggccctgccccaagaccccagcatgttaagagcgttagtttaaaatctccagttcatcctagaacaatcattttaaaaggaaaaaaagaagtggggaagtcctatagaaagcaatggaaagggaaaagttctcaacccagaatcggggcttaggttctagttcctggtttgctataaatggcactttgactttggaatgtctctggcttccgtttatccattagtcagagaatgatgggacagattacttctgaagaccccttatgtcctataaatctcatagttctcaacaagagggaaacgggaacaacaggggcagaaaccaacgagaggctgaggaaaccaaaccaatgagttttggattgtagctaaccgaggagaaccaggtgtgtcaaaggtgatgaaagtcagatgtgtaaaaagcaagaaggaaacaaaatgaagaacatgagccctaagaattcagtgtctttccctggtaaaactaagaacatcaggaaagccacactcgatgaggcacacatttttccaagccagttttcactctgacagggttacctcaagtgattgtttgagagagggtagaggggttgactacactcattcaatctgccaaattagaaaagtcacccagaataccctgtgctttttgagtgattttcatgtttatctcccgtagcttgctattttgttattcaaaaggagtgtaaacttagggcattcatgtataatacctttcataactcatgttaaaatgctgatgttattggatttctcaggaacactactgttctatttctccattcaaaaaggtaaaaaaaaaattaattactctattttcatcattaatcccatttcccccattgtctttgtattctacataggaagcatgccatagatctataattgaatttactcatctatataaaacagtacttttaatcccatcctgaaaatcaaaatatatttttgaaaatcaaaatatgtcaaaattgaaaatcaaaatgtcaaaatattgaaaattgaaatatatcaaaattaattatatttgatgtatccctcaaaaaattgatttctccttacagaaatcattttgctttcctggaaaaacactgggttcaagtgcagctttcttcattccgttctggtctgtccagtatatgaaaagcacaagcacacaatgaccagtgacagattcaccatgaagctaatgaagcttcatggggcccttcccttgtgcagaagtccttccagtgcttggggaagggccgaagcaattttattctcataatttgtaatattttccttagagagactccactactgtgtatattttatgccccacaaaacctgaattcaccccatcatgtcccatttgtaattaagctttctttcctgttaaggagggacgcttacccagccctttgatgtacggtctgaagataaatacactgttagcccccaactagaagtgtaaaatcattaagacaaaatttgagaatgatacggctcctataatggcaatctttggatgatactgtccaagctgatggaaagtgtaaggactccactttgctttgtaaaaaatacaaaaaaacagccatggaagtgcagtacattttgtatggaacattgtaccacattgtaccaaatgtcatgttaaattaatgattcaagataaaatgcagaccaaatttgaccagggttttaagaggttctctctccataaagcaggctggccacgatcttctcactaggtttgagggtaaggaggtcccctgtgaaatatgaaagtgaactctctgctatctaagaattggtgaattggttgcaaagaaaggcagaccaggcccacccagggatcactcttgcagtttgacagatctacctggaggctgaaagaatctatgcagccttcggaaatgcagtgaaaacagtataatcagatatgactagggaaaaaataaaacaactggtgttcatttgcatgtcaacacccagaattctctgctagttcacctcttcttcagaatgcagaaaggattgaaaaagctggaatggggccgggcatggtggctcatgcctgtaatcccatcactttgtgaggcagaggtgggtggatcacctgaggccaggagttcaagaccagcctggccaacatggtgaaaccccgtctatactaaaaaataaaaaaatttaaaaaaaattgccgggcgtggtggtgggtgcctgtaatcccagctactctggaggctgaggagaatcacttgaacccaggaggtggaggttgcagtgagcctagattgcgccattgcactccagcctgggcaacaggagcaaaactccatctcaaaaaaaaaaaaaaaaaaaaatgaaatggtttggcatgatggtggggtgctgattcctctctctgtccttgagtatttactgccaggaaatcctgaccaacatcaattgccaaggggttaaagtcacattgttgttaaattgggagagaaaattagcaggattttgtgccctatgttcaactattacagagtttcaaaaacaggaacctggagctttatatgaggggacaggggaagtaaaggggaagagtgacaagggtgatttatcagggcatagttccagataaatcacttacatggaggtgaaagaatttcatgcatatgttctgtgccaagaagccaaatggttgagcagaagctctgaaagttgaagtgggcagttctgggtacagtctttccacatgtgaaaaggtgatgattttatattcatgttatttgtactcctgcatgtgcagttggtcttttcaggtgtccagatcatcattttctcatgacatgaaagaaagccaataaaggctagttgtggtggctcacacctgtaatcctagcacgcacttagggaggccaaagcaggacgatcacttgagcccaggagttcaagaccagcccaggcaacatacatagcaagacctcatctcaaaaaatgaaataatttttttttagaaaaagaaagtaaatatttcattaatataaattataatacactgtaaaatgcctggaggacaagaaacacgttttctctaggttctgtgaaagcatcattatccattcacatttttctcataattagaacctgacgttctggaaaaatacagtaaattttcatcgatgttacttgctctgccccccttgtattcctcccattaataatattaatcctgaaaagaaaaaaagaaaaaggaaagaaaccacccaagcaaaatgtttaagaaatacggtaaggacagtttggtcccaatttccttaaaaattagagccaccaagtaaacctgtttgggggtcctcacatctgtcctcttttggagtttgctaagtagtacagttgaagtgaattttttggtaacaaaagtaaaaacttccagaataactccagtaaagggtgttgatgtgacgtacaagtttggaaatatatttaatatctgagactcctcaatgttggtgttatttcctccagtttagaacaaacttaatcttttgatgaaaatcatagagttccatagatatgaatagaatctccaaccagtgcatcttgaagccggctgccacggccactcatgcaccttctctcctttcaggagagaattgtcagcatctctgctcaaaacaatctttacttttagtccatcagagacttcatgtttgtcgtgcatgcacactcacacctctccacacatatgcccactccccacacacatcctgcttctgagaaatgcaactagaatttcctccggagaagagatggaaacccctgattgagaaatttaaggcctaggaaaggtaaatgacttttcttaagtcacatggctcaccacagaaccaaagctggaacacacataccctcagctcttcttccagtgctttcaggtatacaagtatttgaacaggattcaaggtttaactccttatgtgtcattcagtgtatccagtgtaagtaaaatgttaccccttagtcagaacagccttgagaatttctcaatgactacaaaccttgcttagttctatacaagggaagtaaaagagagagaatgtcatgaccaaatgacttaacttttgaaggcagcctattgcaaacttgaataattggggcatgtattttattgattgtttgacctataaggacagatattttaaaatataaattcaaaattgcttttttgcagcattcacctgtaggccttctatatctgctctttgtgaaatagatggcttccagagcattaaaaaaagaaatagacattttcttggttcaagagctgtaatctgctttccgagtgatttttcatagttaagcatattttatgtgcacatagtttcatttgagatctgagaggatttcatctaaaacggaaaagttattacctgtgaaggagaacaaaggaaaaggaaaaagaaattttaagaaaaaaaaatttttttaaacctgtagttactttatgttcaagtgggtattttcaacgctgagttgctgaaatggttttttattgaaagaaggttaaaagtgtatttcattgaaagccaagataaacagtagattttgtatcattttaaaaatcaacaatcggccgggtgtggtggctcatgcctgtaatcccagccctttgggaggccaaggcaggcagatcacttgaggccaggagttcaagaccagcctggccaacatggtgaaaccccatctctactaaaaatacaaaaatcagctgggtgtggcagtgcatgccagtaatcccagctacccaggaggctgaggcacaagaattgcttgaacctgggaggtggaggttgcagtgagccctgattgtgccactgtaattcagtctgggcgcagagtgagactctgtctcaaaaacaaacaaacaaataatataaaaatcaacaatgaagactcactccccaaacaaaagaaatcaggattcttagccagtcataggtaaagtgttacagtgtaaattgaagggaaagaagaccaaaattggtgaaatatgtttggtcccagaagataattaagatgaataaaagaacttgagagtattttctcattattaagcatcttcagctttaaagattttagttagcaaagcaagtttacataaacagttttctgaacctgggatggcattcactgtgagttagaaatctccaagtcatccacgttttccctgttttatttgcagccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggaggtaagatttgtcttttgatcttctatgaaagagggtgggatgatggtggggtggccaaaagaattttggatttccttagtgttagtctgcattgtcactttaagtgccagtggcatgatgccatgaatcatcactacacgtgcaaaacactgtaccaagaaagagtgtcataggtttgcggtgtgaaggttataagtaacccaggatcttctctttcatccctcaacaatatattttttccagtcaaatgccctcttctcctttttctttttcttttcttttctttgtctctttcttttccttccagaaaggaagattagaggccagtctaatctttggttcctgtaagtaatggcatgtataactttgcttaagacaatgctcacttgatgtagagaagggaccactaagtatttctggtcaaatcatgctcctgccccaccatcagtaagatactactttgaattgcttttgtgatatcaggaattaaggaatacctactgacctccacccactctcttgtgtggattcctctgatggcttcccttaaagtacctttgtgaggtagttggttgtgattaagaatgcaatgtgaaccgaacacacaacatagaaataaatttagttatttagcaatttgttgtatttttggccctgcaagtagtacatgatctgactaaccaattccaaaagccagattttcttctgagtgtgacttttttcttttttttttcttttttttttttcctttttttttttttttttttttttgtgagacagggcctcactctgtcacccagactgaagtgcagttgcacagtcatagctcactgcagcttctaactgcagttagtaagctatgatcatgctacttcataaaagtaatacgtggccattttacagttgggctcaagtgattctcccacctcagcctcccaagtagacaggacaacagctgcacaccaacatgccctgctaattttaaaaatttttttgtagagatgaggtctcattatgttgcccaggctgatctcagattcctgacctcaagcaatcttctcaccttggtctcccaaagcgctgggattataggcataagccaccacgcacaatctaaacattactttcattagcctctcatgagtagaagaaagttttactttcatctctctgtataaaaattgtttttaagtggcaagttttcctattgaagtggactttaggtgagctttttgtatgtactctacagtgtatcctctgtgaaaaacccgtcgggggatagtggtaaactgtatataactgcacaatgtattataaagagcacgatccctttgtcatcttttgttgtccagttgaaaggagaatgtttctgaaatcaggtgcatagtgcagtagtcataagaatagcaaacatttatttaatacttgctgtgtgccaggcagtgttctaagcacttcatgcatatttattcaatcctcacaacaattcagggaagtaaggaccattttacaaatgaggaaaccaaagcactgagaggttttctcatttgcgcaaggttacgtggctagcaaaagatggagacaggattgtgagccaggcatgctggctcagactctacactctctaccatcacatcatgcggaataccggcctttaaatgcctagggtgcaaatagatcacagtatggcatagtttacctttggagctgtgaagtccagggtcaagtcgtgattcactttaaaataactacttgatattgtgggtttttgttgttgttgttgtttgttttttgtttttttgtttttgaggcgaagtctcactcttgttgcccaggctggagtgcaatggcacaatctcggctcactgcaatctccacctcccgggttcaagggattctcctgtctcagcctcccgagtagctgggattacaggcacatgccaccacactcggctaatttttgtatttttagtagagacggggtttcatcatattggtcaggctggtctcgaactcctgacctcaggtgatccgcctgcctcggcctcccaaagtgctgggattataagcatgagccaccatgcccggccgacgttatgtttaatagaacaaaaatatactacctggcatggtttaatatcttgaccaaatttacttcctaaattaatccctggctgtctggtatctttgattaattcagcaaaaaaggatgagattccagtatataagaggtttgccagaagaaaaatattaaattttgaaaaaccagattagaaaaacagttgatattatttatctagtattttattttacttcattttattttattttattttttgagatggagtctcgttctgtcttgcagtggtgcgatctcggctcactacaaccgggttttccgcctcccgggttcaagtgactctcctgcctcagcctccctagtagctgggattacaggaatgtaccactacacccagctaatttttgcatttttactagagacagggtttcacaatgttggccagtctggtctcaaactcctgacctcatgatccacctgcctcagcctcacaaagtgctgggattacaggcatgagccactgcacccagactatttatctactattttaaggcacattttatttttaataaaatttgaaaatatattaatatttaatttatttcaaatatttttcctaagcatactatatatcccatgtctattcttttcacttagtcaatttcccatgtcattacatactctttgttaatagtttttgttaactttttaaataaaagtattacatggtcattttataattgagagtacagaaaggtataagtgaaaagtaaagggctttgccctcaggataaaatagaattaacaaagtcctatttttcctatcaagaagtttacatgcacactcatgtagatagatacatacatacacatatgtgtacgttcatagcagtttgtattcctacccacatatacgaagggaagcatttgaaatgagccattcaaaggtacttagtttctactaggcaaggtctagacaagaaacagtcatgagaattctgggctttatgaagtgagatctgaatctcaggcatctatcgaggatgagatccacctccccgattgtgcttccttagagtaagacaaaatttctcaattagtttttcctcctattccagattttccattcagctaagcaggaggctttcatccactaaacaaatttctgatcctacccagtcttaacaagagtgattgttttctcctctgcaatttattcgaaagtctatcagttactttggtggtttcagaaagaagtgcttttgttggggatccagttggcctcattctgagctggctgtggattcacagaagaacttcacttcagcaaaggctcttagggccccagactaaaagaaagatgagcaagatgtgcgtcatctaagagtgggcgggggtaaggaattggggattaatgggggtgtccctagaggacccaaagaggagatttttagatgaaagtaactgatttgacccaactcagtatttgctggggaaactggagttgctacctaagattgctgccattgaacttcagccttaaaaactgctgataccatttgattggtacttagatttgcctgggcttagcgtctctgctgttcactcagctctcaaaccaagctgctgagaaagatgacctagttcttctcgagtctttctcctctctctctttctcccctgagcttgggggcaagaattagactaaatgaaaggaacagcaacctattctagaaccaaagttcaggacttggtacctttttaagggcatttcatgttcattctctcattccatcctgacagcgctcctgggcttttaattctcatttcacagaaagaaaagtgagggtcgtaaacttaagtgatttgtctgagatctgacaaactagtgccaccgtggaactaacactgaaacctgggtgtcctaactgtcccctctggccctggccagtggactgtggtcagcacactcactcttgtgttggtggctgcaacctgttctctattcactatatccctaaggtaggcccatacctagaagccaggaacagcgcttccttggtcatcatggtaaacaataacttcccttgcactccctagtcttactgacaggctgggcggtgtcaagagtaataaaactgcctccagcaaagccatgtttgcaactggcgccgcagcatcatgccagccaccctagcaaactcccaaaacctacccagcagccaaagccaagcgtaaagctcagtgaagctgacaagccccaggacactctggtggatgttttgcccccttgagtgtttgctgttttgtgaagaaaaagtgtaggagagttccagctggaactctgcagcaggcaaaagctctttttgttaattcaaaacagtttggaatccatttcagttcttcctaaacctccaagatacgggggaggaaattcactggattttacaatatatttttcaaggcaaattgccatcgccgtcctaatgacagagaagctgccgatatcactacaacggctgcagatggcaagtcatccagcctcctcctgtgccctcctgagtctggcttggtgacgcaaaccacctcaagggcagctccttctttttccagcagtcccagcactgttccttctctgtgaagccactttggatggctattcttggcatgatcatagacttttctgctgttgagtgggcaaggagaatagggtagaagcaggggaattgttctcattgctatgcatttatagatcaaagaggagcagatattttatgttaattggataacacctagttctatcaggtcagtaacctggggtccctggggctcccccatgggtcataccagatagatagattttttaaaaatttgttggaattaaagtagaatcaaagcctagtgctagcccagaataagttattcaataaatgcttgttgagtgaataatcatccgaaatgattataatactgcctaccattcgttgaaagcttcagtatgtgggagaatctgtcctgggcactttatatacacccataatctgtttggatttcttggtaggaagactacatggctgcatacatggtctttcattacctccattttatagatggagaaaatggaaatttaaagaggttaagcagtttgccgaaggtcacagagctactaatcggtgaggtcaaggttcagacccaggtctctcagactttaaaactggtgcacttaaccattagactctactttttgcgtattgagatgtggaagcatctcaattaattgcttcagtcttggagttctttggcggttatcaaaaactgcctatttccatattgcctccagatattgtaattaagaatttccaaggccaggcacagtggcttatatctgtaatcccaacattttgggaaaccaaagttggaagatcccttgagcccagaagtttgagaccagcctgggcaacatagggaggcttcgtctctacaaaaaatacaaaaattagccaggtgtggtggcgcatgcatgtgtagtccaagctactctggaggctgaggcaggaggattgcttaagcccaggaatttgaggctccagtgagctgtgattgtgccactgcactccagcctgggcaacagagtgagatcctgtctcaaaaaaaaaaagaaaagaaaaagaaaaaagaatctccagattatagttcagatattacgtattaatatccaaagccctccttaagacaccattttaatctgtctaacaaaattaacaccctaggttttgacaattgcttgaggagggagtagggcctggtgatagagctaaagactagtgttctggttctttaatttgttcagccagcaggtacctggaaataatgatactgtttgcagaactccccacaaaaatggacagtcaactttaaataactaagtaaacacatctctgcttaatcagataccatcttatactaggttctaatatagataagtggttgcagaaacatttatgagaggaatgttaaattgtcgaaataccatccagtcccttcatttcttcctgcccttcagaaacaaacagaataaccctgatgcagctgtcacggcagaacactcattccagctcacagaacaccagtgttcaatcagcactgagtttgaggagcaccgggtttgggagtattcatctctcttccctgtcccatagctgcccttcaaactcttgagactgttcccagctctaaaatggaaagggtcgtcttctctctggaacaaaagacaggatgtacttgcttgaataggccagtgctttcctggaggaaactccggcttatggagcctctgcttctgcacagcccagtgccttccaccccctcttcatctgctagcatctacattactagttaactggagaggagaccaaacccaaaatattacaaaacatagatattaaaaatactgtgaacaacaatcagcccgctttctcccacctctcctgtaccagctaaatatttacctccctcatccgtagagggtttttggacaagacaggctggtgcctacatggtgaaagttgtttttctctcttttcttgtaatattgcaaataaacaaggatatctgctttctcttgagcaggacaacagccaaagagtattattgcatagttcctgtcccctatctgggctacgattgtgtctgagagtaatagcacttatttattaactggaagaaattttacaggcacctatgttgtttctgcctagcttctgaggctcctctcttaggccactcctctcaccatgcccccacagctagttggtaaaatggctttgaataatgactcgctttgagttatctagaaatgtcccattagttcactattttcataaccccatagacttggtttgacaagggtgaggtttatttatgagttctcaactggcacccaatttttaaaaaccacagagctgggggcggggatagaatgatggggaggagatgaaacatcctagaatcatctgatatactttaaacatatacatatacaggcttttgttgtttgtaaaatatagaagcatctttatctgtgactggttgagaaataaaatcccttccccagcccaggcatggtaggttgggatcatcccagtgagcgagcaagcaattggatttgccctcagagactgactatggggtcgaatgctgagtcattcctgtccccacaccagcagtcctggaagaggctcagtcgatcagtcagtgggctgctttctggagcactttatcattttgggctctcacaatgtgtgtttaaactctgagtgaccccaggcagccttccagactggcacagttcaccaagacgttcagacagatcatctgcaagtgaggaagaatgaaaacccagcactggttcaaatcactcctagcagaggtagtgaaggcatcactcagtcctggagaaatcttcggagggctcaccagcgtcacaagtaggtagaccagaagaggcaggctggcccattgcaaagccctggaatcagagggacaggagttccaaatccccactctctctcttcctagatgtgtgcttgcggcaattatttatctctctgagccttaatttccttatcaggaccctgagcaaaccaaataacatgatgtgaagcctctggcacaatgcctgggacatgttcagcacacaataaatgctaattttcccttttgccctatatgatatgatttgaagcagcgccactcaatcctgccagtcacattgctggaaatgccaccaacagtcattcttaagatcgcttattacaatataaatacccctaggggatatcagctaatcgctttatcaactatcgctttaaggggattaggtgtggattgagaacaaaacccagaaggaaagagatcctggaggaaggggagggcttggaagtggggaggattcggacgtcctgtggcccccgaaggagacggggaatggcaggtctgctggattcccagccttcaggaattcccatgaacttcttggggacttcatgtgtttagaccatatttagagagcgtgcatgtgttttgagatcacaggtttttctgagagacattgggaaggaggacagcgggggagtggagtggagagaagtcatacctggcagcttttaacttcacttactgcccttcatgtgctgttgccatttccagaagttgagggagtaaggaagggtaggagttcttggtattcccttatctcttcctttccctccccttatcctgcccagagcatcgcagggtagagccaccagacggattcagggcatggagatggcaggttagtggtagacttggaagggatcgttcttcctatttcagcaccacccttcttcctctacctcccaccctgcatttccagccccagtcagattccttcttggacagagaaggagcagaaatgtacgtacatcactaggcttaaggggggactgcagatggctcccctggtcctgacaaaaaggtggggagcaaaccgcatggctggacgtaaattgagtgacctggaatgactagaacgacagggggcctctaaccccagggtgcacagaggtagggacccaagggctttccggggtcggacagaaatctcgggttccattttcactctgagagacccagaaatgacagagcccatgctcagtttccactggtggtgctgttgagtggaggggctttgaacatggcacacaggaaagggttgcccaccctgtcaccagatgggcttgcactgttttgtggtttgggagttgcatattggaggtgggagtggagtgttgagatgaggcaagttgagatgtaatcgctatttaatgggcagatcaaagaaaacattggctggtttgatttttattatggttatcccgctccaccatcctggcccagtcatatatattattgttatcaggcatagataggggaagcaattaaatgtgaaactgttatttaaaccggcaagtgtcagaatgttaacccacttcagagcgaaggctctaccagcaacatgtgtgttcactgcagaatgtgctggttacagatgatctttatctgtttgtcaaagcatttgcaagatctctattttatgtcatcccctttccctgaaagcagcagcagtaaacgacattgctcctcaaatcatccatggctcagacctctgattaatttaagctggccctgctagcgttcttataaatccccagcaagatgcaggcccaggagtggaaaggggaaaacatccggaaagcagcggggggcagggagggggaaggctgaagggaaaagaaaaaggctgaagggagcaataattgaggaagaaagaataggaaaaatgtagaaaggacccaagaaaatcagagaaatgagaggaaaagaaaggtaagaagaaaatgaggcaagtttacagagcagtaatgaaaatagtaatagctaatttactgtacaacagacactgtgctaagcactttccgtatgtccctcagtcctctgaccaacactatgagttaaattaccgctacagctccaattgttaaagtgaggaaactgaagtatagaaaggttaaggaacttgcccaaggttacctagcttgcaaagttgtaattccaactgcgtctcactcagctggcagtgtgcacccttggccacacattagaatcacccaagagctattaaaaatcttgaaggtcataccccaggcaagtgaatcagaatctctagggatgggtcccaggcattcgtttgcttttttagtctccccagataattttaatatgtagccaaaattgataatccctgcactagacgaagctccgattcaaatttaaatattaagaggacacatgtataactttgctgaataattttttcctatcggtaggatggtgggaaggaattgctataggccacaccatgatactttgctgaattccgtttaggcccactgtgattctgatggttggatcagaaaagtaccctcaaattcccagcatcatttcttcaaggaagtagtgaattggggcaccgtgggttttttgttttgttattgttcttaaaccaccttgcctatgtgcactcaactacaggaacgagaacttgcctgaaaccccaaacgtgtctgcatcaggcattatttttcttgagctcctgaatttctgctctaaccaagaacaactcaaaaaccttcaatttcataactgttgatatgccacccactcctacttacactcctgaccccaaccccatggaaactgcctttattcgaacaaacacaagaattataatatgttctaaagttcctctacctatttcattctcaccatacgcttatgaaagaaatgtcattgtcttgaaaactaagcctaaacccagaaagattagatgatttgtccacaggcacacagaaactaagtggaagagaaacaggactcaagtcttcagtttcccaatccactgcctcctagaacatgcctgtgaactgagggagcagtgcaataaaggaaacttgagaggaagcgcaaaaggaacttaaattgcaaagtactgggttccctaagtagccctgcctcccctccagttttcagcccacacctgaactaaggtctttcattgtctgtggatcaatttacagctgccctgcaatcacatttgttttgtttgtttgtttgttttggttttgaacgccctagggacagtcggtttcagattagtctctatcagagagccaatagggaaagatgcagaaagccaggagagcagctcctagaatagagacaaaaccacctgcattttttctgcctcttcttcaggagactccactgtggtcatctggttccctaattgagacacctcctgagaaaatctgtgctagggaaacacccagcccaggtgggcagatctcaagaggaccagaacgtttgaatctgcttcagataaaccctccacttaacagtaccagatctggacgagatggaagctttgtagatttgcccataatccacagtgctctgtaatcaattccaggaccgtgtggatggagaccggaaaggtttctttcccaattcttcacagcctggggagtagggaactagtaattgactccagcctcctcgagtgctaagtcctggagtctgagtcacacacacttcccaaaagggccttctaagcagcctaccccagcagagaggacccttggccctggccctactccagactcaactgtaacctcagcaaggtgcagggagaggatctcaggtgggcctcctggcaacagtgccttttcaggcactaggctgttgggaatggagagagaagagaaaggccctggcactgtctgggtatttggatggatttctgtggcacaactgtggcacctggcttagctcagtaaaggactgagtgtgcgtggagcagaaaggggaaagagactagtggggagctggtgaccagttggagggtggagggtagggaacaaccctggcagatccattttgcccttgactagagcttaaagaccaaaggaagcgttcttgtttttaagtaagtcaggtgttctaagtttaatgttaatatgctttttcaattagatgtttgagtatatttccccagttgaattatgtagagggaattacaaatgagaatacatcttacaatttttgaattagaatctttgagattatctatttagtccggtctgttttgtttagacaagaaaattgagcccattgatcttaatcagtttgcccaaggtcacagagctggtgagtgaaagctttagatgtagaatatgcaacttttctctgctgccctccttccctaaaccatcttgccttaacggaggctcagtcagggggacaatgggactgatctgtaaatgatctaacttgtcattgcagaaaatatacttactccgtggccacaaaatttcagcccttcagccaagcttcatccatcacatcataaagaataacttgccaaagaggggtttgaaaatccaaaccagatccctctccactcctagagaggccagttccatgacactgcaccggagccaagtgtttccagcaagccctgatcagttgcatgttagtccttgtttgtatgataaacgggacctagtagattaacatcatctcctcagcccaagggctgaccccagtggtgctgctcaagaggaaggaggaggctgggagcggtggctcccgcttgtcatcccagcactttgaggggctgaggagggcaaatctcttgagcccagcattcaagagcagcctggaaaatgtagagattctgtctctaccaaaaaaaaaaaaaaaaaaaaagaagcaggtggaggaaggaggagctgcagaaaggctccgggagccagtgtctagtaagcagaggcctagcccaggctgagtggtcccagcccaggagggcctctctcggcacctgtctttagatgcacgtctgcctctggcctttgagatgcacacattcatcaagcaggaggatctgtagtcattaaaccaaggtgccagtctggggcccagccttcaatgaagcatcagtggctttttcattcccatagagcaactgcgaggaagaccccatgctcccaggggcccaattctccaggccaggaccagatcatttgttccttctcagaatctgagatcttttgctgatggttccaaaattgaatgctgaaatctaaaaagaaaattatacttactctggtcaatgggatatgttggagacctgagagtgaaaaaatcaaactgaagaccagtttccttctttaatggaagaaaagtaagaaagttaacttagaagaatatttagagttctgaaaatcccactctgagaccactctgccatctcacattgttctcttgagccttatctcaatggataaaggtcactagagtttattagacacaggaaaacatcgtttacagacttcttcattgtgtagggattctgccttcaggcctgttcaccagccaggagaattgtgctttttgatccagggctcttggccagaacagccttctcgctcattaactcagtcaaccaaatgcttcctgtgtttccactggtggttcagaacgtagtctctgccctctgatacctcacggtctaacgggggagaaacaagaaagtcagaacttacaatacaagataataaggaataagagcagagcctttggaaccagacagacttagatccaaatgtcagctctgcatttactagcaagtggtctatcttggtaagatgcaactcttttctctaagtcttaatttctccctctgtaaagtatgacctcatggggttattgtgaagattaaatggcatatcgtatataaggcccttggcacgatctttggaaaataataaccattcagtgaatgtaatctactagtatagtagcgattgaggtgtttatagggtgctatgagggcccagagaaaggagatgagatgaacaggagagaggaagggatactgttgaggaaggatttcaggatggaatcccaccacaggctgtattttgaagaaatggttgaagtcaataagaagagtgaagggaaggtgagaatgtttcaggcaggaagaataaaatctgaataagtgcagagtcctgacagaacatagggtgtttgaggaacttggtatggaaatagattaatatggcttaacatggagcaaaatgaaacagaactgagactagaggatgaccaggaccaggtcatgaaggacattaaaggtgggtaaaactcataccatgaaggagagaagagttacagtttttaaaagaaaataaatagccttcaggagctcaaatttgaaatcaatacgagatagatgatcaagtgaatgttctgtcttcttgatgagcctgactgagaaaaccttataatctaacccaaggcaacaaactgagaaattagaaaataaaacttagagattagaaaacaaaaactgaaacccaaactttttacttggaaatttaaaaacatgcttctatataactcttaggttaaaaatgaaatcaaaattgtaagacaagctgtttagaaaagaactatgagagtaccgtttatcaaagcccatgggatgaaaccaaagtggcactaagaagaaaatgtggaggcttcaatgcatttattagaatacaaagaataccaaatcaaatgaattaagcattcaactcaagaaaactagaaaaagagaagaaagtaaacctaaagaaagttttaaaaaggaattcaataaattaaaaacaaaacacacaatttttaaaaacagacttgattaataaaaccaaaagctatgtcttttttaaaaaagcaaaaaatagataaacctttgacaaatcagatttttttaatgagagaatgcacaaataaagagctctaagagctgggcatggtgactcatgcctatattcccagcactttgggaggctgaggcaggaggattggttgaggccaggagtttaagaccagcctgggctacgtagcaagaccccacctctacaaaaaatttcgaaattagttgggtgtggcggctcatgcctatagtcccagctacttgggaggctaaagcaggaggatcacctgaacccaggagttggaggctgcagtgagccatgatcatgccactgcactgggcaacagattaagactctgtcacaaaaaaaaaagcgttaagttaaggagcgtgaataaaaataatacatttcatattctaagacaatatcatctacaactttattccaatataaattactaaaactttaccatataagtagtagaaagcctgaatagataaaagctatggaagaaaaattaaagatagtgatagatttatcaccaagctcagatggttctgcaaacaaattctaagaaaccgtcagggaacagatcattactgcgttgacacagaaggcaaacctctcaacttggtgtataaggctagttaacattgttactaaaacaggcaaagaatggcccccaaaataactctaaaccagtatcacctacaaatacaaaaactctatataaaatattagcaagtgagtacaagagtataaggaactctattaatgtaattcactgtgctaggttaagataaaaccataactcttcagatatcatagctctttagatagaaaaatgtaaaagtatttgataaaaattcaacaacattcctgactaaaacaaattaaaattgtaaaacccctggaaagccaggagtaaaacatgttctccataatctatagcaaacatcatagttgctgataaaccattagaagcatttccttcaaagttaggaataaaacaagaattgctactattgctactattatttaatcccatattggaggttttagccaacacactatggcaagaagaggaaatgagaaaggttaatgctgcaaaagaagaaataaataaagctaccattgctgatataattatctatccaaaaaaagtagaaatccatgattaaaagctatttgaactgataaaagttcagaaaattggaattgtttcaatatactaaaatcaattagttttctgcacatcagtggggatatattagatgtaatgaaaatgaagggtccattcacaatagaagctataaagtatttgagaataaatctaacaagatctacataaagaaaaaagtaaactgcttaaaagtaatttaagttcaccatttgcaaattgaactaaagaaaaatctaaagaagaactagtgaaaattgcttgcaatcttaccactgaaaagaaacctctgttaaaatgtatcagtattttaaaactgtgttttgtcctttggaaatatgccatattaagcaaacatagcataagcaaattaagcaaaaagacaaacctttttttaaaagcatatttgtgaaaaaagcatatttgaagctatgataagaaactgagtagaagctataaaacgtagattcatcaggaaggagcagaagttgaaaaggagatttctggctgggcacagtggctcatgcctgtaatcccagcactttgggaggccaaggcgggtggatcacttgaggtcaggagtttgagacaagcctggccaacatggtgaaaccctatctctactaaaaatacaaaaattagaaaggcgtggtggtgagcacctatcatcccagctactcaggaggctgaggcaggagaatagcttgatcccgggaggcataggttgtagtgagccgacgtcatgccactgcactccagcctggatgacagagcaagactccatctcaaaaaaaaaaaaaaagaaaagaaaagaaaaggagatttctgagtagaaacacgttagcagaggaaacttcatttggggaacaggattgttttgatgccatgctccctcagctgaccacacagattacatcctggccagaaaaaggccctgcaaagagctctgatcattttggttctgattccatccttagttcttacccattatctgcttacccttcctccccacctatttaagatacaaagcaaaacaaaccaaaaatacagatgagttgcttggtagagctgcctaggcctccaaggcggggcccagaggattttttgactgaaccccctgttgtgttttccatatgtgcttccccagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgctgatagtatttgaagactgagtcttgtgtgtttcccaccctagcccccaggctttcttttttaccccttttccttctcccctccctccctccatccctctcactcttcctccctcccttccctcctttccttcttcctttatttttcttttctttcttagacattttaaaatatgtgagtggaactgctgatacactttcattctcagtaaattaattttttactcaatttacaacttttcggaactctgcatctgctttaacaatcagaactaagaagggaaggggaacttcagaatcagaaactgctcagagcatgtgttttgtagcctggatgtgctgatatgcagcatatccctgggattacccagaattcagtcttcttccacaatcctaaccgagattttcacgcaccaccagcagcctactcgtatactacctactaatcaatgccactgcgcacccacagagccagtggccagcaactgagcactgctagaaactctggggaacacagaacttttttaagatttggtatctgcgccaggcatggtgtctcaagcctttaatccacgcacgttaggaggccaaggtggatggatcgattgagctggtctcttgttcgagaccctgtctccacaacagttttaaatattagccatgtgtggtggcacacacctgtagtcccagctactcgcaggctgaggcgggaggattgcttgagcctgggagttgaggctgcagtgagctgtgatgatgccactgtattccagcctgggccacagagtgagaccctgtctctaaaaaaagataaaaaagatttgacacctgccaaaaagaatttaccgattataaactgaggagaaaagattaatcttttttcatacagattcaaatacgcagatgaaatcacatgccaggtgaatggtaagagtttgtaggaagtaagatgagtgaagattggaatcccagagactgaatctgtggatttgctgaagagggcctcagggaagtgttagactggaataggtagagaggaggagaaaagacattccagagaagcaaaataacaggaacacaatgaaagaaaaaaaaaactgagggagaagagctactttctgttttctccttctgcaaggcagttttgctgtgattattcctgtcctcctccttgggaccactctgtccagagatctcttttctgaactgagaggctaactatccgcatcattaatggaatgcttgcctcccaagcagatagattctaagttccctgaaggcgtgacaatctattcattcttggcacagtgaatagattcgttgattcaatccaccaaattcacttgcattggctactcatgaactcatcatactatgtctttgaagaatgccttacggggtgtctaagggagagaatagagtcatgggttctccatttctgtttctgactgggccaataaagccccttcctcatccctcttttccacttaccactagggacagaaattaaaaaccatggcttcaggctactaaaagcctaaaccaaaccaaatcaaaccaaacaacaacaacaaaataaggcaggttggacaagcttacgagtgtaaccaaactatctggaggtgtctgttgtgcgggacgcttatttccactgacctaaatttccctgccacttctcccttaatttatcttgccttaggatatttacactcaggagacataactgcagacttgaggttttcaagccaaaatatcaagaaagacctgttcatcttttgcttaaaaataactatatctccaaagaatcaggttatagaagtgagtactgaccccagccctaaaaatgtaggattcctaacccttcaggagagacctttctgagctcaaacctttaggatgacagatagacaaagactgaagccattgtctaagtaacaccaaaacatttggaaggaaagtgacaaattcagtcagtcatatggctctttttttttcttcctt

SEQ ID NO: 15492 - DNA, 86877 bp, Human; identical to SEQ ID NO: 15491

SEQ ID NO: 15493 - DNA, 9777 bp, Human
gcgaactctacactgaggtagccatactttaacagaggagcaacaaaaccttaaaagaaggattatcctctaagggcaagatttcaagctgctacaaaatggtgatgtaagaagtaatattgtggagtggaaggagcactgggctagatgtcaggagacgagtactctagtcctcttctgccacggactttctacaagtcactgtatctcactgggcctcagccttcacatctgtccaatgaagagatcagatgggatgctttctgagctcccttcaaatagtacatcagcctctatcttggtctgaacattgtatgaagaaccagcctggatgctaacccgggcatttcatctttcagtcagactcagctctctttcaattcccttcttttcaaatatcactaacaccatcaaaatgaaaaggtatcctttgaaggaaataatgttgaccctgatgaaaagtcagactcctatgggaactaagatttgaacagatactgggggtatctggcctgaggatctcagcattcctggttgaggccagccaaggatgggaagaagaacttcaaagggctttagaaatcacgtagttcaactctactttatgaagaaaaaactgaggcccagagaggcaaaagtcacaaagctacagtgacagtcagaattggaacccagcctcccactatccagtccagcaccatgtggaaacatcccacagcaataatcccatggagatttgggatttggaggcttgcaacactgtgcccaaacagcagacaaggctctggtcacagtcacccccaagtcccctgcttctttgttttttcttttacttttttttttttttttttttttttgagacggagtctcactctgtcgcccagactggagtgcagtggcacagtctcagctcacttcaacctccgcctcctgggttcaagccattctcttgcctcagcctcctgagtacctgggactacaggtgtaggccaccacgcccggctaacttttgtatttttagtagggacggagtttcatcatgatggctagggtgatctcgaactcctgacctcaggtgatcaacccgccttggcttcccaaagtgctgagattacaggcgtgagccaccacgcccagcctgcttctttgttttctaagctgtcccaccttctagaacatgacagagtctccagtgagaagggacatgcaataaaaatcaatgtagtctagggcctcgagagggctttgaggtccaaggtttgccctaagtgatgggacactttgtgttttgtacaccaagagcgctgtctccagctatctggagagtctgaggctctgggagtgagaaagggtttctaaagcactggctgcttctttgacatctctccccaccccccaggcaacagagccaagacacacacaccccaactttctctgtcctgttctattactgtttgctgttgctttggagcctcataaatagggcattgaaagcacttcctgcagctgaaagaagccctgagtagctcgtctcattcccagcgtgcagctcagcaaggggtccgtccttctctgtcactgtctcttttgcctgttgtaattctgtctgcctctctgggactctgcctgtctcactctttctgtctgtgcctctcctcactcttgttctttctgcctgaatcacagccctcagtttttctgtcctcatgcatttgtctttgtggctctttccgtctttctgcccttgacaccatcccctctcccagtgcttcccctctgcttccagatcgcttcatgacttaggcagggaaacagaggtcagggcctccttccaggcttccctctgcatcttactgagtatgcaggtcggaagagcctcgggtcctgcctccgcgggtggcctagagccaaaggaaggcggagcccgtcggggcgggattggcccttagggccacctcataaagcctggggcgaggggcacaacggccttgggaaggagccctgctggggccgtccagtcccccagacctcacaggctcagtcgcggatctgcagtgtcatgcctgggagccctcggcccgcgccaagctgggtgctgttgctgcggctgctggcgttgctgcggcccccggggctgggtgaggcatgcagctgcgccccggcgcaccctcagcagcacatctgccactcggcacttggtgagtccgaggtccgcgaggtccacagcagggggtggttgtgggggattagtatctggccagcagtacaccaggagtccagaggaaaagggaggagctcaaattcttaccggttgtctcttgctgaggctgatgggtggagaaggaccaggcgccatagcaaccttgcaagcccagaacctgactgattcataaggaaatgaagatttcatcagggacttccatagcgacctccctcactccggccatactgcaattatggagtgtcattacacaaggtgtcaccggagctatctgatgattattctgaactactagactggggacagaaaggggaggggagagggcttgcattgtaactacccgtgtctgtccaggcctataactgaggttgccaccaagcccctatggcaacacacacgttctgtcctttctcttccctctgcctggaatgccctccctcacacccttaaattcctggcagactcctactcatccttcaagggctaacttaggtctctccccttctctgcaggctcccgggctccttggtgccgcctcagcatctctaaccgtcttagcgctcctactatgctgtgctgttgttctttacacgtgtgcactccactagatcaagagctcggcaggatggggaccctgtcttaatcacatctatgggcctagtgcctagtgcaaggccaggcacagaggaagaacatcatcaacagtttttggttattaatgctcaaatggcaagagatgcaatacctcagtgcagggtcagaacatttatgaattcaataaacatttactaatatcaactgtaggcgggatgagaggccttgaccacagcaatagataaacttcacaccgactgccctgaaggggctcctcctcccttctctactctgactcctaccctgtgccccactgcacaaacggctatggagaactagagctctccagactaactggttcaaaaggcagaaacagcttagcggttataggacctaataagcctgaggggtttggaacttccagtgactgcaggggaggtgtttccaggtcccccttctcacacatcacgttgctcacaacccagccacaccaaaaccaagaactgccctatagacttcttcatggaccctggatcatccagacctcaggtgtattgcccccaccagctgctgaaggttccctcttttctcttcctatgcagtgattcgggccaaaatctccagtgagaaggtagttccggccagtgcagaccctgctgacactgaaaaaatgctccggtatgaaatcaaacagataaaggtacatgggggcaggctgggatgtgtagcccctaaggctgatggagaaagtggagtctgtgttctgggagggctggtagctttcaggtggcctggctcagtaatccttgggtctagatactgaagtggaactggatgagatttggaggcagagcccatagaatcccagggatattgccagggagggcctcagcatccatctggtcccacagctgctggtgtatggtgccactacaggtacctactggaataaaccaaggtttaggtgtttttttttgttgttgttttgttttaagagagaaaataacccagtagggacatctgaggacacaaaatcctcaactagacttttgcttacatttttaggctgagaagtgagaggtttttgtctgttaatatatacagtacactcactgacccaatattgcctttttttgtaattgcctgtcagatgttcaaagggtttgagaaagtcaaggatgttcagtatatctatacgccttttgactcttccctctgtggtgtgaaactagaagccaacagccagaagcagtatctcttgactggtaagttaaaagaccaacaactggccttaatataatagattctgccctaggggaggtagtgagaaaggagccagggtcttccttgggcagtaggctgagccaggtggcattttcttgggcataaaacagagctgtgttagtgacagacaacctctgggttaggaggagccttgtaacctccctttaaatgtaagagttcttagtacagtgaccctggccaccgtttcactattttaaggacaggctgctcacccagtgtagggcagctgcttccgtttttcaaatagtttaaattagtataagatttttggcaacttgagtcaaagtctcctctctaaaactgctccttgcaggtcaactctgccttttgcacaggacttaacaggagcttgagtctaacatagttctgtctctgtgaacttgggcccaggcaggattcctccatactgaattggctgggatagaacagttaaagaatcacacaaaaatatgactccataaatgaatgcaacattaaattattttggagttcagagaacggaactatttggtagttgtgaactatcagggaagcttcattgtgtaggtgggatctaaactggcctgaaaacataaaacaatatttagaaagaaagcaagggaaagaaaaagcacagcagtgggggagggaacaggtgaagggattccacgatctatccacacattcagcaatgaatgaccacttagtcactgccatgccttggccaggagagtggagattcagtaacaaggcacagtccttaaaagagttcactgtccagacatggctcttgatgagtcataggcactggaggctacaatgataagggcttcctagctctgaggatgtggaattgtacagaactgaggagctcctggatggaagaggcagaggcaggacacaccactgagccctgcagttcccaggtctagcagaccaggccctttcaaactctattatcgcacctccttcctaagcacctgccctctgtgtgtctagcccgctgctaggcatggaggtacagcaggggaaatgaggaaacatgttccctgccttcagggaggtcaagtctaactgagggtggggagaaatgacaaaaaatagtctaagaaaagttatcaatggtgcccaggtcctacaggagaaggcacaagctcctttgcctggtgttgaaagctctttgtgaccagaacactgctgccctctctagctttgtcaatatcagttcccagcccctcactttcccaagaactgaactcagctacctgtggttgcagaaggtatgctgccaggctgtgtctccctgcctctgcacaggatagtggcaatgacaggaagcccttcccccaacctgtttggtaggcagactcccactcatcccttcaaggcccaatgcaagcacagtcttctctgagacaccttctttgccccacactccttccatagatggaaataattgtatgttcctttgttcttatactgcactttgtatagaaccacacaatagtgtaatttttccctacttatccatctaccctactcatttctaagctccttgggagcagagatcctgtcatttttatatctgtattcctggtactagatcacagcagtcactcagtgagtaaatgattgagcgactgaggttctaaaagaggcatgggctagctaggtggtcagagatggctttgaggtggcactgaaagggtctttgaaaggtgaaaaggagcttcataggtaaaaagggggaaatttcctatggggaaggtaaaagactcaccaatctagagcaggagcctggcctgtgcagatactgggaagggctggaaaggggaagggacctattatttattgaatatcttctgtgggaccacactgtgctgggaactttatagacaatctctcatttaatctgacaactttataattttcatcttccagctgagaggttatacaacttccttaagatcattcagctagtaaatgacagaaaagaaagggggatcccacacagactttgactttaaagaccacattcttctctctgtaccatgctaaacgaaaaggccttcaccagatcccacaactctgcctcgtacaaacataatctgcttatctttttgctagaaagattatagtagttttatttattggtcccttcactgagccccatgccaccactgccaccaaagtcattggggaggctgcaattctgggcttttcaaggacctgggcccctggggctccaggagaagaatcctgatgcttgactctcctccatctccccttgaaggtcaggtcctcagtgatggaaaagtcttcatccatctgtgcaactacatcgagccctgggaggacctgtccttggtgcagagggaaagtctgaatcatcactaccatctgaactgtggctgccaagtaagggaatgtccatttccaaagtctttagggatgggggaagggttctgagccttcattcatgcatgaatttattcacttactagactatacttgagatctgcactgtatgaagttggggatgagaaagcaatacagtctataggccctgatctcaaagtacttacactttggctgggaaggtggccatcacaggaggcagaccgagataactgtaacacagctaccctttaaagagagtctattctttgccagccactgtaatagtaaatttactgtaaatgtttaatttagtctccaaaacatatttatgaagaattaagatttccattttaaggtgaagaaatgaaagctctggcaagtgaagtgctcaaggtcagtggtagagtaaggaccctcagagctgtctgactccagagatgccactaagtggcaatattgaatatggggaaccttggggaaggagaatccaggagaagactggggactgggaaaggcttgataagatagggggcatttgagatgggctggaaaggtacgtaggaatctgaaaggcagcaatggaaaaagaaggacaccctactcactttaatgttgtgtggccatgactctagatcaccacctgctacacagtaccctgtaccatctcggcccctaacgagtgcctctggacagactggctgttggaacgaaagctctatggttaccaggctcagcattatgtctgtatgaagcatgttgacggcacctgcagctggtaccggggccacctgcctctcaggaaggagtttgttgacatcgttcagccctagtagggaccagtgaccatcacatcccttcaagagtcctgaagatcaagccagttctccttccctgcagagctttggccattaccacctgacctcttgctgccagctaataagaagtgccaagtggacagtctggccactgtcaaggcagggaaggggccatgacttttctgccctgccctcagcctgttgcccctgcctcccaaaccccattagtctagccttgtagctgttactgcaagtgtttcttctggcttagtctgttttctaaagccaggactattccctttcctccccaggaatatgtgttttcctttgtcttaatcgatctggtaggggagaaatggcgaatgtcatacacatgagatggtatatccttgcgatgtacagtatcagaaggtggtttgacagcatcataaacaggctgactggcaggaatgaaaacaagaacatactgtggctgtgtatcctctacttcccctgtctcaactcatcctaatcctctgatacactttcatctgtttgggggagtcatttgggagacacagaatcactcaatgtgagagccagaatggactaacctgccttccaatgctgttatcccctctataccatttctggcagagggtcccacctggttagcacacctctttgaataagaatgcacttactgtctcagaataggtactacctctccaagttaactatccttaatgccctcaactgatgtccataaggcttctcttctgtctcttttaaattactaacatcttcattcctatttcagaactttttaaaagccacaaagcctttttcttacagagctgaaatccccctttgttggctttttacaccacagagaggtggtcctctcttgagggcaaatttcaggatagagcaccggagagaaataacacaaaggcccttgaggggaaagcacggtaggtagggaatatacctggcaattaaggcagtttttttccagcagccagccctgctagatgctacagcaggaaaaagccagttttgatccccagagagccccctgtacccttcagctgagtactctcaccattgtgccttgggctccctgagattccccaaccaaaggaccctcagggctcctcagcctctgcaaggcttcctggcttgccctgaaaggaaaagtcctgatattggcctctaggatttattaaggacaagagcttagagtttcagagcttctccctggggaagctctggcaaagatgacagagatggttcttttcaatgcccaaggttgttttttgatatgtggtctgctggtgagcagggccatgcacaatgtgtcagaaggctcttgatttgcagaaatggtgtaaatggagaccccttttggccaaggaagtggggaggcgggcacaaacataatctctgttccacttggaatgcttcgcagggagtctccattggtgggttaagcacgatcaccaattgatcacaccagcctggggcagagggtgtggggacagggaagaagaagggagtttgagctccaggtccctgcacgggaaaaacattggcaatagcctccttaccaaccaaccgtcccatctctctgctccttctgacttactaggatggcctcagagaaggcacagtgttaacccagccttatcacagttgtggaagcgccaggggaatgggagagtcaggggattaataatagtaggagcaatgccttacatctagtagatgcttcacactttcccagaagctattacttaatgaatctcacttaaattgtgtctgtaccatattagaatatcctgtgcagggataaatatgcccacttgaccgtcttattggaaactgcacacagtgaggaaatgcagcttgttcaatgacaagtggcagagccagggctgggactcaaaagcagtgagatctgattgttggtccagaagtttgttattctctcagcttgattaaactgcccttactcctgtttttccctattctatctccagaatttgacaagaggctgtcagctaaaatctagttattccagccgcataagctctatagttcaaccccagtggagtctttggggttgagatgctgaggcccttttcagagccccacaataaccaggtggctaagtgcaaaatgaaaacagcagaaagactaatgtccccactgagccacttaccatctctttgtggttggggtagtatgtctgttcaatgagagggaacttttctcctcccagtgtcttatagatagcgaccagctgggcaaactgcaaaagaaaagcaaatgttacagcttatcttagataacttctgaaacagatgaaacatcaactcatcaaatatttattgagcatttgctctgtggaggactttatgctaagcattgtgaggatataaaagaagtgtacaattcctatttccaaggatatgatacgca

SEQ ID NO: 15494 - DNA, 183770 bp, Human
  misc_feature (1)...(183770): n = A,T,C or G
cgccctggaggattgacgaaaggcttcctggaggaaccatcaacttacataccttctccatgccttctctggctgcctgcctgcctgccttcttcacttttctactggtaaacatagctgcctcaagatccacctcaaatgtcacctcctctgagaggccttcctaagtctcagaggcagaatgagtccctccctccttaggcctcctaaccctctttgcccaactgtatgatagcatttctcacatcttatgtggttcctgtgtctatcctccctccatcccccagcccacatagatcatgaacttgcaatagacaagagccacttcccattcatttcagcctttccagctcttaccactgtgccaagcatgtagtagataggaagaccactgtgttattatagttgactggagacttctctgatagcaccggctcagagctggattgtgtatctctaggccctgagttgagtgccagctgggatacaggaagcaagaactgcccaccaacattagtgacaagccactccctgactccattcagcccagtacatacttactgagaaccaattgaaaaaagaattcaggcatcactactggaatacctactgctgtgtaccagatgctttacatacatgatctcatttactccatgtaacaactctggaaagggttacttattcctttttatcagctaaggagagaggctcacaggggttattgatccagggtcacatatcacccggggtagtctgctgtaaagcctatctgctgtgtcctgctccattacaacacaagggaaagtatatctaatgagagatgaaaactaaaggtccaagagtcacgcaagatttagagagtgcacatgggaaggtggccatcagaaatgtcttcacagaggtcaaggcaacgaataaaatggaaaaaacaagtagaaagatcttgaagagatgtccttcttggtatagcactggatgcatcaatgcatgctaggaaagaaacacggtggggttgggggatccttagatatccctcttggggtggagaccatgtctccagtcttctcttggttttctctcactggtcagtgaggagggggagagaagtacatactgttgttgtccctagaagtgcaggagtgaaaacacaccccacccctccttccatgacagagtagagaggatctgtttctcccctttcctctccctcgccttggagtaaggaggctgccttcctccctagaagaggtatttcttttttgtctcaccatagggtgtgtgtgtgtgtgtgtgtgtgtgtgtgtgtgtgtgtgcgcgcgcgcgcgcgcgcgcgcgtgtgtgtgtgtgtgtgtgtgttagtaacagcggattattcccttccccctcttctgggggctggggagatgacatctttctccccagcgttgggaaaggaggtggttcttttcctcctcactacagggtgttcgtgcttgtgtgcgtgtgtgcgcgcgtgattgggatgactcctttcgttctcacctccgcatagggaggctgacacctcttatccttccaaaaggagtggggtcggtttccttcgcctccatttcagctgggacacggctctttttctctccaaccaaaaagatggtggggcctctggttccttttccttcccctggggagaaggcctggctcccacgccctccccgcatagtcacgctcaggttgctggaggcctgggtcgccccctcctgcaagccccgagagtcgccagacgcgcggctaggtgccctccgtgagcggggcggggccgcctctgcggcgcggggcgggggctatctctggccccgcccctgccccgcccgctccctctccgcgagcctcgcgccgcgcggcttgcctggcccagtccgccgctgctgtctgcggggtctggcgccggggtctgagtctctgctggctaagccgccgcctcagccgcctcagtcgcctcaatctcgccttccgccctcgctctccctccgcgccaccagaccccgtagccccgcgcgcccccagccctttaagccagatgatgaacttcctgcggcgccggctgtcggacagcagcttcatcgccaacctgcccaacggctacatgaccgacctgcagcggcccgagccccagcagccgccgccgccgccgccccccggtccgggcgccgcctcggcctcggcggcgcccccgaccgcctcgccgggcccggagcggaggccgccgcccgcctcggcgcccgcgccgcagcccgcgccgcagcccgcgccgacgccgtcggtgggcagcagcttcttcagctcgctgtcccaagccgtgaagcagacggccgcctcggctggcctggtggacgcgcccgctcccgcgcccgcagccgccaggaaggccaaggtgctgctggtggtcgacgagccgcacgccgactggtaggtgccgggcgccgccgccctcgggggtcggggtccgccggcagccgcaggccaggagaggacggtcccaggtcgccgaggaaacgtttcagaccaataaaaaggagggtccccgaggtcccgctgggaggaggtgggggctgagcgcgcgcgcgtttgcggggtgagggagggcatccatcagcccggaaaggcgaacccaaagctaaaatacccctcaattgccccaggtcccccaggtcccatacaagaaggagctactttatgcaacaggaaaggcccttaggaaatagtttttttgggggtagaggaggggacacacttgttagcttagacacataaaatctgaagtgaaatagtcccaggaggccgaaggaacatttagggccagtaaaaaaggtttaacttcatgaagcacggagtgaatttggaatggaaattggtattttggagggagaaggtggtggtgggttttttttaaccaggacccatgaaggctgatatcaagtattgacatcaggttgatgaaatcacacatgtagtggcccaggtgtacacgggcttgttccccggagcatggctgaagtctctttatgaataataaaattgttgtattttgtgcagcagggaggggacgtgtggaatttttttttttttttgattgcttgtttttctgaaatgtgcgtggtggggggcggggcgtggaagtgaatggtagctttttctagctgaaagatgaagaccttggtaaaatatactggatcattaaaggggtacaaataaaaggagacctgccttaatgtagtagatgggaaacttcaataatttttttttcttctaaagagataggtagcatgtttccaacttagaatggtgaaggctgctgcttggtaaaagtacgaatgaggtccactgaagacaaattagttaaaagcggctctattttatagttaacctagggaatggtgggatggtgaaattgataggtggaagggcttggagaaatgaagaggccgagaatctgggggtgccttttctccaggaatgtgagcaagggttttgttttttttttttctcataggggttgaggttggagactggacctgagtgttcttcccaggaggggtgcacagagagaccacagagctatttctctccatttcctcttttggctgcttcactgctttctctctctagcattctctctttgggagacccagagggagggagtgctggcgtgtgggtgtggtggaaatgagatgcagatgtggagatgccctcctgctgcctgctaatgtcaccattctgaatagtcctttgggtgacttatgtggttggccttttcaagagagtagagtagaaaatccgaaaggacttttgccaggaaatgacaaaggcacatggaagagggtaatgggaaaagtgtaatgcatatgatagtgccactggcagccctccttagaattactctgactcagttcatatcaacaagtgcttattacggaggaagggaaggtaaccaagctagtaaaggtgctcagtcagagcatccattatatgccaaatgctgtactctcagcatgatatctcattgcattttcttcacaaaactgaggcttaggaaaggtaagtaatatgtttacaatcatgtagccagcaagtggtagaagcaggatttgaacttaggcctgtttgactccactgctttcattccactgtgttatattgcctcactattattattagcaatattaataacaagctccctctaggcagtgtgggggccttttaagagaactcactcaaattgggacacaaagtggatacatgaaacagttaaaaagaaatctagaattattggttgagactagtgtttcaggcagtcaacaaatggagtggttagtgagagccagagttattggagaaagcttcacaaaagatgaatcttgaagaaaggccaagaaaaggaagaggagaaatgagaatgacattcgtgctttatttttctgtgcaggaatttgacccttctgtaccttgtcctgatttcttatcctattaaatgcacttgttttgagtcttattgccagttaggtatctatagataggtactgatacttatttgtatgggtatgatgaagctgctgcagatttctgtttagttataaatgcttctgtagcttaagatttgaaactctctttggatagtattctctaggaagcctatttggcataaactagagaatttgccttgccctggagactagaagcctctgatggaagtcatagaagccactttcctgtgggctgactcccaactgttttcctattttctctgaagtaataacattgatttattaaaactcataagcccagttcaagtctagttcttgacaacagttttttgctcctgtgtttctgtgcttaatagcagttcccagaattgctcttctaatatgggcctaaatttgtcaaaaacatctcagttaaaaattgatgagtggttttattgaaaagtctctatgagttaaggagcaggtgcttgccgtgacaagcgcagtgacttacacaggtgatttttgcactgaagactgattttagtaaaattgtctcacagtttaagctacctagatagtattcaatgagtgatatcgtatatgccctatattatttttctggtgctggaataggaagtcagagtgtagactcattagaacttaagaatattggtcccctctgaattatataatgctaaaataaagagtctgaacaagcatttaaataacaagagatgtaaaagaagggcttaaaataagcagcctctcagagcatccttaatacaacagcagtttcctttgaatttctgtcattgtaattgtgggcaattggagaccccaccactgaccaggttgatgggaaaattggaagatgtttttcttttgctggaaatgttttcattggttgtttgagatctttagattaatcgcacactaaaagatcgttgaaaaatttatctgtgccattaaaaaatgaaatcaagctctttatataccttattatttattattagtattttgtaaatattgtcagaaaatgtcctcttttaaggttcatggctaaatttgaaatgcaattaagattgcactttaatgatcgtgcttaaacaaggaacaggtgtttatgttgtttcttcggtgtgttatactctcaccagcgaagagatacgttttctctcagattctgtcctgcctttgttccggagattctgaccccagtgatcaagtgagcttttcatcctggcatgatgtttcagtgtttgattcagtatagcacaggtactcttgagtgtccagactgcagatataaggcaacagatatttatgaagcaccttctctgtataggggatatttactaagaaaaatgagacacagtatctgccatctaagagcttgctgtccagataggtagataagataaatacttttgaaaaaaaatttactaaaaagtagggcctttggatcaacagcattggcatcaaccaggagcattttgaactgcagaatctccagtcccacctcacacctactaagtcagaatttgcatttgaataagatccccaggtgattcataatcacattaaattttagatgcacttagctgaaggatatgccattagtgctaagggtatggcaataacaccaactactgtcatttattgaacaacatatgccagatttactaagctttgtaccaatctcatttactctttacatagcagtgtaatactgcagaagtttagaagagttaagagatggatctgggctagagtgggaatggaaggtttctcggaacaagtgaggttttaactgagctcgaagaattggaatcaaaagagataggtttgtctcagtccagacagtggatagcataaggaaagtacaactgcagaaaagagggggacaacgaagagactagattgatgcgttatctaggcggtacctgtctccattcttttctagccagcctttgagcatttcatcaagaatagaggaattcaaagtactgcagtctgcttgaaccagtgcttgtgagtggctctaaaaaatacttgaatttgaacttgaaagaacactcaaataaggtttggggcttctctttgtttaatactttaagcgtcttatttctaacataaatatactgattgcacagaatttgattgttcatagcagcagttgcctgtactttagaattctcagatattagagctgaaagatcatctgagttactttataaatggggaaatctcgatctcgagaggggatgtggcttgttcaaggttactcacttagctaatggcagaaccagaactagaatctagaactttaatctctctaccatgtttttttttttcccaactctaccacagtatccctccatttttactattttctacctttaacttttatatttttccatcccttactatctcaaggactggtggggacttttagtctcataatgatagcatttaaacctgagggaacctgaatcatcatctagcctagagaaatggaacattttgcccaaggtcaaatgagaagttagtgaaagaatgggaactaaaactcacatctgactccatttcaagtttctttttactcttaagtcgctctttgagatttctcaaattctttttctcctgaaaaatactgtttgtgtcggcttcttttaaagactcatcatggagctgttagtaagtgcttaaaaagaccatgtaagcacgctctcacactattagtgacaccagcaattacactattccttgtttgtgttcatttatgttattgttgtttcagcaaagttcattctaaaatggttgaagaaggttgggcgcggtggctcacgcctgtaatcctagcactttgggaggccgaggtaggcaggttgcctgagctcaggagttcaagaccagcaacacggtgaaaccccgtctctactaaaatacaaaaaattagttggttgttgcggtgtgtgcctgtagtcccagctattcgggagactgaggcaggagaatttcttgaacccgagagatagaggttatggtgagccgagatcgcaccactgcactgtagcctgggcgacagagcaagactccatctccaaaaaaataaataaaataaaatggttgaagaagactcttggagacctagtcgtcaaaatccagcaatctaataaagttagtaggactgtgccgtaatgctgaccttcccttcaggaacccatttttaagttagcgttcctatctacctaaggttgcttactgtctttctgtacccaagttcagatctgtaataaccttgttctttttaatatcttcctaaggaaaaaggaatggaggcctaaataggaagttttccagatgtgcatacctttccctcaaatttacaagggatataaggattaaacacaggccatgtctattggaatcgtccagtccaatgggagaggacaggcatttaaagaggattttaatattgtatggtaattagtatgcataggatgctatgggaacacagagataagttatcctggggaatgaagatcttgtacttagaaatgttccattaaaatgtgccaccatgtattcttagataaaccacttcgcatctttggactttgattttctaaaatttgtcaaatgagaggattgaaatatattctccaagatcctttccagtactgtattatttccgtggttcagtttttgtgccattttcttttaaaagcattagctctaatttttttctatatggtaatgcctgtaaatctttggaagcagagacatatgtcaataaatgactaaacatttcccggaatgaaaagctcacctttgaatggtcttaattcagtacctccttgttacattattgctaccatatgttatcgtgaaaaaagaggctaatcctgtgatgcctgctgtgtatatttcctcatcaatgatgggaattgggacttgtggctaaatctatgtgggaatctaaaacaaaagatgacaatgccacctgataagcttgcagaagttcttacaagatttacaggtgtacacatagtgggagtgccactaaacacacagaaaaaccaagatacaactctgtcttgaggctactgcatttaaccatgacttcactctaggtggtggatatgatcctgaaaaagctgtgtatattgagtttttgtaaattgaataatttcaaaaacagtggggcactcactatttaaatgaattgtggaaaatcttttgcaagagaaattgccttttttataagaaaaaaattgttacctaattttttttagcttcccacatagaagcaattgggtatcataaagctacaatatctctttagagaaaggagaggatgatctagaaggcttttctgttctgcagacactgcttcaatacagcaggaagacgtagtttttagtagggcagtgacctgtggagagaataaagtgagcagataccacaggtgcctgaactctaaggatgtccatgctgcatgactaagaataggaggatgtatatgggccttggtgtttgttgcttgacagcaggcatttcagaaattttaaccagttcatgtaagattgtaaaatagattagattcagtcaccctgcccttctttccttttcagcagcatgaaacaatgtgagatacaggattgagggtcaaaagacttcgaattgagatctggctccactgttagccttatggccttatcaggtttacataatctccttgagcctttctcccatctatttgacagatttccgctggaggtctactatatatcaggcactgttcaaggttctagaataacagacaaaaattagtttcattacctgtaaagtggagataacattatgtatttctgataccactgttgtgataattaaataaaataaggtaccataaaagcattttgtaaaagctaaagagccatactagtagttagtgttacatctttccctgtttccagccgcaggtatctgatctaccttggttccttttttgagttcccaaaattttgttatgtaagtgattgtttattttgcacacttctgggatgaggaatcttctttttgttgttgttatttagttgagggccaccgactcaagacaatatcatcaaaggctttcttttgtgtttttcaaaaggcaatataacttagtttttttttttaatgacaaaaacattacccattaactcagctatatttaataattaggggcagaaccacataaatcttaattttatttaataagtgaattctaaaatagctctccttcagttttacttgtaactaattaaggaaggatggctacagaggaaaatgaaggaagagagaaatacacagaaggcctttaaaaggtagtgcttgtatttgtttccctatccaatcaaagcctagaacattgctttcagaatatttttaagcaaaacaaaagcattcacggatcttagaaagttagcttctttcttaacattcttccctaacacgtagttgctcattgtgcttattcacagtttgcctccagcttttcagactcatttctcactgtcccctcaatcctgaattttgctgtactctggattaccctctccctgcacacatgctggacttttaagacctggtgctattattgcacagctgcctttgtttggaatgctcttgtcctggttctcttaccttaacgttgattttctttatttcattctccgaggataaaggcattgcctattgttgaaaaagactcatctcttgtcttctgcatgaccttgcttaagatttcatctctctttttccttctgttcatattctcattttctactgattgctctttctatgggttgctccattcttgtaaataaagtaacaaatgaaaaactcatcctcaccttcctaatcactcttccaaacatgaaagataaatctcactcgttacttatccagttatttgcccttttccactgacactggccttctgccttctctgtaatattgatactgttcttgctagggaacctaattgctaaatccagaggaaggtgtcaaatgttcactgatgtgtttgacactgtatatcttccctttggaagtcgcttggcttcaggacactgcattctttgttcctttttaaaatttttaaatagttttgtaaagacaagatcttgctatgttgcctaggctagtcccgaagtcttggccccaagttatcctcctgcctcagcctcccaaagtgtcaagattacaggcatgagccaccacccccagcctctttgttctcttcatacttgttttatcgaagtttcttttcactcttcttgttctttccctttgtctacctcattaaatgtagatgttcctccgggcccccttttcctgcccacttctttttttatactgcatattctccctggtccatctactctcaaggtgtcagttacctcttaagtacaatcagttccctaatcattacctttagtccaaaactttgtcctcatctttagacatatgtgcagctgcctgctggacatctccatctgggtggttaagagtcgtttgatccaatattgaaatccatgtttttccttcctattccagctcttctattctgtattttaagtgggacaccgatggtcacctatttcaagttctcattaactttcacctagaacttctgcaagtctcatcatgatttccatttagtaacctgaatgaactatttaaaatgcaaatttgacctttttactcctttgcttaaagtttttcaggagcttcttacatcctataggtagtttatggccctcctgtgatttgacccctgctttcttctcctgccgtctctaattatttccatgtccagacttccttttccagcaatactgaactgtttgcacttccatacacacattgttgcattcctcctccttgtctttactgtctgctactacagtttcccttcctcccctttccttttcttgattaaattcatattcatcttttgagactgagtatttccttttccagaaactcttctctaactctctagattgtattgagcgtctatgccccctccatgccctctttcaatactgcaagtatctttatctctggacacaacacaatggtctgtttatgtgtctgcttccccactagatagtgggttctctgaggacagacaggctgaatgtttcattcctttttgcatccttagcatccagcatagggcttgacacatagattgaggacagtaaatctttgccatattgaattgagcagcaagagagtcaaaggatgagataagggatagaaggtaacaatgaagagagggaagtatcctaggattagaagtatatgttaatatgttggaagtcatccttactgtcttcaaatataagctttagaatgctttcactcttatgtcctatgaaatataaattaattactaattttcaaccataccacatcataaatctttagagatttagctctgaatgagagagccatagcagcccacaatactggaaagtattatctagtccatggcagctctgagcagagcaaaggcaaatggaataaaattgaggaccaagtttctcttaccatatattgacacttggctctcaaggaaccatttttctgaaaattcggtcttcttttttcctcagtgtgaaactccaacctcaggccacccaagctgtgtgtttctttctctttagtgaaaaagttcctttgggctattgctttgtctgtacctttatgagttttgtgtgccttcttccacacagcttttttggcttcctgttttttcaactgcaaagtgggattgtgggaatggtttaacttccccattctaagggctcttcagaactatcacaaacaatatatttgttttcttgaaaacagctttaattgtaaacagtttactaatggtagaatagagatttggagaaccaaaacatcattgtgattggaaaatgttgaaagtacacagcaagcattcatgatctgactgcttacttctcctgccttgcctttctttgatttgccacatactttgatgtaaccatgagacactacatagagttaattgaatgtgccgtgcccctgtgtctttatttgtactacttgtgcttcctgaaaggctttcttctcctgtgtctttacctggataatcttcaagactcaactcagttgttgcatcgtctagcatcaggacttaatccttccttaaattatttccatttgtgttagaaaccacaataccattgattacctgtcatagcagttagcccactgtattataatcagggtttgtctgtcttccccaacacctcactttcgacaacactgagatccccttgaaggcagtgtctataacttttatttcagtatctccaggacaaagaaagttttcagtacttatttgttgaacttatcagtgacttatgaaaaaaattatgaaaatatcaatgatgagcaaaagcaactcgttggttccctgtaaatataaacaaatgacagctgcattaaccgaagtaactagtcagcaagtagtggtatatataaaatctttttataaagtgtaaagtgctatagaagcattaattattgttactggattagaatttcctacaccttccgttacataaggctgattacgtacctgctcgcacctctccctcattcacccttgtctgatgtgcctaaacaccccatgcttgtttttttctgaagaacagctgttgtgctctctgcttctcctctctcagcctaggcattaaactgcctttgtttccttgagcttttctcaagttctagggtttgttcgttcttttcttctttctatctaggactgttcttccattcctgtcctcccaagcacaactataatcccttttccaggatatatacctcttatctctttctctgttcagggggcctgacaacttcgtacaataatttcagcctgatttaatcctgtacaaagaggcttgggcttcgtgagaggaaattgagatcccctttctctatcatggactgaatctttgaaggccctcaataacacaactgaaaactgtttcttttatatttctagattccagtgatatagtgtgaatccttttttgttgtaccttgtaatgcaactgtagcaatacatatgaatatatatttccctcttctgtccctctcttcccctgatgaatagctaatggtgagaatttaagttctagagtcctgtgttcactaacattttaactgttagataaaagggcaccaatgaaagattgatgaaataattagcaaactgctactaacttgaatgtgttagttgccatgaaggctacgaaaccagtgaaatacttgaaatcaaataattatagaatatatgctttcagtcttgtaggacttatagagaatctcaaggaagacagaattaggatagtgtaatggaaagagcattgcaaacacttaaaacacctgggttcaagtctgtactctgccaactaactttttgtgtcaccataggcagtttaactgttcaagtctcaatttctgtttcaaaaattagggatgtaggccaggcgtggtggctcacgcctgtaatcccagctctttgggaagctgaggcgggcagatcacttaaggtcaggagtttgagaccagcctggccaatatggtgaaccccatctctactaaaaatacaaaaattagctgggtgtggtggtgggcacttgtaatcccagctactcgggaggctgaggcaggagaattgcttgaacttggaaggtggtggttgctgtgagctgagatcgcgccactgcactccagcctgggtgacagagactccatctcaacaacaacaacaaaattatggatataggctaaatcatcgatcttcagaggcccttatgaaatcaagtgatctgtagaaatcaagtggtttctaaaggttggactgtttgactatataaagaactctttatatagtcaaacaatatcacagtctcagtggactgtagaagtcaaaatgtttcacagaagtcacagatctgagctgggttttgatggaagaatgggatttagattagtgaggtgggagagaggcatttcagttaagagtaagagaaagagccaaagcataacatcagtaatgagtaagatgtgtgtagtgcagatgtaggctagttggcataaaggtttcaaggcagggaaaagagggaaaggcttggataaacaaggtgggaaaaatgataatacataatgtattgggcatgtattttgtgacaggcaggcactgttctaagtagatgtattaactcatttactaggatatcaagtagattactactattaacctaattttacaaatgaggaaactatagctcacagtgaattcggaatttgtacccagggagtccagctccagagttcatgcttccatgctcctaaccatcatgctctgtgattaatggataacaatttgttccatatttctcctttccactgaacaccttggtatttctttttctcagtgacacagatacatgtttgaccttgaacaatttcttattctctctgaactttcttcatctaaaaagaggagataaagtatatctcaaactaattgaaataaaccttgaaaatgtctaacaatatgattgacacttgacagatgttcagtgaatgttccaccatgacaagcagattttcatagcagctttaagacaacagcttactacatgagtatttataggagccttcaagtgaggataggagcctgtcatttgtgaacagattttcatgacactaaaaaatgatttagaaaaatagaacaaacctagatgaatattccttcattttggttcgagcaatttgttgtacatggtttggaaaacattgattagcactgttttgaaacagtctctggggaagatgtttttaagctgacttatatgtggaaacttcatactttgagcactatcacattcatgtctcatttaatcctccacacaatagaatctgtggtgcagtactaatactattctcattttacatatgaaggaattaaggtctaagtaggttaagatgattacccaagctcaaatagccaggaagtgatagagtcaggactagaacccagatttgtgggttctataggttctgtggcctggaaaagagaatgttctacagaagggacaaatctgagctgagctttgaaagatgagtgggatttagattagtgaggaaggaaagaggcatttcagtaaaaaggaagagatagtaaaaatatagtaacagtaatgggaaagaagtgtgtagagcagatgtaggctagttggcataaaggtttcagggcagggaaaggaagaagtttggataagcagcgtgactttggatcctgtgtgtatttcttgaggcttcctagactgagtgccaggtgccatagagccaggtggttagctaatctggttggaaattttgtgggcaaaaatatcagttcttccaaccatttaatagacttgttttccaagggcatttagcttaatgatttccctttggtgctagcttggaattctcttgcagaaacatctagattctgatacaaaaggccaatgaacagcgccatgaagagtagtgatgggaggattgagactagtttaattcatgccgtaacaatttgctattcttctctgaatctcagtttcctcatccttaaaattggaataattttacttgtcctaatttcttcatgagataatgtctatgggaggactttgcaaactgtaacaaaaacaacagatttcaatatgtattgtctgaaactctagtaactggtgggattgagagtaggtagatatgaggaagagttccccacttagtttccttttaggtattgtcatgggcactttttctagttatgagagtaagaacttaggggaggaaataggttttctcaagtatcagggctgttgagtctagttagaactgtgtaggtagtgaattttgttttcttactttttggtgccttctctctccaatgatgcctcttattctctgtctgtggacatatatcttatgacctgggactcattccagatgtgaacgtgttttctgaatcaaaattgggacatgaagtcttatttgccagtgcaagaaatagtctgggagatttttagatgctgaaatgggggaatttggagggaattttggtggttggagactacaagactgaaaatgtgaaatcagcaggttcttgggacatttaaggcaaattgttgttggcatccctatttcctagcccttagtattcagtagactgagcccgtgagctaaccatgttagctcaactatgagttgctaatggttactggcaaccctttttcaggtttctgcattttcatagaaggagctgggaaatagaaaaacttctctgacactaagtcatgaatagtggaatttcagcactatgatcagaggaaaaggaaaagtattctttattgccacccacctacatgaaaagtctactctttgaaagaataaaacatcagttaacttggcaaaatgggatgagactaattttcctgtagcctccagataacttatgcagtcaggtttgtttgaaaaaaatgcactcaacttaactgtgacccttggaaggaaattgtagtatttctgattccttattaaggtcatatatttaagtaaaactttacaatttatgtactttgacttgtatgtaccattgcacttaattgtcaccttgaccttgtgaggtaaattggtataatttcctgcttagattaggaatccaaggctcagagagcttgcgattttgcttaaagttataacaccgaaataaagctgtgtctaaaatcaatactcttctcactctgtaccctttctctgtgcggctaagctcctttctgatctctgcattagtcaattgatgatgcttttgcttagaagcaccagggatagataaaaaaattgcttaagatggcaagagcctgtatggtttgtgacagatgttgcgtaggttggatgaaaataatttaaagatcgtctcctttccctatatgtttttgttaatgcttataatacttctatgacttagagttcttctggtatatttcagactgattctgagttgtcaggaaagaggattttcactccagagctcagttcttttaaagcttcttatttttctttgtacctggaaatttatttcttagccagaactcagagtggcatcagacttaaacttaagttcctactaaaaagactgttctctgctggtctgttttttttcctgtcctcttcccccccaccctggccccccacataattagtccctcttgcaacatcctcctcttcttctgtccccccagttgattccagctgtagtgatatggaaggttcctggagtagaagggcagtgggttttggagtagggaaaggatttgaagcacctggccctctgactcgggataccccctgaaagttttgggaggttccctgctgctatgcccacttcccaggatcctgtgctttcccccagacccttaggagaaagatctaggtagcagctttgaaggaagaaggactctccagagattcttcagtgctgatttagtttttcccctagatgtatcttagaaacaggcacctagatataaactttttgtttgactttaatgatttacctcctctccccttcttgggggtatttattttgaggtttcccatgtacttcatatattctttcatgaattattcagtaggaattggtgctgtaacgcgagcacaagaaacattgccctgtcttcacaaagcctatagtttagtggaggagacaagctattaaacaagcaatgtaataaagtatgatttattatatcagcatgattaaaggatgttttaaatagaaaacatttatctcataattttaccatagcagtagaggagctgctttcacattttttgtattctcttctaatatttgttcatatacacacatttttacataattgtggttgtactctagctataacttcatatttttttcacttataaataattttgacatatgccagtcttaaaaattgtattttttcatggctaatgtaccatgatttcttcaatttataattctgttaaagaactgtattgacttccaatttttcaccattatgacatagtacaaccataggcattctcaattttcaggagaccaactacttgatcaaagattattatatctgtaactcttggtaatgttactatattgcaatatctgaaaagattctatgaaaggtttttttctattatatttgcagtctatcaaccatttttacctcactttgcagcacatggtattatcttttttagtgttaatatccgtaaagcagtatttgcccattttaacatgtatttctatgagtataccaggtaagattaaatgttttccccaatgtttgtttaaaaatatgtgaaatgtcatgctactttggaggctgaggtgggtggaccacttgagccctgtgaccagcctgggcagcatagcaacatcttgtttctacaaataaataaataaatttttaaaaatgtgaaacgtcagttcttgtcttttggcagtttgtttgtttacttggtggtttgattttaaatgggctattcactgttaaagatgaggaatgggtagcagcagctagaatggcttcttgggtgttcgttccaacttggcagaaaacatcagtgattgtgaagataagaatcagattcttggctgggcgcggtggctcatgcctgtaatcccagcactttgggaggccgaggtgggcagatcacccaagctcaggagctcgagaccagcctggccagcgtaacgaaaccccgtctctattaaaaatatgaaaaacaaatcagctgagtgtggtggtgtgcacctgtaatctcagctactttggaggttgaggcacaagaatcccttgagcccaggaggaagaggttgcagtgagctgagatcacactgcctcactccagcctgggtgacagagtaagattgcaaggctctgtgtcaaaaaaaaaaaaaaaagaggttctttcagctaaaatcagtactacatacaggactgacacctgtggggtctatactaggctgtgagttccatcagggcaaaggccatgctttattctttgcctcagcctttagcagcctggctgatggtaggcctcaaaaaaaatgttgaagaaatttcaagttcttgggacactggatagtctcctccaaatatcacttccgcatcttcttatattgcctaaagtttcaccatttaagtttcatttcattctttggattttaaagaatgaaaatctaatcttggagacctctaggaagttattattattattattattattagtttttgagacggagtcttgctcttttgccaggctggagtgcagtggcgcgatctcggctcactgcaacctttgcctctcggattcaagtgattctcctgccttagcctcccgagtagctgggactacaggtgcacgccaccatgcctggctaatttttgtatttttttagtagagacagggtttcaccatatttaccaagatggtctcgatctcttgacctcgtgatctacctgcctcagcctcccaaaatgctgggattacaggtgtgagccactgtgcctggcctattctttaaattttttttttgtagagacagagtcttgttatgttgctcaggctgctctcaaactcctggtctcaagcgatcctcctgccttagcctcccaaagtgctgggatgacaggtatgagccaccgtgcctggccaagaaaattattaatgcctataggaggatgaatatggtggtctcaggtaacatactggagattatagctgcaatatgagagcaacaacaccctgcagagatagaatgtagaatgcacacccggtggtggaggagtagagaaatgcttacaagagtagtaggaagttgtcagaaataacagctacatttattgaccagaatcccaggaatatgagaactggcaagtaatcttagtgtttacctgagccttggtgtctttatatgttaaatgtggatgagaatgcctattttccagggttattgtgccacttaaagtgggttatgaaagtgctctgtaaattcaaaagtgctttataaataaaaaaaaaaatcattgtcatcaccatcatgtaggaagctagggaatacagggataaaatttctttttattattttttcaggagctagatttattcttcatatttttagctaatctttatcatttgaaggtgaaattgaagtttataaagtagtattttccccccccacccccaaagaaacagtgaagaagtagagaggatagggaggtagctttggggagtgtaagacttctttagcttttcatcatgttaaatgaatagcttctttctgcccaagtctttttctgagaggatggtgaaaagaggaaggcacactgtggaccatgttcagagtcagtattttacttgattgaagcagtgggacaagatgaggaggaattatgagttaatctttgaatagtaggatggaatctgctaaggagaaccttgaatacaaagctcacatattttttctttatcttgtagtcagtagaaagttgtgaaggttttgatcaggggagtgagttgataagtgctgtacttaagaaggtttatctgaagacagtgtagaaaatgggctgtggggggcatgggtggagaacttgtgcagtcctggagaccaactaggagcatgttttggttgtccgtctgtgaggtactggatgtttgaactagaaccgtagcagtggaaaagaaggagtggatacaggggtgtcttgagagtgtagtcctggggtaaaggagctttggggaccttatgaccctcaatctgttattgcttccaaaggtttgttttctctgtagacttttaaaaaatcaaagtataaaactgacatacataaacgtgcagaaatagtaagtttgtaactcattgagtttttagtataaaattataaagtatgacccaagatgagatatgcatgcaacattaccagcgcctgctaagccttctgtccatcattacttccttttttttttttttttttttttttgagacagtctctcactctgtcgcccaggctggagtgcagtggtgtgatctcagctcactgcaacatccacctccagggttcaagcgattctcctgcctcagtctcctaagtagctgggattacaggtgcatgccaacacgcccagctaattttttttgtatttttagtggagatggggtttcaccatgttggccagactggtctccaactcctgacctcgtgatccgcccatctcggcctcccaaagtgcattacttctttcaatcttgacttcttctccctgaacagataaccactattttgcttccttcagcatatgttaattttgcctacttttgagctttatataaacgaaatcctacagtagaaactctttttgtgtctggtttcttttgtttaacataatattcatgagatgcatttgttttcttgtagatagcattagttcattctttgacattgctgatttgtatttcattctctgaatatatcacagtttatgcattctgctataatggatacttaagttgttcccagtttggggctactgtgaataatggtgataagaacaatttttgtacatgatgttggtgattataagctcttattcctgctgggtgtgtacccaggagtggcatttgctgggttatagggcatatgtatattcagcttttagtagttttacagttttacagaatgattgtaccagtttacactcccaccagcagtatatgagagttcctcaccaaaactgtgtcttgtcagctcaggctgctgtaacaaagaccttagactgggaggcttaaacaacagaaatttatttctcacagttctggaggctgaatgtctgagatcagggtgccagcgtgattgggttctggtgagggccctctttctggcttgtagacggcaccttcttgctatgcccctacatggtgaagggagagagccttggtctcttcatccctttataaggacaccattcccatcatggggggggaggggctctcttctcttgacttcatctacactaattactcccaaaggttccacctccaaacgtcatcacaatgggggattagggctttaatatatgtgtttgggagtgacacaaacattcagtccatagcaacgtggtattgtcagtattttaaatttcaaaggcttttatgttataggaaacttgactagagaaggctgtacctaacataaaggaagaaagggattattggttattgaatgcctgctgtgtatgagatactgcctaagtgcttttcctaatattgtctcatttaatcaaggtaatctcatgtagattttgagatcagtgttgtgttgattttacaagccagaaaactgacgctacaggttagtcagcttgtaattgccatccagaatccagcctagatctgctggagtctaaaccaatcacattacatagaaactacagtagtcagtgaggtgtgtggtttttttttgtttttgttttggtggatgggggggcttttcctgatgaccctgaaagtccgtcatataagtggtccccttctgatacatagtgcctagctggccctgcaaacagcagccacccaaccaggcacctccccctaccctgtgccttctctgctgcctcactgaatctcttagcagccagtcattcagactgtctcaaggtagatattatactgacacatcctctcctccagctggcaagctcacggaagaagcttccattgaattttaaagactagccaagcctcttgtttctttcaccagtttttttcatgtagcttttttccccctaagaatgggaaggcaggaatgccatgtgatagaaagagcttataggtgctattattaaattgttgtatgaccttgaataccacattttccttgtcttggcccagatttcctaattcataagagagtgttgggttggggtcagtggttccatggaccctcctcatggcctacagtgggaagagccaagtgggaaatactttggatcctctggatattattacaaccagtgtagctctggtttcatttattgaatatgcactgagctttctcctgagaatttggttaaagcaaataattatatgacaaatatatgcttgaaatccactataatagatgatactagatgatctctactaagggccctatcaacttcgtgaaagatcatgagtggcaaaactgaaatgagcaaaatttctacccttaacctttaaaaaaatatatatacaaggccttcatgctaccctctgatcactatgagaaaatagaaggggctataattaatttgcctagaataggaggctggggaaggattaacaacaaaggcggcatctgagttggacttaaaggaagaatagaagttcactagatggagtaggagattaggggagtaaggcctctcaggtagaggagtgaggcagaagatatgaaaagacattgctctttaggaaacattgtgttcttggtgcggatattgtgtgtgatgaaaagggcaagaatgaggaatgctaggagacgtggctgggaggatcactgagccactttgtaaagagacttgaatagtacagtggtggggactaatgaaaaatgttaaatattgtttgggttagcactgcatagttgctaatctgcaactgcatgttaagctcctctcaactcaggaccctgatccacacagcagtgtttggatgttaactaatgcagtggcagtgcccacaaactcagaagtgattccagttagagccttggtgacttggggtttacactaatttcttcttcttaattgtctcagggtgttggatatacgcgtaatgcttgtataaaataaaagggtaggagagtggggggaggctctgctgataggcagcaagtctcagactgcaataaactcagtggtgtccttgccattctaaactcatcatcagaggtgaatgtggcaagattgtaattttgcctcctgtgtgaaaaattagagtcagcttcatggctcagccttcccagctcttctccataaaggatctcctcattctgtctccggaaacatatgtttatttgtaatgcatttcgtttgtggtaattggagcagcgtgccttttcattctcttgtcaaacacccatctccctgcctagagagcttcggagcctgatataatgagcctgtgaattacattaggttggaaatcaggtttctaattaaacacatatgaaagatgtcgtacccattgtccccctttttatcatttgtgatcttgagatgtccctagatcctatgagattcctgtcctggttgatgaaagatttcagattggagcacagtacctgatcagttggggctaatgtcagcttcatccattttacaaaacactgagaagagtgagtatattgacattagttgaaacattgctgtgactaggcactttacatatattatctcattgaatccttatgtcttcaaagagatattatctccgtttagcatatgagcagatggttaagtaacttccccaaagatgcatacagttagaaagtggtgaatgaggatttgaatttttgtctgaattcaaaacccatgtttctttcaattcatgcctctgagagcagaatgattgtgctattaatatttcatggcccagtggaaaaaagtttagagggaggaccttaggcatcaatgtcaggaaaggggctttggagaatcaacatttaatcagaagagtaactttcatgacttacatagaggaaagaggttataagtaattctttttttttttttactgtgctctacttcttttttttatttttttatttttttatttttattttttctttccctcccccctccccaccacagtccccagagtgtgatattccccttcctgtgtccatgtgatctcattgttcaattcccacctatgagtgagaatatgcggtgtttggttttttgttcttggcgatagtttactgagaatgatggtttccaatttcatccatgtccctacaaaggacatgaactcatcattttttatggctgcttagtattccatggtgtatatgtgccacattgtcttaatccagtctatcatcgttggacatttcggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctcctcatcctctccagcacctgttgttttctgactttttaatgattgccattctaactggtgtgagatgatatctcatagtggttttgatttgcatttctctgatggccagtgatgataagcattttttcatgtgttttttggctgcataaatgtcttcttttgagaagtgtctgttcatgtccttcgcccactttttgatggggttgtttgtttttttcttgtaaatttgtttgagttctttgtagattctggatgttagccctttgtcagatgagtaggttgcgaaaattttcttccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattcatctatatctctgttttggtaccagtaccatgctgttttggttactgtagccttgtagtatagtttgaagtcaggtagtgtgatgcctccagctttgttcttttggcttaggattgacttggtgatgcgggctcttttttgcttccatatgaactttaaagtagttttttccaattctgtgaagaaagtcattggtagcttgatggggatggcattgaatctgtaaattaccttgggcagtatggccattttcacgatattgattcttcctacccttgagcatggaatgttcttccatttgtttgtatcctcttttatttccttgagcagtggtttgtagttctccttgaagaggtccttcacatcccttataagttggattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagaggatggggttttctagataaacaatcatgtcgtctgcaaacagggacaatttgacttcctcttttcctaattgaataccctttatttctttctcttgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcagtacctaatttattgagagtttttagcatgaagggttgttgaattttgtcaaaggctttttctgcatctattgagataatcatgtggtttttgtctttggctctgtttatatgctggattacatttattgatttgcgtatattgaaccagcctcgcatcccagggatgaagcccacttgatcatggtggataagctttttgatgtgctgctggatttggtttcccagtattttattgaggatttttgcatcaatgttcatcaaggatattggtctaaaattctcttttttggttgtgtctctacccggctttggtatcagaatgatgctggcctcataaaatgagttagggaggattccctctttttctattgattggaatagtttcagaaggaatggtaccagttcctccttgtacctctggtagaattcggctgtgaatccatctggtccttgactctttttggttggtaaactattgattattgccacaatttcagctcctgttattggtctgttcagagattcaacttcttcctggtttagtcttgggagagtgtatgtgtcgaggaatgtatccatttcttctagattttctagtttatttgtgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttcttctctgattttagttatttcttgccttctgctagcttttgaatgtgtttgctcttgcttttctagttcttttaattgtgatgttaggttgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaaatgtatattctgttgatttggggtggagagttctgaagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattggagaatttagtccatttacatttaaagttaatattgttatgtgtgaatgtgatcctgtcattatgatgttagctggtgattttgctcgttagttgatgcagtttcttcctagtctcaatggtctttacaatttggcatgattttgcagcggctggtaccggttgttcctttccatgtttagcgcttccttcaggagctcttttagggcaggcctggtggtgacaaaatcggtcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggatgatatcctgcagagtgttttccaacttggttccattctccgcatcactttcaggtacaccaatgagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttgtcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctctatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccgtgccgtgtgaggtgtcagtgtgcccctgctggggggtgcctcccagttaggctgctcgggggtcaggggtcagggacccacttgaggaggcagtctgcctgttctcagatctccagctgcgtgctgggagaaccactgctctcttcaaagctcagatggaaatgcagaaatcacccgtcttctgcgttgctcacgctgggagctgtagaccggagctgttcctattcggctggttataagtaattcttgtgctttctttactttgggaatgaaacagactgtgctgtgaccagtggtaagcttagataatttccaggtgtgaggcagactagggtacgagagactaatacaatatgtagctgggactctctttttcccaaattgagatattatttgcataccataaaattcacccctttaaaatatacaattcgttggttttagtatattcacaagattatataaccaccaccacttattccagaacatcttaatcaccccaaaaaccatatacatgttagcagtatttcccattcctcccttaagcagccccaggcaaccactaatttaccttctgtttccgtggacttgcttattataagcatttcatataaatggaaccatacaatatgtggccttttgtgtccagcttttttcatcttagcataatgttttcaggattcatccacattgtatcatgtgtcagtacttcattcctttttatggaattttattcctacacacaatatttcctttatagatatactgcattttacttgtctatttacttatcagttgatggacatttgggttgttttcacttctgtgtaattataaataaagctgttatgaatatttatgtacaagttgttgtgtgaacatacgctttcagttcttttaggtatatccctaggagtggaagtgctgggttatatagtaattttatttttaactttttgaggtactgccagactgttttccaaagtggttgcactattttatattaccaccagcaatttatggttccactttcttcacatcctcagtgacagtagttattgtctggtttttttatgttattattatagtcatcctactctttgtgaagtagtatctcattgtggttttggtttgcatttccctaatgattaatgatgtcagctatctttccatgtgcttattagctatttgtgtatcttctttggagaaatgtctatgcaattccttttcccactttttgattgggctaatttaattgagtctttctgttgttgagttgtaagcattctttatatgttctagataaaaatactgtcttagtctgttttgtgttgctataacagaatattacagactgaggaatttataaagaaaaaaaacatgtttctcacagttgtggaggctaggaagtctaagatcaagggaccgtatctgatgagggccttttggctgcatcataacatgggggaaggcatgacatggcattacattgcacaagagtgagggttagagggccaaacttatccattatcaggaacctactactgcagcaactaactcactcccaggataacagcatttgtccattcacgaaggcagagctttcattaggcccacctcataacactgttgcattggggattaagtttccaacacatgaattttgggagacacactcaaaccacagcattccactccagcaccagcccccttctcacatgcaaaatatatttattcagtgccgatggccttcaaagttttaacttgttccacatcaactcaaaagtccaaagcccaaagtctcatctaaatcagatatgggtgagactcaaggcacaattcatcccgaggtaagtttcttccagccgtgagcctgtgaaatcgaaacaggttgtttatttccaaaatataatggtgggacaggcataggatagacgttcctattacaaaagggagaaataggcaagaaaaaggggtgacaggtcccaagtaagtccaaaacccaacatcatgaataacgttaaatcttaaagctccagaataatcttccttgattccatgtccccatcttcggggcactctgggtcagggactgggcccacaaggcctcaagcagccctgcccccttggctttgctgggctcagtccatgcagcagctctcacaggttggagtctcgtacctgcagctctctcaggccagagttgcacactggtagttctgcagttctgtggtgttagggggcttattactgaaccaaacttgggtccatcaacctggcatagcaaagccaaacactggcattgagatttgcagcgagagaaggtgaggcatttattgcagggcaccaagcaatgagaattgacagctaatgcgtaatacctgaactccccaatggcttacatgtaagggtttttaaaggtgggaggcagaggttacaggcaaagccatacattgatatacggaggctatcataaattgatttgaccggaaaaggtggggcatctcaagagtgggggcctgcaagtcataggtagattcaaagatgttctagtttgtaatcggataagaaaataaagctttgtctgaaaacttggggtcagtagaaaggagtgctaatctctggtttgtgagtgtggacttcctccaggcctctcagcaagaaatttagaacaaagaatggtggaagacagagttcagtcctcatttcctctttgtctgaggtctgcatgcaagaggatggcattttctgttggtgagggtccaggtttttttgaaaacaactaaggacatatgttaagatattatctttagtttcaatagggaaccaaacattttatggctctaacttccttgctattgttttaagctattactgccttcttgtttatcagatggctctttggtttttaaagccagctaggtgcctggaatttttcttgaaggaactaaagattttacttcatttccatgcttggagtggggcccagcagacccctaagaggggtacctgctccatcttaggctgacccactcacatggctccactaggcattgctgtagtggagactctctgtggtggcctcattcctatggcttagctaggcattgccctaattgtaggggaggggtgcggcacactagctgtggtggctctggctctgttcctgtgacaagtctctgcgttggcccccaggacatctgcaacatcctttgaaatctaggaggagattgccatggctccacatttcttgtattctgcatattagcagagtcagcaccctgtggataccaccaaggtttaccatttatgccctatggagctacagcctgagccacacccaggaccatttgaaccacagctggggagtctgaggaacactgtactggcatgcagggagcagtgtcctaatgaaacccgaggcagtaagtccactgagggtgtgccaggcatagtgaggaaaccattctgccctcctagagctctgggcctgtgatgggagggtgaaaatctcaaagatctctgaaatgccttccgggtcattctctcattgtcttgatgaatagcacctggcttccttctagctgtactactctgtttaacaaactgtcaattggctacatccttagtattctctcctgaatacacttttttattctttgcctttccaggctgagagttttccacatctttccttctccttcccttttcattgtaaattatgtctaagtcatttctcttttccttcactttactataaggggccaaaggaagtaatgaagcatcttcaacactttgctgcttagatgttcctcctaccagatatcctagtttatcactgttaagttctgcattccacaaagtcctaggacatgaagacaattccactaagttctttgcaactgtgtaacgagaatagactttactccagtttctaataccttgttcctcatttccatctgagacctcatcatcagaattgcctttactgtccatatttctacctacattctgattatggccacttaagtaatccctaaaaagatttaggctcttcctacagctctcatctttttctgacccctcaccagaattgtccttaagactctattaatggcagtctagcctttttctagcctgcttctccagattcttctagtctctacctattatccatttttaaagctacatccacattttcaggtatttgttatagcaacagccccacttctttgcaccaatttttatctcactctgttttgtattgctgtaacagaataccacagactggataatagatacaaacatttatttattatagttctgaaggctaggaagtccaagatcaaggggctgtatctggtgagggcctccttgctacatcataacatggagtaaaacatcacatggtgtgtgagagagagtgtgagcacaagagcaagtgagagcaagaactagagagtgagcaggctcaagtggaagggggttgaactcatccttttatcaagaacctactcctgaaataactaacctgctcccatgataacagcattaatccattcatgaggcctcacgacctaattgctgttaaaggtcccacctcataacactgttgcaatggggattaagtttccaacataagaactttgggggacacactcaaaccatagcaaataccttaccatatatatgatttgcaaatattttctcccattctgtggcttatcttttcactttggtagtgttctttggagcacatgtttttaattttgatgaagcccaatttttctgttttttcttttgttgcttgtgttttttgtgtatatctaaagaaactgttgcctaatccaagatcacaaagacttacacctatattttcttctaatagttttatagttttatctcttacacttagatctttgaatccattttgccttaatttttgtatatgctgtgaagagtccaaattcattctttagcatgtggatacctatttttcccagcaccatttgttgaaaagactctttttcctctattgaattgtcttgacacccttgtcaaaatcaactcaccatagaattgtgggttcatttttgaattctaagttctattccattgatgcaatagattgcaatgatgcattatttgttcttatatcaatatcatattatcttcattactgtagctttgtagcaagttttgaaattggaaagtgtgagtcatctaactttgttgtttttttaaaaaaaacttttttttggctatactttgagtcctttgaattgccatatggattttaggatcaacttgtgaatttctgcaaaaaaggcagctgaaattttgatagggatttaattgatagattaatttggagatattggcatttattaaatattacaatccatgaacacagatttttttcatttattttgttcttcaatttctttcaacagtgttttctaatttttagtctataagtcttgtacttattttaaaattcttattcccaacaattttattctttttgatgctgttgtaaattgaattggtccctttatttcatttttggattgtttattgctagtatatagaaatacaattgatttttgtatattgattgtgtatcctgcaaccttgctgaactcatttattagctctaagagtgtgtgttcatgtttgtgtgtattccttagaattttctatgtataagatcatctgcaaataaaaattttacttcttcttttccaattcggatgcctttaatttctttctcctggctaattgtcctggctaggaccttcagtataatgttgagtagaagttgagagaatggatatccttgttttattcctcatttttggggaaagctttcagcctttcactattataatgttaactgtggttttttatagatgctctttattaggttgaggaagtttcctttgatttctaggttgttgagtgtttttatcatgaaagggtgttggattttgtgaaatgctttttctgtgtctattgatacgattatttagtttctttttttattctattaatatatattacattgactaatgttcatatgttgaaccaacattgtattcctggaataaatctcacttagtcgtgttatataatcctttatctattgctaggtttggtttgctaacattttgcttgtagctggggctttccacaaagtgtgtttagtagattttctgacattgtacagagggaaatacaaggtccctcatgttatttcaccagctgctatgtgctaccaccatgccacaggccttacatacattatcttgtttaaactctacctttgtgctaggtagaggtcacttcagttttcactgtattcttgatggtgatgttcctatcctgcagatgagaaaacaaagaagcaaagatttttttttttttttttttgtcattcagcatttatcctgtcttttttgggattaatgctgcaagaagtgagacagagccaaataaagcaatggattttttttgaaggtgtgccatgagttatttctgataaaggtagctttatgtatgtagtaacagaattggtcctctcatggatatgatcatagacaagagatcttgtatcagatcaggtattaaggatcgggaggaagaaactaaactttttcctaaaagaaggatgttgccaccctttttctgagatcagataagatcaggtcttaattcctaaatcagaatccttttatgacatgtttcctgcctttaagtagttgatagtctagtatgaatgaaatgcaagttgtacagtgaggttctgggcctctaccaatggcccactttagtcatgtgggcattggtgttgggggagcctggaatactcattatttacttagcaattataaagtatagaatgattaaagtacaaagtatgctgatttgggacataaattggtgatttgggagatttgtgtccatgtttgaggaggagagactacatggattttcagcacttgttggattttcattaactaggatttggtgaggatttgtcttcccaaagataattgtaatctggtggaagatgggctggcaactgtgtagttgcagacagaaagggcagtgaaagtggatttcagagtggtaataggaggcaggaggtctttggattaatctgcctctgatgaacaggagagaatgttaaacacaaaatcctgcatagtgattacttctgatggaagccagagtgaggcaggagggtattggtagacagcatcaacggtattggcaagttctgtttctttttttttttttttttttgagacggagtttcgctgtgtcgctcaggctggagtgcggtggcgtgatctcggctcactgcaagctctgcctcccgggttcaagccattctcctgcctcagcctcccgagtagctgggactacagacgcccgccaccacacccggctaattttttgtatttttagtagagacggggtttcaccatgttctgtttcttaaaatgagttgtaaggccatgagtgttctttttattactaggctttataactttcatatatatcacattttaaaaatatatccaatatttgattcaaaaaagaggataaaagaaagatggaaggatagtggaagaggactaagtctcagtgaggaactaaggtgttgatagaaaagtcaggcagcctttgcttaatgtagattgtattatagttttcttgcccatttggagttattaggggaatatgtgcttctctcttctcttctataacctttaactgagaggtactttcttagagctggagcttgggaagaggagaaaagatgaagctttgaaacagattttgtttctacttctcagagaataaaggggtgggtgtaggagtgagagcttatgtgtccaggcatcaaacttggcagacaactccctcagagcagatggagtgaggatttcattgcttgacagactgactcagacctgcctccctgcagccagccactactgggtatggcttgaatctctgttgaaagctgccggatcatggtatccctacttctactctagcaatgatgaactccagccttcccagaggaagagctgtccaaggagctgatgtgtttgacccttattgcttgctgggatggtggctttggtgaaatggacatttcttagactgcagtgttttttcagagattgtataactcccccaatctatgttgctttagagaggatttttacattggaatagagcttgcctctgtgtcctccaagctgtttttctgccatgagaaatatgaactggaagattctacacaattgggtgattggtttagtgaggtcaacacaggaaaaaaccctaagatgtagaattcttgtttaagaagtaagcagctttccagaaacttcagatttctctgccagtcatgattttagcaaccagtgaagatgagcatgttttggattagagccacagccttctagttcgtgtccttgcctttagtctccctcctgccagtctaaggtgtaaatgctgccaggcttttttccataaagccctgctttcatcatggcattctccattcagataacctctagttgccactcctgtgcatcaggtctaggcatactgtttagctttgaaatttgttatatccggcgttatgtctgatattcctccccagcattcaccatctgcacctgacaggctggttttctctcagtcctccagatataatattcatttccacttatatccctcgctcaaaacgttcctttcttctctagctaaatcctgcctgtccttctaagacagctcatttcttcttccttcaatgctagcattggtcacagcctgctctgctctgccaacatatatagtagtttccaaataatttagtgacaagttgttttctattttttgtatattagcgttggtctgtaagccttttgaagtcttggaacatgtttgcttctcttatttccccatggaatttaagatggtacctggcatgtatcagtatatttggttaaataattaaacattgcaagttttgtaaataatgactagtatttgtatatcatgttaaagttcacaaaatgctctcacatttattatatttcttaattctcccccaaattttgtgatacttctatttaaagttgaagaaattgcatcttaaagagttgaaataatttgcccaaggtctcacagttgataactgctctagataggactagagcccaagcttcaggtctgttaaaaatgctgacttgccttgtgttttcttgaaatcccagttttctttaagggatttgtagatattgttgtttaatactatggaattatcctgggagctcaatggaaaggtaatgtcttcctgtgaactagacagttataggagacctgagaatgtttcagctgcaagtggatctaaagaaggagggtgtagtgggttgaatagtgttcctttctgcctggccctccccatcccccaattcaggtccacctcagaatgtgacttatttggaaacagtgtctttgcagctaaggatcttgagatgaaatcattccagatataaggtagatcctaaatccaatggctggtgtccttataagaagaagagaagatacagagagcagcacagagaggagaagcccatgtgaagatggaggcagagattgcagctaggcaactacaagctagggaatgacaaggattgcttgtaaccactagaggctggaagaggcaaggattggatgggccctacagccttcggagggaacatagcccggccaacacaccttgattttagacttctggcttctaaaaccgtgagaataaatccccccacaccttttttttccttctcttttctctcttttttttttttgtgagacagcatcttgctctgacacccaggctggagtgcgatggggtgatcacagctcattgcagccttaaattcctggactcaggcgatcctcccacctcggcctcccaagtaggtgggactactagtgagcatcaccatgcccagctaatttttaaaaaatttcatagagatggagtctcactgtgttccccaggctggtctcgagcgcctgacctcaagcaatcctcctggaaaacaaacctctcaaagcactgggtttacaggtgtgaactactggtgcccagctgcttttttttcctctcctaatttcacttttttaaagccaccaaattagtggtaatttgttatgacagccttaggatactaatctaaaagagaagaaaaataagcatttactgcagggtctcctatataacccggtatattttaggcactttaatgtgttattttatctcccaacaactttgtgtggtaggcattatttatccatattttacaaatcagaaaaataaggctcagaaagataagcttgtgttttaggaatattctgtcattttgttttcagctgtctactttcttctgttgattgcctgaggaatttattatgcggccctcagaatgactgggcataaaactgtgatgtccattctactgggttggttaaagaaatgcaccgtggattagtcaaaggagggccagacatatcatatgacctttcctatggaaaagtctcagcatctgtcttcccccacgtctgtacctatttctcacctactatatagtcaaatctccatcatgaaacttccctagatttctttacctaatattttatctgtttctctctctcaactgaacctccatagcagtttatctacttcaattttattgtacatactgcattctaccttgtattatatgatttctgccttgtgccatttgtccaggtatattgtaggtctcatgaggatggagatcttgtcttgttcatttttatatcttccatattacctaccagaaattcttacccataacatgttaattaattgttgaatttctgttttcctcttctccttcttccccactttccaggttctagtgtcaacctttagaaggcaaagttctctctctctctctctctctcacacacacacacacacacacacacacacacacacacacacaggtgtgaggaggattcaagtgaggagagggcagtaagacatgaacatgaatagcatgagcaaaagcaaaaaagaatgaaatgcttccatagtagtcaaactggtagaatatcatattcattttgtctttcccatttcatgagtaatcaggatattgaaagatttgaaatgagatccttctgaaaaagcaaagggttccagaaatatgactgaaaacttagtaactgtctaaaattattttgctctgtgatcaaaataattatgagcaaccattcttttagaggaaagaaccaggataatgggtataagatatttagaatctgatgaagacatttgatgaaacaattagaacccctgaaaataggaggaatccttttatgttgagtcttggtcatttacttttataggggtgtatggaggcactatttttagacaagcagttagcatccctcttcattataagtctacatggtaagtctacatgtgctgtgaactatagtacattcttgctattggggaataagaaaaatacctatagtacaggttttttattgtgctctatggcattgggtttatagaatcataggacttcagaaccagagagataagagtaagatatcaaatatttattgagtacaattgtgtgctacatactgtgctaatctctttatatatatttaaatttcacaattacctgaaataataggtacacttatctctattttatgaatgagaaaattgaagattagagaggttgggaaatatacccaaggtcatgcagctaagaagtggtggagatggaatcattagaaaatctgattatatgccttaaagatgatgtgatccagaggttcctatcctgggccctccaggcatctagtaatctagttaagttccaaccctgtctcattctactgtaccaccaccagagagctgtacatgtggtataccataaaaatgatgtttaaaggggggtttactgcatttagtattttggtgtttttttttaaacttcagcaactgcttaatgactgagatgtgattataatacatgagaactgtcagacttttgaagtttttctgatgcagtaaaaaggagtagataaaaagtgaaatggattgttctttgctgcaagcggagttttgtttgtaaaatgtagaaagagttaaaatgagatggtaagaatgaatgaggagaaatgcatttcagtttttttctgggttaaataagtaaatgtctctactgttttccaatttgaatagatgtttttccccctttggaggatgggggattccgttacttagagagactaccaccactattgctatcactaataacaatcatttgattagtgctttacattttacaaagtactttcactgtagcccgtagacaattaatcttcccatatcttgcattcccatagtcctttgcacataccctgcattgtactgaatccctttgcccctacaatctccacctcagtgctcatggcgaactgatttgtgtgccctgtggagtgggagtactgcaacattgagtagtggggggctcaggaatacctcccagaagcacaggagagtactatatagaatttgaatctggcggagttaagaagaaaaaagttaaaatcagttatgcttttaaaaaatgaggcttgaatttacagcatagtgtagtgggtgagaagcatgggatttggagtcagcagaactgaatttgaataacttgctgctttcatttaccagacatttattcattctcaaaggaacccatatttctcctttatagtacttactacaactctaactaaatatttgtttaatgattatactttctactaggatataagtttaattaggaaagagactgtcagtattgttcagttttattctctgtacctagtacagctactagtgtggtttagttgttcagtcaacatttgttgactgaataaaatgaatgaatgtctggtaaattgggtgggtgaaactgaccaaatctgaggagttgggaaaggttttggtgagtatattacatttaaaatgagacctgaaggatgaataggagttggctaggtaaataaggagagcaacatcctgggagaaagaacatgaagcttgtgaaagggaaagagcatagttagtttaaagaaagacatttctttgtgactggaatgtagagagggggagaatgtgtgagatgaggctagagtaaacagaggttcatgcagaggcttataggctttgctaaggattttgcactttattctcctactgtagaaataggaagctatctaacagttttgatggaagagagccatgattagatgttccttttgatattttgaaatgactgctctggctgccatctagtggagactggattggaggaagggaagagtggatgttcggaaattattaaaaggctattgcaaaaaactaggtgagagaagatggtggcctggacaaaagtagcaaacgtggagatgaagagagttggaataatataagaaatatttaatagatcatcaagacttgatgattgattagataagaaatgaaggagaggtcaaagtatgacgactaggtttctgactgcacagctgggtggatggaggttgccatttactgatacgaggaacattgaaggaacctgaaggacagattttagggggagatgatgaatgttgttttagatatgttgtaattgaagtgccgatgagacaataaagagaatgattatgggaagttgggtgtatgggtttgaacttcaggaaaacatattgtactccatgactgttccatatcaagatggaaagcactaccttgtttttttcatgactgaatggtatttcattgtatatattaatgttccaattatgtgccataattaagggaaaggcaaattgtatggaaagagaagaatacttaatagtgtgagtttcctttaagaggaggaggaaatgagatctggctcacaggtgtttttggtcttagataagaggagagacacctgatctattattttaacagaagggatggaggagaatatgggtgaagatacagaagggtgtgtagattggatggtgggaagttgaggatgtatccatctggtggcttctattttctctgttaagtaggaggctaggtcatctactgagaagaaggaaggatgatggaaggggtactatttgaaggaaatgaataagattttaaatcatcatattttgaccagacaaactcatgatttagtgagagttgaaggccttgttgaggtgacaatctgttctgttgtgttatttctttctggcattcttcagcagcttggggacacagaaagtggatacttgagctcattaagggtttttgaggtttttgtcagatggagacgatgaaagggaaaggaagtttaagttattgaaatactagatcatggcatctaagttggatagagaggcgagtgatggattggggacagtgattctcaaactttagtatatattaacattatctgaagggtttgttaaaacagagatcacttccatttgtaaaacaggaagcagtgttctgatgcttttctcattagttgttggagttgtaaggtggcagcatgtgatgttctgtttaatttgaagaaagcatttaacctgttttttgctgtaaaccattcagatttaagatggttcaataaatcagcagttaactctgggtatgagagtactttggtttccttggtacctgattgtgagaccctctacaagttacgtacgttgtgtattccaaccttttacttctgacttacagataaaatgcccattgtttgtttctagggttttgagcattttctgtaaccctaagtgaaagatttagcctttttatgcctttttaagatgagacaattcatgtttgctacattttactttcccaagggcttattatgagattttgttttattattttttgagacagggtcttgctctatcacccaggctggagtgcagtggtatgatcacggctcactgcagccatcggactcaagcgatcctcccacctcagcctcccgagtagctgggacgacgggtgtgcaccaccatgcccagctaatttttgtattttttgtagagacagggttttgccatgttggccaggctggtcttgaactcgtgagctcaagtgatccacctgctttggcctcccaaaggcctcctggagtggtgggattctaggggtgacccactgtgccaggctgagattttattttaactacaaaattcttttaagactgtttgccatataaaaagtctacattttaattgtagaacccagtgatttattgtaaagatgatgatgatagctaacattcattgaacgcttattgtgtgccaggtattgtgataggtagatagtggataagacaatctaaggagtgcctacttagttaagtgttttaatatagtatctcatttcatcctctcagcagttttatgagggtatatactatatttcccccacttaaaaagtatgtgaattgaggcacaggaaagataatatgcccaagtcatgcagcagtaaatggtagctcgggttcaaatctaagtttgtccaattctggacccctgctgataatcactgtactggaattgcagcagtcggtagtgactattttattcattatatcgttggtttatggattttacaatcacttgcagacctaaaccgtgggaacctatatgtcagtcttttcagttctgtgtaagatgagattgtcagagttttgtgaatatgtaggtgagatgtgaaattagaagcccttgaagtttgggaatgtacatggacccttctttctcattcattgagcacatgcttatcgaacacttagggtatgtcaggccattgtgctatgtgtagtaagatagtctgaatgcttactagtttagcataactttgggaaagttaacattgggcccaaaagagcagctgagaggagttgtaggaagaacattagagccctggctcggtggctcatgcccataatcctagcactttgggaggctgaggcaggtggatcacctgaggtcaggagttcaagaccagcctggtcaacatggtgaaactcgtctctactaaaaatacaaaaattagcctggtgtggtgacaagtgcctgtaatcccagccacctgggagggctgaggcaggagaatcactggaacccgggaggcggaggctgcagtgagccaacattgtgccactgcattgcagccagggtgacagagtgagactccgtctcaaaaaaaataaaaataataaaaaataaaaaataaaaaaactgaaagatgagggaactgagtactagtttagtatcagagtgctatagatggcttgggagttatataggaaatgatacagtaagttcctataaagtgactggtacatgttgaatgaaaaacagggtttggaactcattttgttttgcagtcttgtgatgttttctgctatgacattcttctcttttattcatttatatatccactggacgatacattatgtttgtgccacatctgcctgggtggttgacagatttggaaacatggcttatatttagaagagtggaaaagcagaaactttccagagataaaatcagtaccttggagagctctaagcaggcaccagaactgtgcaacacaaagcaatctcgacagtttttgtttgttttctttttgttttgtttgtttttgtttttgagggggctcactgcaacctccacctccaggattcaagcgattctcctgccccagcgtcccaagtagctgggattacaggcacctgccaccacgcccggctaattttttgtatttttagtaaagacagggtttcactatgttggtcaggctggtctcgaactcatgacctcaggcgattcacccgcctcggcctcccaaagtgctgggattacaggcatgagccaccgaacccagcctcgacagttcttagactgttaatggttataattctctgcaagattcttgaaatgttagagtttattagagtaaatccgtaagttacacctttcatttaatgttgattctttgacccaggaatggctccagtttggaatgatttttttttttttttttttttggagatagagttttgctctgtcccccaggctggagtgcagtggtacgatcttggctcactgcaacctctgcctcccaggttcaagtgattcttctgcctccgcctcccaagtagctgggactataggtgtgtgccaccatgcccagctaatttttgtattattagtagacatggggtttcaccatattggctaggctggtcttgcactcctgacctcgtgatctgtcggcctcagtctcccaaagtgctgggattacaggcgtgagccactttgcctagcctggagtgattttttaggtttgtagacttgtaaagatctttggaataatctcatctttcttctcttctctttttttttttttttttttttttttttttttttttgagacggagtctcgctctgtcgcccaggccggactgtggactgcagtggcgcgatctcggctcactgcaagctccgcttcccgggttcacgccattctcctgcctcagcctcccgagtagctgggactacaggcgcccgccaccgcgcccggctacttttttgtatttttagtagagacggggtttcaccttgttagccaggatggtctcgatctcctgacctcatgatccacccgcctcggcctcccaaagtgctgggattacaggcgtgagccaccgcgcccggcctcttttttttatttctatatagataaaacagagacccaaaaatagaatagcaaaaggattaatgtcttgttgacagaaagtcattagaaaattctggataagaatcctagtcttttgacttccagacagatgcttagtatgtaacaatggacctattatgaggataaaataataagttctacacaatgtttttatcaaaaaattatagctttctaaacaggattttaagatgaccttataaaactgtggcaaggggaaatgtgtcaatttcttcaagttccctggtggcttttttttttgaaatgtaaagcagagagtattttgcttagatatgagctgctacattgttctacatctctggcagaggcacagagctactgctggtcttctagttttgtcctccagagctactgctggtcttctagttttgggtcgtagtggtctgtttctcaaattgctgctgccccagtgctgcccctgaagtttttatttcttttagtacatatgaatcctcaaatgtaagaactgaaaggtcttagagatcctatagtctgccgccttcattttatgattttcttttagttctgtgctaatctctaaacttcaagtagatctcaggtctctgaaactgaacatgcaggcttatttctggatcagcccacttggaaatagcttatcagagatcttctctggaccagaggaaatattccttaaatgggtcagttgtcaagaatgttctttggaacacattgtataacaacatctgcttcaaggccttgtgtatgcctgaggtgttaggatctcattccttcatatggaaggtttctcaggaatttattcagcttctccaagaaggaagcttttcagaggctagaaatcttactaaattcaccgtgtatttcccatgtgggctgttgcctcttagttggctccctgctggttttctttttcattcagtttattttgtattttttaatgataataattattcacctttgacaaatgttttggttttagagcatttttgacacatctttctttagccctagcagcaatcatatgggatcgatattcacattttagtatttatattcaggaaacatttattgaatgctagctacatgctaggcgttgtgctagactgtatgctatatatcattttaaaagtctcacagtatctgtaaagtattattcagattttgcagaagagaaactagaattttaaagaggttaagtaagtaacctctgttctattcatttctttttttcttctttttttttttgcacctactgcctgataggagctgtgcttagcacttaggagagacatgtttgctgttctccagaattaatgcagtgcctgaggaactcaagatttataaagttacattagaatttaatcaactgttaagacttaattgttggctatactttcaagaaaaaaattaaattgactgttagaattgggcaagaagaatcaaaatttgtgtggaccagggaaataaatacaaatttatggagaaggaatagaacctaaattgaagaatgtggcaccattgtagatccctgatctctggataacatgataaagagttaggttaggagtgttaaggtatctggatggattggtaggaggagagactagaggcgagaaaacaagtcaggaggttgttgtaatcaagattacccataggagccagccttggtcatgtctcctttctttccagaaagagaaaaacagttttttttaggccaaagcatcataacattcttgaaactcttagcattgcccttgcagtttagctgtcagagaaatgctaagttaggagatttgaactcacatcctacttatcttcctttgacccaaacatgctactttgagcttgctgctggttcccatatctcttctgaagatgacctttttgttttttgacataatttccatacatgttgtttcattttacctttacaacaaccctacagcaaaaggcatggtagatattattcccatttgataaatgaagaaactgaaacaaaggtaaattaactcatccaagatcatacattgaattactttagagctggaaataagattctgattgatccggccaggcacggtggctcatgcctgtaatcccagcactttgggaggccgaggtgggtggatcacgaggttaggagttcgagactagcctcaccaacatggtgaaaccccgtctctactaaaaatgcaaaaattagccaggcatggtggtgggtgcctgtagtcccagctactcaggaggctgaggcaggagaattgcttgaacctgggaggcggaggttgcagtgagccgagatcacaccactgcactccagcctgggcaacagtgcgagactttgtctcaaaaaacaaaaaacaaaacaaaacaaaacaaaaaaatatatatatatatgattctgattgatccttctttctcattatctgataaatgtacacttaggtctcacagcccccctctacactccatctatcaaacataattattctgtaatttgtatttatatcagtgtttacattattctcatatatgtttctttctgcagagctaggtgacatacttactatgattacaatgtttaccatacaggacttttcccccctagagttaatagtattctcatgttttttacatgaaaatttttataactctcaaattgagaataatttttgtaaacctcaattaaaatttttgtatgcctcaagtaattaacttaaaataagttaaattaaaaaattaagttttttgtaaacctcgaataattaaaaatataattaaaatgataagttttgcaaacctcaattaaaaattttcatattattttatcagaatccatcatatacctgtgacttggtccatgttccttagataacagagcttgaggcaaacattaaatgcgaatcctttactgggaggtgcaatcccagggcagcaagaatgatagtagggggagtgaggcaggaaggacaggaagcaaatgcaaggtaatgccttatcacacttgccgctgctttacaacaggcagtgaagagataacaactggtcatttggcaggtacaccagtctgcccactcaggacatttccatgtgggctatcctgaaaactgttagagtagtccatgagaaagagggaaaggggctctatctgttgattcccccttatgttctgtctcccactggttaaaaattgcccatgaagaataaccctcctccccatgcttcctggttgcatcatcagatttgtcctttgcaattttgggggaagcaagatcctacatagtggcacttcatctgaatctgggagttgtaggaggagccagagacttggggtgtatagccggttgacacagaaggtttaactacatgagtccatctagaatcactctggtggcccctgaaggcagagtgagtaaagccaagagaatctggggaggagcaaaagatttgtctgattcaaccaattacttacattatctgaaaaatctaccaattctcccctctctgatcccctgcccagaggtctccctttgtaaccctctatcctattttaatctggacaatttggtatctaggattattgcatcctgggacttttttttttttttttaacactactgtctcctggggagtagttccagtttcttggatcccactttttcttttttgcttagctttacttcctcattctacaggaacatcttttccaggagtttttaaagaaagggtgcctaagagatgaatcttctgagaaattagatattcaaaaatgaaattattaacccatacatttgatagtttagtagaatatagaattctgggtcaaaaataatttttcttcaaaatttagaaaagtactgcttttgttttctagcatcctttattagtgttgataaatttaatattgattggtcaagaagacagaaagtgaacagtataggagatctgaatgccaaaattaaaaagcttgatacttgaccttttggacatatagatttttatatttaacaatttaagaacacacagtttctcaaatattcatggaacattcataaaaattaatatgaataaagcagagaacacatcaacacatttcaaaaagatatagaatgatctttgactataatgaaattagaagttaatataaaaagatgaaaatcttaaaaattccccatgtattttgaaaatttgaaaacaccactaaataattaatgtaaattaaaaatacctagaaggtaatgacaatgaaaacactacataacgatatttaagagatgcagcaaaggcagtattttgaagaaaacttttattttaaatatattagacaagaaagctttaaaaatgaatgagctccattttgtgaagttatcaaatgaagagaataaacttaaaggaaaaaagaaatatgaaaaataatggatttccttgcatacaggaaagatctgggattttgtgattgtgttgattctgtggttcaatttttggagaaattatatatttgcagttatgaatttttagaacatgaacatggtatatcccaccaactgtttgaggctttaaaaactctcaaattatgctttgtggtttttaaaggcagaagtcttttacatatttagttgcctttctctctgggtatttggtggttcttttgatgctattataaatggtattactctttgaatttcattttctatttattggctgttggcacatgggaataaaatgaatttttgcataaaaatgataaaattagagtattaccgttttgcaactcccattgaattaatgcatctaggtattgaacatcaacagctgttaatatcacagaaaggcagactttatgagctcctgataaaaggaatctaacaggagtctgatcaagcctctgcgtccagctgccaatttgtgggaaacacaaagaatggagaaagacgatcttcctggtgagagtgtaatcagcaaaactgctactatgggaaattctacatatggatcaagatgctccaggctcttgaacagatcaactctaaggaaaataaagggatgcacagggaaacctgtggattaaaagagatttggaagacaaagttgtgttttgtttttttttttttaaataggcaactgtaaactgtagtgtttaagaatatacacttgaatacaagcataaggaagtaattccataaaagtcaagagagtggttacctttgcggggaaggagggggtcaagactgggactgggtattgaagttgctcctggggtggctgtcaaaattggtttattaacctggatggtggatacatgagtgtttgccttataacaactcattaaactcattaagcaatactctttttttttttaattttgatgtggctttctgtatctttgttttattttacaacataaagtttaaagaaaaaaatgttttctgttgtatgaacaagagcaagaggattagtgggcagagaggagaaaagaagggcacctatatattaaaaatatttttgcctaaggtatactagactttgtactagagcatttcacacctgttatcttgacattcaaaatggattattcttatttggcagagtctcagaagttaaataatttcctcatggtaatgagtagggggcaggagttcaagcccaaatttgattgattccaaagcagactttctacttccctcatttactgatgttggcaaatagaagtgtgggtggtataccaatgtctctctaaacctagtgtctatagtatctagccttcagttagtcaccctcctaaaaagttgtgtcctttgtgtatattaaaaattatatggaaacatgtatattctcaccctctcaactaatctgttatataaaagactggttatattacttgttctaacagaacaaaaatgataattctaagacaagatatgaaaatatagtgacatctgggccaggtgtggtggctcacgcctgtaatcccagcacctttgggaggctgaggcaagcggatcacttgaggtcaggagttcaagaccaacttggccaacgtggtgaaaacccatctctactaaaaatacaaaaattagctgggcgtggtggcatgcgcctgtaatcccagctattcgggaggctgaggcaggagaattgcttgaacccaggaggcagaggtttcagtgagccaagatcgtgccactgcactccaacctgggcgacaaggcaagactgtctgtctgtgtgtgtgtgtgtgtgtgtgtgtgtgtgtgttactttttgacatctttaaatcccttatttttaggggaattgtttttctagtgaaacatgaacaaagatatttgaaatgagtttcaaatatagtccagcagctgagaagtcctagaacaatcttaaacatataaaaattaggctacaggaagggattttattttcagtcctcttatgtgatatgactttagccatgaacattgtataaatttggattagacatgcctgtaggatgactaagattcaaacttatttctttggttacagtttgattttagaaagttggctttatattttgtagttttgattttgattattgatttctcagcatttgattcagtctgataactttgggctcttaatttatggataactggtttccaatctctatagctttctgcttttccactcccgtgacatgcttttactgttactatgagacaatcagggaagattttatgaaaaaatatagtggaaatacttaaaaataaacatgtaagtagaattggttctataattttagaagaacattaaaactgaaacatataaacatactcgaaacatagtctttattttgatccttttagagcatagtatttcatcgtgtggtcctctatctgcatcaaaatcacctgggatgcctactttaaaaatatattctgtggtcccattccccaacccttctccatcagaatctacattttttaacaaatgcacatacctagaatttgatccctgtccttttcaaatgtccatatttatttcttcactttaagtttcttacctacaatgtctataaggacactgtagataagtaggccatctggaggttgatttggtagaccatttgcatgtttttgaaacaatagatttctgatgtaagttgattatcttaacaatttagcataaatatgttttatttcccacaaattaatgatccctttaatgacagtagatgatttctgaatgattcccagctgtattgttaaagacattaaattaagatatgctattatgctgtgtgtatatataggactactaaaggaatcagaactcagaattttttttagaatgagttattccagtcattaacctttgtatgtttgtgtgatataagacaacagtaatttacttcttttcctgacaaatgattattctatctctgaagcaaactgttccttccagtgctggacaatttgcctcaattatttccacttactctagtatcagctcttctgataataattaagcactagcatgtctaagtggacccagtgaataaatcaagataaaatcactggggaaggggaatatgaaagcagtgctggaacagggggagagggatgggcagagaaaaacccagaaagggagcatgggtactagagatgtatttgatattttgcttttcctgacctagtcaaaagattctgttagagtgtcatatcagtgctgagaatggcttctaaaagcagcagttacctttatcattccctctttcctcatctcctgagagtcccttctcattacagtttaatgctggttccagctgttttctcttataaacccaacttctagcgatagcacttgagtcccacattcccaccagtttggatgagagagttttagtatttgaccaagagctggattccaccactgaagtgtatctaaatctacctgtctggttatatgcatccaagtcatgtgttgccaaagtagttctgttatagaactgaactggggtctacttgcctggcacagtaagaccagatatccacaccaaggttttgcagtggtagaaaggaaaacgttaatttgcaaggcaccaagcaaggaggaccaggcagctaatgcttaaatcctgacctttcctatggtgtataggtaagggtttttataggcaggagtaaatttcaggaaagcagaagtacaaggaaaatcataaatcaatacatagaggttacacattggttttggcctaaaagggtgggacatcttgaagcagacgggataagtgggtggtgggcccacaggtcataggtggattcaaacattttctgatttgcagttgcttaaggaagagaagctttgttttaaaagctggaatcagtagaaaagaatgttaactctggctcctgggtgttactccctccaggcccctcaggaagaaatttaaaacaaagaacggtggtcagaattcagtcttcattgccctttatctgaggtctgtgtgccagtggatctgcttggtggaggtctgggtttctgaaaaacaactcagggacatacgttaagatgttatctttagcttctacaggggaatcaaacatctcctgacagtaacttccttggctattgttttaagttactgttaccttcttgctgtaaagttgcttatttacttctcagggctagctaggcgcctggaatttttcttgaaggaactcaagattttcctttatttccatgcttggcggggggcccacaggctcctctaaagggggtccctgctctgtctcaattcctcaagacaccaattcattaaactgtaaggatgaaaatgaaagcagcgggtatcagctctgacatttatagagcatggaaatcatcatacctagccttgctcaagaaacagctgaacaaaatgaaaatcagaacttttcttgcatctatcagagaaatgagattgcagagcaaagtgctgccctaaaatatggaaagacaagccaatctaggaagtctcagttgagatctgcatacttggagcagaagctgctggagtcttaaactggtaggaacacttcaatggtaattttgacaaattgctgaaggttgtttatgggctagctggagattgagaaactcctgggtctgtagtcttaacagtggcatcacatttttatagattttacttttaggaaccccacaggtttgtacagtgtagagccaagaaaaatctcatattggttctggcaggaagaaagggagagtaaccattgtgaaatacacccggagccttctccataacaaagacctactctccagaggaaaagactaccagagtcttatcccacctgggagaagggcatttctctgactccagccccctctagttttactatctcacctaagggggaaggggaaagaaactgagaaatactcgtgaaggtgacaggcccactgaatgactgagatttaatcgtaagatagcagaatgcttcctttcccccaacatcttaccaccacaccaacagggctacagtgtaactgctgggttacagccaaatgagttataacacacagactctatctgagggggagttctcagggaagcccaaagacaacagaggacatacaaacagggacactggaggaatttgaagcctctggcacttaccactgcagcatgtattaaacacagccaaactcctagctagattaacataaaacctcacactaaaggcctatttagaccagttcctattcccaatacatcatgtctggcttacaaaaaaattacaagtcatgctaaagggaataaataacacagcctgaagtgtcttcaaaccaagcatcagaaccagcctcagatatgacacatatcttggaattaacaagcaggacatttaaagtaactacgattaatatggtaaacgctctgatggaaaaagtagataacatgaaagaacagatggataatgtaagcagagagatggaaactgtaggaatgaatgaaaagcaaatgctataagtaaaaactgcaacaaaaatgaagaatgcctttgatgggctattctggacacagccaaggaaagaagcttgaaaatacatatgtcagtgaaacttctcagaaaggcaaagagaaaaatagagtttaaaacagcaacagaacatttaagaatgtgagatattttcaataggtataagatgtgcaattatatgagaaggcaaagaaagaacagaagaaatatatggtaagatatttgaaggctaggaattgatgcttaaaaagcctctgacaaaatgcaacgttgattcatgataaacattctcagcaaactaggcataaaggtgaatttcctcaacttattaaagaacatcttacaaaaaaagcctatattgtacttaatggtaagaaaccatactttctccctaagattgagaatgaggtaaagatgtcttctgtcaccactattagtcaacatcatattggataacttagtgaaataagacaagaaaaggaaattaaagctatatattttgtgaagtaagaaataaaactgtctttgttcacaggtgacatgattgtctatgtagaaaattgctaggaaatgataaacctcctggaacataaacaagtagagcaaggttccaggacacaaggtgagtatatataattagttattttcctgtataccacaatgaaaaattaaaaaaacactaccatttacaacagcaccacaaaaaaagaaaaaagtacttaggcataaatctaacaaaataaattcaagacgtataagcagaacactgcaaaactttgatgaaagaaatcgaagatctaaataaacagattctatatttatagattggaagactcaatattgttaagatgtcaagtcttcccaacttgatctgtagatgcagtggaatcccaatcaaaatcccagaaagcaatttttgtagagattaacaagttgattctgaagtttatatggaaagcctagaaacccagaatagccgacataatactgaagaggaataaagttgaaggattcacacaacttgatttcaagactttttattacattgtagttatccatgcagtatgatgatgatgatgatatgaaacaatagttctatttcaatcaatggaacagagagcccagaaatagactcacacagataataatcaaatgatctttgacaaaggagcaaagaattaaatggggaaaggacagtcttttcaacaaatttacattcatatgcagggtagtgaacctagacacaaatcttatacttttgacaaaaattaaaatggaccataaaccgaaatctgaaatttaaaactagaaatcttctggaagaaaacacaggaggaactctaggtgaccttgggtttggctgtgagtttttagatacagcaccaaaaacataatctgtgaaagaaaaaaactgataagttggactttattaaagttgaaaatttctgctctatagaagacattgttaagagaattgaaagacaagccacagactgggagaaaatatttgcaaaatatgtacctaataaaggaattgtatccaaatataccaataactctaagactcaataagaagcgtagacagtttggcagtttcttacaaaactaaacatagtcttaccatacgatccagcattcatgctcctaggtatttacccaaatgatttgaaaaccatatgccaagacaaaaacctgcatgcaaatgtttataacaactttattcataatcagcaaaaactggaagcaaccaagatgtccttcagtaggtgaatgggtaaactatggaacatccagacagtagaatattattcagtgataaaaataaatgagctatcaagctacaaaaagacatggatgaatcttaaatgcatattgctaaggtaaataagccaatttcaaaaggctacaggctacatgagtccaattatatgccattttggaaaaggcaaaactatagtaacagcaaaaggattggtgtttgccggggggaaggatgggaggggaggacttaaatacagtgaaacacaggagatttggggggtggtgaaactattctatatgatactgaaatggaggaatacatgacactatgcaaaatctatggaattcaacaacacaaaaggtgaaccataatgtttgcaaaattttaaaaaatcacttaggggattgggtgatcccaggatagaatgcagaatgtgataaaattacaaatgtgtaaaataactcactgaaatgaatgagggaaaaaggtgctgatttaattgactatggaaatgagtagagtctgtaagattaaaggcaaaagaatctaaacgtaagaactgtagttgataatgtatcccatgagtgtgtggattaacaattctgataatgctatacatgtatactgaaattgaacaattaagtaaatggatggaagatggagtcaaccaggtttctcactgtcggagtggaagttcacagataaacatgggaaaaggctagaataatccatgtaataatggattaaagttggagacatcattatgaactcatgtttagtttaatataggcacatacagtttcatatagaaatatttatggatatttttaaaaacacatggaagggggctgtgtcaaaagagcctgaagcccaattgaaagggttaccaatggctaaagctggaatagtttgagcaagaaaatacagtattgggttataatccaaaataatagatatccataggtccatactgatgcaaataaatgattaaagggagaagaggaaaaaaaatctaccatgcaggataatttccaatttatgtagatattctgcatcaagaaggtggaatataacttcccaccccttaagtgtgagctgtgcatagtgccatcctttcaaagagtacagtagggaaagtaggaaaaaagattacattggagaacctgacaaacactccctcagtcaggtgatcaaagtcatcatcaacagtgataagtaatgttggtagtgtatacccttgacatgtgactaaaatggtacttgatctctgtggtcttttttcctcaaacccataactctaactttgagaaaaacattagataaagaccagttgaggggcagtctacaaaacacttggccaatacttattaaaactgtcaaaattatcaaaaacatggaaagtctgagaaactgtcaagaggagaacttaaggagacatggtgattaatgtggtatcctgtatgggatcctggaccagaagatgtcattaggttagaaactaaggaaatctacacttaaaaacaaacaaacaaagaaaatataaataaattgaacttcatcaaaatttaaaacttgtgcttcaaatgatactataaatacaatgaattcacagaatcggggggaaagtaaataatgtagctaagagagttctagtatccagaatatatagagttcttataattcaacaataaagagacaacccatattttaaaggggcaaaggatttgaatagacatttctccaaagaacatatacaaaaggtcaatagtgcatgaaaagatgctcaacctcattagttctaacggaagtgtgtcacaaagccacaatgagatataactttacaccccataggacaactataataaaaaagacagagaataacaagtgttggtgaggatgtggagaaattggaacccttatacatggatggtggaaatgtgaaatggtgcacttggaaaaacagtttgtcagttcctcagaagttaaatgtagagttaccatatgagccagcaatttcactcataggtatacctgagaggatttaaaacacgtgttcacccaacaacttgtacacagatgttcatagcgttattcatatagccaaaaagtgaaaacccaaatgtctgtcaactgttaaatgggtaaacaaaatgtggtatagctctacaatggaatgtcgttcagcagtaaaatggaattaagtactgatacatgctacaacatggatgcaccttggaaacgttatgctaagtgaaagacgccagtaacaatcatcaaataaatgcaaataaaaatttcaataaggtaccatctcacactattcagaatggctattaagaaaagtcaaaaaacaacagatgctggtgaggctgcagagtaaagggaacacctacacacctagacactgctggtgggaatgtaaattagtcaccgtggaaaacagtttggagagttctcaaagaacttaaaacagaactactattgaacccagcaatcccattattgggtatatactcaaaagaaaataaattgttctaccaaaaaaacacatgcacttatatgtttgtcgtagcactattcacagtagtaaagatggaatcaacataggtgctcaacagtggattggataaagaaaaggtggtacatatatactatgaaatactatacagccataaaaaggaatgaaattatgtccttttcagcaaaatgtatgcagctggaggccattatcctaaatgaattaataacaggaacagaaaaccaaatactgcatgttctcacttaacaagtgggagctaaacattgggtactcgtagacataaagagggcaacagtagacactggggactacttgaggtgggaaggagggtgggggcaagggttggaaaaactaactgttgagtactatgctcactacctgggtgacggaatcaatcataaaccaaacctcagcatcatgcaatatactcatgtaacaaacctgcacatgtactccctgaatctaaaataaaagttgaaattatttaaaaagccagtaacaagagaccacatgttgtatgattccatttatatgaagagtccagaataggcaactctgtagagacagaaagcagattagtggttacctagggctacaagtggggatgaggcattaggaggtgactggtaatgggtacatggtttctgttttgggtaacaaaaatactctagaattagatagtggtaaatatactaaaccctactgaattgcacactttaaaaggatgaattgtatggtatgtggatgatatccgggtaaagattaaaactaaggaaatctggataaagtatgcacttcagttaataataatgaatcaatattggcttgttaattataacaaatataccatactgatgtaaaatgatagtatggaaagctaggcttggggattgtgggaactctgggctatcttaatagtttttttggtaaatctaaaaccattctgaaaaataaaattaaaaaaatgaaagcagctgttgcaatgtcagaagtgaaaacacacaaagtcctacttatgaaaacagaaggatatttggaggcagttgttttagaaaaaagactcaaggttggggggagtcttattaaattgtaaggcatgaattgaatatattcaccaaaactcttggcggcattggtagaaaatctggctggcttttatgcaaactgaatatttgcatggctactaagtttttcagcccaaataattcaccttccttacccttacatttgtgtacttatatcagaatatttatcatgtaggatatgaaaaaaaatatgctggagttccagcatcacagaaggtggcatggtactcacattcagaacatagagcagttctgttcaagaacctctttacaagtgtattagtccgttctcacactgctataaagaaccacccaagactgggtgatttataaaggaaagaagtttaattgttgcacaatttcacatggctggggggggtctcaggaagcttacaatgatggcagaagggtatcacttctcggccttttgactaagatcaagtgtagaatcatggcagaagtgaaagcaaacatgtccttcttcacatggtggcaggagagtgagttccaagcaaagggggaaaagccccttatataaactatcagatctcatgagaactcactctcacaagaacagcatgggggtaactgcccccatgatgcaagtacctttcactgggtccctcccacgacatgtggggattatgggaactacaagatgagatttgcgtggggatacagccaaaccatatcaacaagatttgttaaattatatttcacatctccctaggggagaaaagacaaatgcagattttagcatgggaaaagaaacagaatgagtcatatcaaggttttaatccaagtcattcagtgatttaaaaaaaaagaaaaaagggatgttttttcccttattgtttcaactctatatgagaggtaaacctttcctttccttgtaaaattcttttcagccttcaaggccaagtcttctatgaaacttcactttctccctggtccctactgtattcctttgttgaactcctctaattaatatgcatggcatcacaacatcaattcataaataagagactgttagaatgtttattaattggccgggtgtggtggctcatgccatgtgcagtttctccttctctgttaaatcattttcgtctgcatattacaagctccagactctcttatcttaaccagaaaaaaaaaaaaaggaaagaaagaaagggaaagcttccttgacactttctgaactttcctggttcatttcctagaaatatttctcaaattctatctctctgtcttcaggtcttcacttcttaagcattctataaatttttaaaattaaaatttgaactcaggccaggcacggtgggcccatgcctgtaatggcagcactttggaaggctgagatgataggacaacttgagcctaggagtttgataccagcatgggcaatgtggcaaaaccctgtctctacaaaaagaaaaattaggcaggtgtggtggtgcatgcctatagtcccagctacttgggaggctgaagtgggaggatcacctgagccttgggaggtcaaagatgcagtgagctgtgattacatcactgcactacagcctgggtgacagagtgagaccttgtctcgaatgaatgaatgaatgaatgaataaataaaaatttgaactcaaatgtaataagtgtatttgatatatatctaccacttgatatcgctctttttttatagaaacatttaaagctcaaccttttatgtctgaaaaaagctcaacctttcatgtctgaaaatatctttatactatccttgtacttaattgatagtttgctggctttagaattttaggtcagaagtcatttttccttagaatgttgaaggcattgctcagttatcttccagcttccagtattgctcctgggaagtttgcagccactttgattcctaatcttttggatgttgatctgttcccaccctcttccctgaaagcatttggaattttctctttggcttgcttttccgaaatttatgatggtgaatcttggtgagaatctatttgcatttgttttgcttgactctctggagccctttcagtctgggtaacaagcctttcaattctgagatattttcttgaattccttcattgttgatttccaatccatatttttctatgctctctttttagaactattatttggttgttgaccttccgaatttatcagtagatttaaatttttttctcttctgtttttcatttctgagtttttttttctgtatttttaggaagatttccttgacttttcttccagccttcctaatgagttttcttcctgtgatattgttttctctctttaaaaatatttcccacttaaagtgtgcaatccaatggtttttagtacatctgcagggttgtgcaactaccacacatcactatcaattttagaacattttcattaaccagaaataaagctctatacccattggtagtcacacccctatttctccacaccttctcagccttaggtcaccacttatctgctttctgcctctacagagttgcctgttctgaacacttcatataaatggagtcatataatatatggtctcctgtcattggcttttttcacttagcgtaatgttttcaaggtccatccatgttgtagcatgtgtcagtacttcattccattttattgctgactgacattccgtcatgtctgtaccacattttgtttattcatcagttgatggacatttgggttgtttccactttttggccgtatgaataacgctgccatgaacatttgtgtacaaattgtatgaccttttttttttttttggagacggagtctcgcccttgccctgtgacccaggctggagtgcagtggcacaatctcagctcactgcaacctccgcctcccgggttcaagctgttctcctgcctcagcctcctgagcagctgggattacaggcacatgccaccacgtgtggctaatttttgtatttttagtagagacggggtttcaccatgttggtcaggctggtctcaaattactgacctcgtgatctgcccgcctcagcctcccaaagtgctgggattacaggtgtgagccactgcgcccggccgtggacacatgtgttttaaactcctttgggtatacctaaggagtgaaattgctggctgctatgataattctctttaatgttttgaggaactgccaaactgtatttccaagtgtacccattttacatttccaccagcagtttgtgagggttccagtttctccacatcacatcctcatcaacatttattattgtccatcttgttaattatatttatcctactgggtgtgatttggtacctcggttttgtttatttgttttgttttgggttttttttttttgagacagagtctctttctgtctcccaggatggagtgtagtggcatggtcatagctcagtacagtctcaacctcccaggctcagtcaatcctcccacctcagcctcctgagtagctgggaccacaggcacacaccaccacgcctggctaatttttagtagatatgaggtcttgcagtgttgcccagattggtctcgaattcctcaaactcaagtgatcctcccgccttggcctcccaaagtgctgagatgataggcataagccactatgcctgtctggtactccagttttgatatgcattttcctgatggttaatgacgttgagtatcacacagtcgctgccgccagcccgtgcaccatgtcctcctactgctctgccgccctgctcctccgcctgtcacaatggaagaagagattgccatgctggtcattgacagtgtctccggcatgtacaaagctggatttgctggggacgacgccccctgagccgtgttcccctccatccttaggcgcccctggcaccagggcacgatggtgggcatgggtcagaaggactcctacgtgggtgatgaggcccagagcaagcatggcatcctgaccctgaagattgggactctgaccccattgagcgtggcatcatcatcaactgggatgacatgaagaagatttggcaccacaccttctacaatgagttgcgtgtggccccggaggagcacctggtgctgctgacagaggcccttgtgaaccccaaggccaacagagagaagatgacccagatcatgtttgagaccttcaacaccctgtccatgtacgtggccatccaggccatgctgtccctctatgcctctggatgcaccactggcattgttaatggaccctggagatggggtcactcatacagtgcccatctacgaggcctaagccctcccccatgccgtcctgcatctggacctggctggtggggacctgactgactacctcatgaagatcctcaccgagcacagctacagcttcaacaccatggctgagtgggagatcttgggtgacatcaaggagaagccgtgctatgttgccctggacttcgaacaggagatggccaccgccgcatcctcctcctctctggagaagagctaggagctgcctgacagcctggtcatcaccattggcaacaagtggtcctggtgtctggaggcgctgttatagctttccttcctgggcatggaatcttgtggcatccatgagaccaccttcaactccatcatgaagtgtgatgtggacatctgcaaagacctacatgccaacaaggtgctgtccagcggcactaccatgtacccgggcatcaccaacaggatgcagaaggcaatcactgccctggcacccagcaccatgaagatcaagatcatcgtgcccccagagcgcaagtactctgtgtggatctgcagctccatcctggcctcactgtccatcttccagcagatgtggattaacaagcaggagtacaacaagttggcccctccatcgtccaccgcaaatgcttctaaatggaccgtaagcagatgtgtagcatttgctgcatgggttaattcagaagtataaattgcccctggcaaatgcatacacttcatgctagcctcatgaaactggaataagccttcaaaaagaaattgtccttgaagcttgtatctgatatcagcacttgattgtagaacttgttgctgattttgaccttgtattcaagttaacttttaccccttggtatttgtagaatgcctatacatatctttgatttcttagtacaagtggcttggtcactttgtggctgttgtaagaacgtgcttgtggaagacaagtctgtggcttggtgagtctgtgtggccagcagtatccgatctgtgcagggtattactgtgtcaggacttagtgttctggaatttctctagaggctggtaagggctcctgaaccagtggtttctgtcctgctggtctgtcagggttggaaaagtccaagccataggacccagtttcctttcttagctgatgttttcctgccagaacaccgagggctgttaacttgccttgagttggaagtggtttgtattgatacctgtaaatgtattaatccttttaatttatgtaaggtttttttgtatgcaattctcaattcttcaaagagatgacaacaaattttggttttctactgttatgtgagaacattaggccccagcagcacatcattgtgtaaggaaaaataaaaatgctgccgttaaaaaaaaacaaaaacctttttatgtgattttggctatttgtatatgttctttgcagaaatatctatttaaatcttttgactgttttagaattcggttgtctttttattattgaaatataagagtactttatatattctggataccaaacccttatcagatatatgattagcaaatattttctcctgttctatgagttgaatttttactctattgatagtatcttttgaaacacaagaaattttgttaaagtccaaatgtgtttattttttcctttgttggttgtggttttgaggtcatatctgttatctagtccgaagtcacaaagatttatggctatattttcttttcagaattttatagatttagctcttacatttaagcccttcatccattctgagttaatttctgtatgtagtatgaaatagtggtctaaattcattattttggatatcgatatatggttgtcccagcaccatttgatgaaaatattcttttttctccattgacttgtcttggtaccctcaccaaaagtaaattgaccataaatgtgaaggtctatttctgggtttctcctatttatgtttttagcttccaagagctctttgtttttctccaattgcttccatattcatcctgtttttctatcatgggtccattatctttgtgaagatactaataatggcttttaaagctttcatttctctgtatagtctctgtttctccaggttacctttttctctgcccacgggcttgatctctgtgttttattccatagtgtctattaaaatatgtattgttctcaattgtctgctcaagtttaaagacagagcactaaaggctagttgaaagctctgtgcgtttaagtagagcctaccagctgtgggcctcactgtcagatgatctagtagactttatcaatgtggcaatatctaaattgtttttcttaaacaacttagaaagctctctcttactcttcatggaagggtataatcatggctcccaacattctacagtttcaatgtggagtggactgggttttttcaactgttagaaagtaagttttcccttagttctacatgttttcagtaaagcatctgcatcttcaaaagtgtctagtggcccctagggcaaaacccctgctttttaacttcttcagagaataaattctggtttcctgtatggattaaggggcgccaaggtgatgagtcacccagcgaggtataatagtggagatgacatagaggcctaagtgcttcttaaaaatcagctcacctgtatgtataacaccacttccagagacttttggaggttccatggtataaaccaggctgctttttcccactgctggcttaggactcagttttctcaaatctgcagtcagttaccactccctccattctccagtatccacagttttgttgctgcaatttcttcttccattctcttcatccttgtgggtttataactaaaaagaaaaccaaaaataaagcaaccctttacatttattgtagttggatttctggaggtaaaaagttaactatttgtgttcattctgtcatctttaaccacaagacagaatattaaacaatatttttgctattggtttgtaatttatgttataagtgcattggagccaaagataaaatctttgaaatttgttgagggtgactttatgagccttggatcgattaatttttataaatgtttcatatgtgcttaagaagaatgtactctataattgttggtatctaaatcatttgttggatcaaacttgctaattattatataaaatattcacatacttggtaattttcttattcttaatctatcaattatctagagaggtttgttaaaatctaccacttcaattgtagactcatcagtttctccttgtaaatctgtcaacttttgcttcatatatttagaagctatgaattagggccatacatgttccagagtagttctatcttcttgctagattactcctgttaatcatatataataggcctctttatttctccatcaatgctttttgccattagttctgttttatctatcatatagttttgtctaattttagcctggtacatctttttctatccctttactttcagcctttctatgtttatgtattttaggtgtatctcttgcaaaacagcctataaatgaattttcaaaatcaatctgacagtatttgtcttaacttgaaattttacatttattataattactgatgttagatttatttctactgtttgtataatgctcactactgtgtttttactgtttatcgttgtctttttctttcctgccttctaccagattgcaagccctcccactcttttttcagtccattaatttggaagttatatattctgtttgtattatgttagtgaatactcttaaaattttaaagttgcagttgacttaaagtccaaattcagtcaaattctttattcttctccaaaacaactccgcagtcttgttctgattatgtgttattattgtccagtttttatacttgtttttgtattcaaatttgttcttttttgttgttctgtggcttggatttatacaggagtcttaattctgccttatgcagactcttcctactccctatatttagttgattggaccaggggtagaccctggatctaagtcaggctaacccctggaaacctgaaactgggcccaagagacactagttggaactagtgaaaagccagagatgagagagagggaaaatttggttcctgatgactttgcagtttctgattccagtttctcaagaggtgcagctttggagttctctgagatatccctgtatccttgcaataaattctcctgttttgttaaagtaatttatagtgggtttctttcttgttatcaaaggaacttgaaaatgccattctccttcccagaattactaattttaaattaattatatcattgcacatctgtttaatacttcatagcttactaaatatgtactgtcattaatctattctccttacaacaatgtgaatattaatggtttttcaactagataaatgaggaaactgaggcccagactcatgaaatgattgacccaagttcttaaagatatggttgatcagcttatatgaaaacccaggtgttatttttagcccagtggcttcctatgcaccattgcattctaaattgtcctaaggttgtcacaaaggttgttttcataacatagagcttcattttctccaaagaaatagaattgagattacagggaaaagcttttatattaaatgcttagataatataatgagaaatctgttattctatttggaggaaaattactttgagtacaattgatatgatgtcaattgctatgatacatggtttttaataaccaacacaggtggaggcttataataaaaggatgccttgctattatagtagaagaatgaaataacctgcagtccacatttatctgtgaatgctactcagttttctttcttcttagccttgcagttttctttaaattagaaaattaaatcttcagggtcattattttaaaagatattctattcctcttccctgataataaattccttatatattaagaattactggaacaatatttttatcctgtatatgaccagtgatttaaaggatgctttccatttctgaaattgcattaggagtacataaatgctttttaaaaattgttcagtaaagcaagtgtgatacctatttgcaacactaggccacatgtgggatttttaaaacaatgaattagtcactgtctttaaagagcatatagctgataatattaccagccaatattccttgaatgcttactatttgccagtcactgttgtaaatattttagatcatatgttaattcacttaatcttcacgacaatcctgtgaggtatatactattattatcaccattttatagatgagaatattgaggtgcctttacagagaagggtagagtaacaagctcaagtcacatagctagtaagttgtaaagtcaggactagaatatatgcctgactcgctgcaaagttcatgctttttcttcttatgccatgctgcctttaagcgctggggaaaagcagtctagtggggaggctaatgaaataataccagtgtgaggtaataagttcctggaataagtgcagtcatattaccacatttcttgaattttctcagtagtgatttcagatactctgcttgtccctgtgagccatgaaaatgttaggcaaaatcttgttttagtacataaagtaattgttttttgaacctagaagtaattatatttcttttctcaggctgtgtacaaatttttgattacggtaacatgatcaccacgggaagtgaggatggagaaaaaaatcatttcaagggaatcatactaataatacatattcacctttttatcagtcattactagataacatgatgaccatgggaagtgagaatggaaaaaaaaaatgatttcaagggaatcactgataatacctacgtttttatcagtcattactaggtgttagacactatgctaagtgttttacccgttttaatttaacctcacagcaattctgttaggtaagtattattactcaccaaagctaagaaaggttaagtaagttgtacagtctcacatggctcattagtgatagaactgtgttttgaacacaggtctatcccattacagacctctttgaaactgtttctggaaacaaatttgatgtcactcaaatagcccagggatgctaagattacaacatgtcaaatgcctctgtagtgacagatggtttggataacaagattgattgaagttaactttaacctgagaaattgtgtggttttagatggaagaagaggtgttgaaggaagactgagccagctgctgatcaatgggatagaatttgagagggagaagtgttggaagtggagttacagtttcctccctgattttttcctgattaactttactactcagtgcaggtttgcgatggggcaatcttgctacagtatctcctctgtgaactagtctccacacctagttaagttaatatggttagttaggttaatatgtaaagttaagcattgagcttggtatcagtgacccaattaagatggtttcactcccaagaaaattcatataagaataactctaagcatggccatagattttaatcaaaccttgcatagaattttttttctttttttttaaaaaaaaattatttttcttttaagttccagggcacatgtgcaggatgtgcaggtttgttacataggtaaacatgtgccatggtagtttgccgcacctatcaacccatcacctaggtgataagcccagcatgcattagctatttttcctaatgatctcccttcccccacccaaatcctgataggccccagtgtggtgttcccctccctgtgtccatatgttctcattgttcagcttctacttacaagtgagaatatgcggtgtttggttttctgttcctgtgttagcttgctgaggataatggcttccagctccatccatgtccctgcaaaggacatgattttattcctttctatgcttgcatagtattccatggtgtatacgtaccacattttctttatctggtctatccttgatgggcatttgggttgatttcatgtctttgctattgtgaatagtgttgcaatgaacatacatgtgcatgtatctttgtaatagaatgatttatattcctttgggtatatacccagtaatgggattgctgggtcaaatggtatttctggttctaggtctttgtggaattggcataccatcttccacaatggttgaactaatttacattctcaccaacagtgtaaaagtgtttttatttctctgcaaccttgccagcatctgttgtttcttgactttttaataatcgccattctgactggtgtgagatggtatctcattgtggttttgatttgcattctctaatgatcagtgatgttgagctttttttcatgtttgctggccgtatgaatgtcttcttttgagaagtgtctgttcatatcttttgcccactttttaatggggttgttattttcttgtaaatttgtttaaactctttgtagattctggatattaggcctttgtcagatggatagatcacaaaaattttctcccattctgtaggttgcctgttcacagtgattatagttttttgctgtgcagaagctctttagtttaattatatcccatttgtcaatttttgcttttgttgcaattgctttcatcatgacatctttgtctgtgcctatgtcctaaatggtattccctaaattttcttccagggattttatagttttggattttacatttaactgtttaatccatcttgagttaatttttgtataatgtgtaaggaaggggtccagtttcaattttctgcatatggctagctagttcttccagcaccatttattaaataggaaatcctttccccattgcttgtttttgtgagctttgtcgaagatcaggtggttgtagatgtgcagtcttatttctgagttctctgttctgttccattggcctatgtgtctgtttttgtaccattaccatgctgttttggttactgtagccttttaatgtagcttgaagtccagtagtgtgatgcctccaactttgttctttttgcttaggattgtcttggctatacaagctcttgtttggtttcatatgaattttaaaatactttcttctaattctgtgaagaatgtcaacggtagtttaatgggaatagcattgaatctataaattactttggggagtatggctattttcaccatattgattcttcctgtccgtgaacatgggatgtttttccgtttgtttgtgtcctctctgattttcttgagccgtggtttgtagttcttctcgaagaggtccttcacttcccttgttagctgtattcctaggtattttattctttttagcaatcgtgaacaggagttcattcatactttggctctctgctagcctgttgttggtgtataggaatgcttgagacttttgcacattgattttgtatcctgagactttgctgaagttgcttatcagcttaagaagcttttgggctgagatgatgggattttctagatataggatcatgtcatctgtaaacaaagacaatttgagttcctctcttcccgtttgaatatccttttttctttctcttgcctgattgccctggccagaactttcaatattatgttgaataggagtggtgagagagggcatccttgtcttgtgctggttttcaaggggaatgcttacagcttttgcccattcagtatgatatcgactgtgggtttgtcataaatggctcttattattttgagatatgttacttcagtacctagtttattgagagtttttaacgtgaaggtatgttgaatgttatcgaaggacttttctgcatctattgagataatcatgtggtttttgtctttagttctgtttatgtgatgaattacatttactgatttgtgtatgttgaaccagacttgcatcccaggaatgaagccaatttgattgtggtgaataaggttttttggtgtgctgctgtattcagtttgccagtattttattgagaatttttgcatcgatgtttatcagggatattggcctgaagttttctttttttgttgtttctctgccaggttttgatataaggtgatgctggcctcataaaatgagttaaggaagagtccctccttttcaattgtttggaatagtttcagaagaaagggtatcagctcttttttttacctctgttagaattcagctgtatatccgtctggtcctgggctttttttggttggtaggcagtttattaatgtctcagtttcagaacttgttattggtctgtcagcagttcagttacttcctggttcagtcttgggatggagtatgtgtccagcaattgatcaatctcgtctagatcttctagcttattcgcatagaggtgtgtatagcattctctgatggttgtttgtatttctgtggggtcagtggtgatatccccattatcattttttattgtctatttgattcttctctcttttcttctttactagtctagctagcagtctattttatgaattttttcaaaacaacagctcccggattcattgattttttttttttgaagggttttttgtgtctctgtcttcttcagtcccactctgagcttggttatttcttgtcttctgctagctttggggtttgtttgctcttggttctctagttctgttagttgtgatgttaggttgtcgatttgagatctttctagctttttgatgtgggcattaatgctataaattcgccttttaaccctgttttaactgtgtcccagagattctggtacgttgtcactttgttctcgttggcttcaaagagcttcttgatttctgccttaattttattatttacccaggagtctattcaggagcaggttgctcagtttccatgtagttgtgtggttttgagtgaatttcttaatcttgagttctaatttgattgtgctgtggtctgagagactttttgttatgatttcagttcttttgcatttgctgaggactggtttacttctaattatgtgatcaattttagagtaagtgccatgtggcactgagaagaatgtgtattctgttgttttggggtggagagttctgtagatatctatcaggtccacttgatccagagctgagtccaagtcctgaatatctttgttaattttctgtctcaattatctaatattgatagatcccactggaattttttagggtacttgctgttccaattgtggtgaaagaaaagtgttaacaatctgaaggctgatagttcagaaaaaaatataattaattagttatcttttttaacagcatcacctgttaatgtattttcactgatgagaggattttatcacatctgaattttagattttagtgctttttaaagacagtaaacaacaatgtttagtcaaagggttatctgcactattaacctcgtatagtgctgggcatataaatgcatgaaaaatgctcattgaataaacaagtgaaaatctgccttttatttatgcatgcactattgcttttcctaatgcattgctgtaagaatgtccataatatcaagtcacaaaaagagcaacttaaaaggaaaatgaaatacttaatattaccttctgttgacttctgaaggaatgagctattgttccagatattttgtatttccaaaataaaaaggtaactgaaagacaatttgcttttttggcattccttatttttgtgcacattattagattgctcattttagatatttgagcttttagctccttcccttaatttacttttttttttgttatcaatgcaaattgcaaatgttctgaaataatatttaagaaggccattcagacagtgatcagtcctttgtaatagacccaaataatatgttttgtatgtttctggggttaggaaacttctgtaagtgaactgatgatttctaacagtgcttgaaaattagagaattagaatcccagaagtatttttctcagtagccatctaatccgtcattcttccaccacatatgccccctcttccaccaatcctcaggttttccctgtgttcatactgcttacttgaatatctatattgatttgtaatctcttttcccacttatctatatgccactcttacttcaaggcccaactcaagtattatttcctctggtgagctttcctatagctcacattgttcgttctttgtgtgcttattggtttgtcattaactttaatatttgttctaaggggtagaactgaaggaccaatgggcggaaactaaggaagacagaattaggatcagcatgtgtgttggggatccccagaaccacccccattttgatgattcactaggggaacacccagggctcagcatatagtcacatctaagatatattactgtgaaagaatacaaagcaaaatcagcaaagggaaaatgagcattgggcaaagtctagaggaaatcaaacatgagctttcaagggtcttcctctggtggagtcacataggatgtatttaattcctcctaagttgtgacaagggtgatatgtctaccaggaaagttcattagactcagtgcccaaactttttacttgggcctggtcacatggacaccctctgcctagcacataccaaaattacagacccgcaggagtaaagcaggtattcagcataaagcacattgcataaacagtttaggcacagtgaaccactcttatgagtcctgagaattgtattatccctcctgaaatccaagttctcagatgccggccaaaggccaaatttgcgaacaggcttttgtaaggatagcagtctcaagcttgctatattaactcttttctgcaaagtttggtattaggaaggcctttccaaagtgctaacttcagaactaggctgacttaagaagtaagtattacctttttactaaaaggcatttacaaataaattgtgtgagaagttttagaggatgtatatccattgctcactgaaaactcactgttattcaaatctggggcttttataatcccttgatatatattatagtttctttttttaaaaactgtgttactcttttattatacaggagaatggctttgagttagaagtcaggatacttgagttttgatgtagtgttgtcactcttcacctatctccttaatatctcttacctatttataaaggatttgaacttttttatttcagagttttcttcctagctcatatttctgccccttgagagagtccattggatttctttgatttttaaaaagttcttaatgatacctagtagaaaaacctactttcccgtaatatttaaccattcttcttcttattttttccccgagactgagtctcactctgttgcccagactggagtgcactggtgtgatcttggctcactgcaacatccacctcctggattcaagcgattgtcctgcctcagcctcctgagtagctgggattacaggtgcataccaccacacctggctaatttttgtatttttcgtagagacagggtttcactatgttggctaggctggtctagaactcctgacctcaggtgatctgcccacctcagcctcccaaagtgttgggattacaggcgtgagccactgcgcccagcctgttgtttttaattagatcttttggagacagctctattttttacctaggatgtctgtgaataatagttctgtctctctctgtattggtggtaacaaatcttgcagactaaaatttgagtttagcttcctacctagggttggtggaactgcagtggtgaggaatgggaaaactcaaggagagagctagggacaataggaatgtttattccttcctcccaaagtttctccttagacttggaaagtcttcagggttaggaaaatccttagaaaatactggaagtgctaatgttcctgaaattcctatgtcattataacttctgtttttgtggactgtcatgattctctgagtataaagagcctatgtgtgggctgctgctcccactgaagatggcacttcatcatctgttctacctagtggtctctggtgagaatgatggagcctaaccatctgctagttttaatctgtctggaaacaggagccctctgagattgaggaaaacctagtttctccatctacctagcagaattaccacaatatctccattcaatcccatatgctgccagcactctaccaagtaagaaatgaccaaagttaggaacagagaaatccttagagaccatataatgtgtttcatgggttgggatagggagaggagaatgctggaatagtccccttgttcagacatgtctctccccattcttataatttagaaaccctgtttatggcatctctgttaggtagccatctaaggtttaattaaaactcttcattgatcaggaatttatttctgccccttgagttaagccatttaatcactttgaatgtattttttataatgttaagatgaaaactgcctccctataatatctaaccatttctaattttcttaattatgtcttttcatatcactcagactactccatttttttttcctgaggagcccttcaaaataatagagagttttattctctttttattaattggtattgtcttataccctgcagatgctcttgggaaatgtaatctattaaattaatattcaaattaattaaacagattctttcctcctggacagtggctcagataataatctagaaggaatattatgcccagaaatcttgttcttcaaaaatgaaggggagataaaaatctttctcagacaaaaactgagggaatttatcaccactagacttggcttatacaaaatgctaaagggagtccttcaagctgaaggaaaatgttactaagcagtaacacaaaaacatgaaagtacaaaactcactggtaaaagtaatcacatagtaaaattcaaaatattctagtactgtgatgacagtggaaaatcaattacatctcttatatgaaggttgaaatattatatagctgcaataatctgttaagggatacacattataaaaagatgttagatgtgataccaaacacataaaatggaagaaggagtaaaagtttagagtttgtgtaagtgatcaaagctgttaccaacttaaaatagcctgttacaagatgttttatgtaagccttacggtaaccatgaggcaaaaacccctagtagatacacaaaagataaaaagaaaggattcaaagtataccactgcaggaaatcattaaatcacaacggaggacagcaagagaaaagaggaacaaagggtctacaaattaactaggaaaaaaaaaaatcagcaaattggctgtagtaagtccttacctaataataattattttgaatttaaatggattaaagtttctaatcaaacggcattgaatggctgactgggtaaaaaaaaaaaatatgttgcctacaagagactcacttcactgttaaggacacatttagactcaaaatgaagggatgggaaaagatatgccatgcaaaggagcaggaatagctatacttacatcagacaaaatagactttaattcaaaaactgtaaaaaaagacaaagaaggtcattatgtaaagaggtcaactcatcaagaagacataataatcatatatatatatgattgttatggaatatacacacacacacacacgcacgcacgcacgcacgcacgcactcgatgtcagagcacctaaatatatgtggtgaatattaaaagatctgaagggagagacagactgcaatacaataatagtaaggtacttcaataccccattttcaacaatgggcagattatctagacagaaaatcagtaaggaaacagaagtcatattgcttatcttttccaactacagtggtatgaaactagaaattaataacggcatcttggaaaattaacacgtatgtggaaattaaacagtatgccctagaacaaccaatggatcaaagaagaaattaaaagggaaaataaaaaatattttaagacaagcaaaaatggaaacacagcataccaaaacttatgggatgcagcaaaagcagtcctgagaggggaaattatagcaataaatgcctatatcaaaaaagaaaaatctcaaacaaccttacatcatacctcaaaggaactagaaaaagaacagagtaatcccaaacttagcagaaggaaggaaataacaaaaatcagagcagaaatagataaaatagagactggaaaaacaatagaaaatatcaataaaactaaaagttgggtttttgaaaagataaacaatattgacagtattttagctagactaacaaagaaaaagagaagatgcaaataaacccagaaatggaagagtggacattatacctgataccacagaaatacaaagtagcacaagagacttctatgtaacaaattgcataagcagaagaaataaattcctaaaaacctagaacctattaagatgaatcaagaagaaatagaaaatctgaacaggcaataatgagtaaggagattgaataagtaataaaaagtctcccatcaatgaaaacccaagacctgatggtttcactgctgattctaccagatatttaaagaactaataccaatccttctcaaactcttccagaaaatggaagaggagggaatacttccaaactcgttttacaagaccagcattaccctgatgccaaatacagacaaggacactacaaagaaacaaaactacaggacaatatctttgatgaacatagacgcaaaaatcctcaacaaaatactagcagaccaaactcaacaacatatttaaaagatcattcaccgtgatcaagtgagatttatccctgggatcctaggatgttttgacatatgtagatcaataaatgtgatacagcatattaacaaaatgagggacaaaacccacatcatcatctcgatagatgcaaaaaagcatttgacaaaattcaacttcctttcttgataaaaactttcaacaaattagctatagaaagaatgcagttcaatacaataaaggccatatatgacaagcccacagctgacatactaaatggtgaaaagttgaaagctttttctctaagatcaggaataagaccaggatgctactcttgccacttctatttatcataatactagaattcctagctagagcaattaggcaagaaatagaaataaaaagtatctaaatagaaaaggaggaagggaaattgtttctgctgatgatattatatattttttaaaaatcctaaagactccaccaaaaaactattcgaactgataaatgaatttagttaagtttaaagctgtaggatacaaaatcagcatacaaaaatagcatttccatatactaacaatgaactatctgaaaaagaaattaagaaaacagtcccacttacaataacatcaaaaaataaataaaatatctcatagtaaatttaaccaaagaggtgaaagatctgtatatcaaaaattataaaacattgctaaaagaaattgaagatgacacaataaatggaaagatatcttgtgttcatggattggagacattaatgttgttaaaatatctatattacccaaagtgttctacagattcagtgtaatccctattgaaattccaatgtcatttttcatagaaatagcaaaaaaatcctaaaatttgtaagaaaccgtaaaagactacaaatatctaaagcaatcctgagcaagaagaacaaaactggaggcatcacactccttgatttcaaaatacattttaaagctatcttaatgaaaacagcatggtaccagcataaaaacagacatgtcaaccaatggaacagaatagaaatcccagaaataccagcctgggcaacatggtgagaccctgcctctacaaaaaaggaaaaaaaaaatagctaggagtggtggtacacacctgtagccccggctgcttggggaggttgaggcgggaggatcacttgagcccaggaggttgaggctgcagtgagctgtgttcatgctactgcacttcagcctaggtgacacagtgaggccctgtctcagaaaaatcccaaaaagtaacccatgcgtttatgatcaattgattttcaacaaaggtgctaagaacagacaatggggaaaggacagtctcttcaataaatggtgttgggaaaactggatatctacatgcaaaagaatgaaattggacctttatctcacatcatataaaaaaaaaacccctcaaaatgaattaaaacataagacctgaaatggtaaaactcctaaaagaaagcataagagaaaaccataggttgagcaatgacttcttggacaggaccccagaagcgcaggcaacaaaagcaaaaatacacaatgagattgaatctaacgaaaaagctactgcacagcaaagaaaacaacagagtgaagagacaaccacggattgggagaaaatatttgcaaaccgtacatctgataagcggttaatatccaaaatatataaggaactcaaacaactcaataacaagaaaacaacccaatttttttaaatgggcaaaggacttgaacagacatttttagaaagaatgcatatgaatggccaatagatatatgaataaatgctcaatatctctaatcatcagggaaacgcaaataaaaaccacagtgagataacatctcataccttttagaatcactattaccaaaaagacaaaagataagtattgggggggttgtgaagaaaaagggtgcactattggtgggaaggtaaattagtatagccattttggaaaacgctatggaggttcctcaaaaaatataattactgtacaatccagctgtcccacttctggatatatatccaaaggatttgcaatcagtatgtcgaagagatatttgcactatggtcatttcagcattacagtaaccaagatatggaaacaatctaagtgtttgttaaccaatggacggatacaaaaatgtagtatatatacacaatggaatactatacagcatttacaaagaaggaatttcagtcatttgcaacaacatagatgaacctggaggacgctgtgttaggtgaaagaagccagactcatggaaaacaaatcatctcacttttatgtggaatcttaaaaagttgaacccatagaaggaaagagtagaatgatgactaggggaagtggtggaaggggaaaggagaactgttagttaaagggtgcagagtttcagttagacaagaggaataagttttagtgatctattgcatagcatggtgaccatagttaatgatgtattgtctacctcaaaattgctaaaagaatagattttaaatgttttcaccacaaaaaacaataggtaaaatggtgaataaattagcttgatttaatctttctgcaacatatacacatatcaagacatcacattgtattccataaatatataagtattcgtctgttcttatgttgctaataaagacatatctgagactgaaaaagaggtttaatggacttacagttccacatggctggggaggcctcacaatcatggtggaaggcaaaggaggagcaaaggcacatcttacatggctgcaggcaagagagaacttgtataggggaactcccatatataaaaccatcagatctcatgagacttattcactatcatgagaatagcatgggaaaggcctgcccctcatgattcagttacttcccactgggtccctcccaggacacatgggaattatgggagctacaattcaagatgagatttgggtggggacacagccaaaccatatcaatgcgcaatcattatttctcaaacatttaaagaaaaaagctgggtacagcagcatgtgcctgtagtcctagctacttgggaagccaaggcagggggattacttgagcccagtagtttgatgccagcttgggcaacatagtgagatattatatttaaattttttcttttttaagaaaagaatctagcaggaatagttaatttggaggaatcctgggttatttgtgttatagcagcctctagggagcctgaaggcattgtctagggggagtcaagggaagataattggggagtcagagagagtacagaaatgtaggcacgatgtcatagaggttggctattacccaaggtttgtgggtgtagggggaaatcctgagctggattcaagactattgagatttagtcttgtccttgttcccagagttctgtaattctggacagtcacttgtagtgcttcattttcttatctacaacaagaaggagttagattagagaattcaatgagcactaggtagccctgaaagcactctaggctgtgattaccaagaaatagactaaaagcattttaagagaatttctgcctagatatctgacttggcctccaggagacacatttctctgagactagcaaatttaattttgaacttttttttcttttgatagctaattggcccttatgaattattaaatcagcagctccttaagaaatccacacccagagctgatgaagagaggaagtctctggggctgtggtcttcagaaagcttaagccattttctgcaaatattttatttataaatgactatgaggaaactctagcctgtctctgactttatgaatgtataaacgaaacaggtcatacctaggatcccatgggagcatcaaacacaaacacttaagttaatgtaacttagagtagcccccataaagagatgacacaatgtagtggaaggaatgctaagctgaagagtctgaagacccaagtttaaatttctggctctgccactttcttgccagtaagaccttgagctaatgagttcactcctctgtgcttcagggtcttcagctataaaataagacagttggactaactttcaacttttagtaactgaggcttggcaacttagaagtaagagaatggagctagaagcccatgaacaggaagtcatctgtaatgacatcaaggatagcaggttattcctggccaagagcttgatgtgaaactctacttcctattgttccttggcctaattgatgtcgtgatgctttatctgattgtgtcactgacagactggctagggagtgattttctaacttttcctccacagttaccccaaatgatagagaaaagtgaatcccatggttttgcaggagaggacagcatagcactaaatggtttgctttgagtgatagatgtatttaaaatgttataagacaaactcatgtaaatttggcattctattccataatattgtgttccataatgtagttagttttaatatcagcatgttttaaattgtttttagggaaatggaaattcaaaacttccttcttctatctcttcccctcataatcttggtagatggagggcttaagtctagaagaatgatcaacactaaactgtttataatagtttgctttcagaggtgggattgtagagaaatttaagtttatgtttttatattccttgggctcattacaactatatactaagaacaatcattgtgtaaaattggtactgcaaaaagaatctctatgggtattctgtgaggatatgtattttttttctcattactcttatttaaggagcatggagctataagaagataaccttgctctaatattttctcagaaatattttgatagtttataagctaaatgatagcttgtaatgttagcatttgccaaactgtttgctgtgatctatatgggaaaatttaattaatcagctatggagagatggagaagtagactgattattatagcctttttaaaaggtaacagatcctcacagctcaagtaattcttataagtgagacccagagacagaaagtgacttatttgagatcacatccaatattagcagaagagctaggatttgaagccaggtattttgccttgtctcagagctgttagcatttacttaatttggggtatttttaaaatttaagttggattatgggtattatttatgctagtaatttgcttctgtcaaaatagttaagcctcaagacttagtgggaacactaacagtggtctaccccctgtattttgttccacactcaacatctctgcaggctgtctattggaatagagggtttgaccaccaaataaatgtaagcagcctatgtacaactgttttctataaagacttacttggatattgagaggcaggtgtgtttattgcaaaatgaatgttaaatcttctaataacttctggatttgagttcagaactactttggccaactgacaaaataattgcacaaaatgtagataaactatcaatggaggaagatgtcactaaaacaggtaattcaggcagatcactacagatcaatccattcttctttttgcaaagaaaattcatttttttaaaaaagtgtgtttttcacccaaatatgctttctttaactcttcttgcacatttaaggccgattatcagaggatacttggaatctgaactttttttagactgtatgtgaggaaataatggaaaatattttaattccttcactattaaatggagcaccaaacgttcaaactttcctcgctatacttttaagcataatttctaaagataattaggatttagatttaagtatagaaaaatctatatgttgctctttctttaagaggtggttaagacacaatcattgctttccacgagctcattctagtagggaatacaaatgagagcaattaacctctcatctgtgagagaaaggcttgtatagagaggtatggggagcatagaggaagaagtaagttagtttacctggaggggtcatatctgaatggctttgaagagagtaaaatttctccagacaaaggaactattattccaagcagatctttctgagcttctgtgaattcaaaacacttattagctataccacttatttggcatccctggaccactcatattatttcatttctcatgccttatgtcttcagccagattctaggcttcctgggggtcaaagactgtgtttcatatgtcattgcattgtttcagcactgactctagtgtttcaaaatgttttgtatagttggtacacaattaatgtttgttgattgaccaccttaacatttgagaggtggaagaagggcctgttgagccagagtttgaggtgactttggaataattttttaggtttcttgatcagtattaaagacccattggatctctgagaatagctttatctataacattttccctttttccccattttcattactaccctcactgggggttctctgtgacttctcccagggcctgttagccatcctgattacttttcctctcccacagggtgcctttgaccttaaagttattatttttcctctttgggcatctgttttctcatcagtaaaataacatgaaagtaatctttaagtttctttctagctccaatattctgtgatgccattgtccagaatctctactgaatgggggagcaaattatgtatcacattttttgttataaaaatcaaattggtttattgaacagattctggagaataaaaccttcgttcaagcctcagccttagtggtcatattagtattgtggtctctgtgggtttttaatcaaagaaaactgtggacataggaatggtatcatttgtcagtgtaagctgcaatgaagaaatgcaaggtagaaaaagatgactgacatcattagacccactttgacaagtgtgatattattctcaaagtactcccgggcatctgagttatttttgtctcctgtgggtcagagtctggggcttgttctcctcccctggtaagatagctagtttaatgatggctctgccatcactgaagtacatttggtcttaataatgggcttaaatttttcttggttctgttgggaacttcagctgtaacaaggaaacttagtagtaacgatactttgatgtgggaaaaactaagcaccttttgctgaaatcagttgctctcatcactgactttgagcatgttattttcctttccacattagcgtcttttttctaggtgtcctgctgttctttgctgatatccttactctatatcctaactgttctaatggttacttttcaaaagtacatctctatcccctgactgccttttctcctttctctaaaagtcttataagaaggctctgccctgcaattttttttttttttttgagatggagtcttgctctgttgcccaggctagagtgcagtggcataatcttggttcactgcaacctgtgcctcttgggttcaagagattcttctgcctcagcctcctaagtagctgggactacaggcacatgccaccacgcccagaattttgtgtatttttagtagagatgggatttcacatgttggccaggctggtcttgaactcctgacctcaggtgatccgcccacctcaatctcccaaagtgctaggattacaggcatgagccaccgtgcctggcccctgcaatttaatatttagttctctactgtctaatattattaatctgttttatgtgtgttcattttgtctccttaaatagattatttgcttcttgaaggcaaggagtaatctttgttgatttcgtaatcctagtatcattgggttggccccagaaacaggatggaggaaggagtgaaagagtgtaaaagacaacatttattgaattcataccctttactaggcactgtgatatgtaccttatattttataaaaaaaatttataacagcctaaagataggaaatatcagttccatctcagtcctgaggagacttggcctcagaaaggctaggtggggtgccagaggcagtgtggattcaggcatatttggtattaagtcacctccatctatgccatttactttttgtgtaaccacagtaagtaacttagccattctgagtctcagtttcaagatgagggggtgagtgtaatacctactctgttgggttcttgtgaaccttagtaagaaagataaggtatttaaggggcctttgagtgcctagcacatagaatatctctaaacaatacatatttgacaatagaatggacaggatttgctactggattggttatgatgcacaaggagagaagagtaaagcatgactcccaggtgtcatcttgaacacttgagaagagtatataattcacagagaatatggaatgctagaagaaaaacaggtatggaagggaaatattgagtttaattatatgttgaataggcaactgaatttataagtctggagctcagaggagagatctgaaacaaagatacagtgtaaatcttggagttgttggcctacgtgtggtgactgatgttcttagatagaagagagagaaaaggcaaagtaagatggcctaagttctgaagaacttcaacaccagcagacaggttgaagaaccaggaaactagtttgacgaaagccaaaggaagaaaacatttcaagacagaatcatctacacatgatgtcactttgttctcaccttccacttactcttcagctcactacagtctggcttccgtaccattcccctcaattacactaaaatagctcttttttaaaggaccgtcaggctgggagcagtgactaaagcccgtaatcctagcacattgggaggccgaggcaggtggatcacaaggtcaggagatcatcgagaccatcctggctaacacagtgaaacctcgtctctactaaaaaatacaaaaaattagcggggcatggtggcgggcacctgtagtcctagctactcgggagactgaggggcaggagaatggtgtgaacccgggagtcagagctttcagtgagctgagatggcgccactgcactccagcctgggcgacaaagcgagactctgtctccaaaaaaaaaaaaaaaaaaaaaaaaaaaaaaaaaaaaacattggccgggcacggtggcttacgcctgtaatcccagcactttgggaggccaaggcaggcggatcacgaggtcaggagatcaagaccatcctggctaacatggtgaaaccccatctctactgaatattaaaaaaaaaaaaaaaagccgggcgttgtggcaggtgcctgtagtcccagctactcgggaggctgaggcaggagaatgatgtgaacccgggaggtggagcttgcagtgagccgagattgtgccactgcactccagcctgggcgacgcagcaagactccgtctcaaaaaaaaaaaaaaaaaaaaaaaaaggaccatcatcccccagttggacagatttggtgggtatttctctatcttcattgaacttgttctgtcgccatcattcaacaaagttgaccattccttcttctttccccctacttggtggctgctcttttttagtatcttttcatcatcattcccccagtaccagatctctaagtgttgggatttctcagggctcaaaacagagcccttagttgttctctttctgtaaattattttcttgggtgattgcagccatcaccatagatttcataccatcttggtcttaatgacttcccaatttttacctccagtaagacctatccttgaacttcaaatatctgcatgacatccccacttgcagttcttatgtacgcatccaaaactgaactcttgaatttttcctccttcaaactcatctccttcccagcacttcctttccatctcaataaatagtacaaccatcaacccaatcaagctagaaccttggggtcacttttgataccttcccctgccattcatgacatctaacttgacactatgtcaaatctgttatacctttagaatttatctcatgtcatccatttctcctaggccaggtcaccatcagtgtgacctacagtcttgaaattacttcctatcttaaagctttcagccttgctttcctataaatctttctctatacagcagggaaagagatctcctaaaaatgtaaacttgatagggcatgtatgagtggaagataaaattaagcattttcacattaaaagacagattcttgttggctccttcagagtattacagcaggtcagggggtggcttagaagagaacccaggtgttctgagaaccagtccagagctccagaaggacatcctcactaataggattccaagtgacattttcacaaagttaaatgagaataaagcacatggcttttctgttattctgttagttataagacttttgctactagattatattataaaattcatttgtgatcatcagcttctgcttgtttgtgattttaattcactacgtaaaatacattcatataactaaaggaaactatatctaaaaaactaaaggaaatatgagaatgatgtctccccaaataaggagagagagtgaatgagaatgagtgtgtgtgtgtaactctctccatatatagtagaagttttgcagtttaaaagttagtaacaaatgaaaaatttactagagaggttaaatagatttaagcaggaaaaaaaatgaacttgaaaatagatcagttgagattatacaatctggggaacagaaagaaaaaaatgtacagagcctcaaggacctgtagagcaccatcaagtataccaacataaacaatgagagtcccagaaggagaaaggaaaataggagcagagagaatatttgaagaaacaatgacaggaacctccccacactgatgaaatacaagaatttattcatccagaggtggagaaataggaacacttttacactgttggtgggactgtaaactagttcaaccattgtggaagacagtgtggcgattcctcaaggatctagaactagaagtaccatttgactcagccatcccattactgggtatatacccaaaggattataaatcatgctgctataaagacacatgcacacgtatgtttattgcggcactattcacaatagcaaagacttggaaccttggaaccagcccaaatgtccatcaatgatagactggattaagaaaatgtggcacataatggccgggtgcggtggctaatgcttgtaatcccagcactttgggaggccaagatgggtggataacaaggtcaggagatcaagaccatcctggctaacacggtgaaaccccttctctactaaaaatacaaaaagttggccgggtgtggtggcgcacgcctgtagtcctagctactcgggaggctgaggcaggagaatggtgtgaacccacaaggcggagcttgcagtgagccaagatcacaccactgcactccagcctgggcgacagagcgagactccatctcaacaaaaaaaaaaaaaagaaagaaaaaagaaaatgtggcacatatacaccatggaatactatgcagccataaaaaaggatgagttcatgtcctttgtagggacatggatgaagctggaaaccatcattctcagcaaactctcgcaaggacagaaaaccaaaccccacatgttctcactcataggtgggaattgaacaatgagaacacttggacacagagtggggaacatcacacaccagggcctgttgtggggtggaggaagtggggagggatagcattaggagatatacctaatgtaaatgacccatgtaatgggtgcagcataccagcatggcacatgtatacatatgtaacaaaccggcatgttgtgcacatgtaccctagaacttagaaagtataattaaaaaaaaagaatttattcatctgagaagatcaatgaactctaagtaggatacatttttgaaagtttgaacacaccataatcaaactgttgaaagccaaacccaaagtcagtcttgaaagtagcaaaagagaagtgagtcatcatgtagaagagatcttaaaaagattaacagcttattctcatcagaaaccatggagaccagaggcagtgggatgacacattcaaaatgctaagagaaaaagactatcagcaaagaattctgtttctaacaacatttttcttcaaaagtgaaggagaaattaaaacattcctagatgtacaaaaaaatgagagattgttgctagcagtagttataaatttgtgtcagtgggcatacaatatataaaaatacttatatgataatagcacaaaggatgtagggtgaggagggaatggaactatataggaagaaaatttttgtaaactattgtaattggtatcaatccaaacaagtttgttacaaattaatatgttaattgtaattccctagacaaccactaagaaagtaactttttaaaaaaagtaaataaatgacaaagatatttaaatggtatagtagaaaatgcaaatttagcacaaaagagattaatggaggaataggggaataaaaaattaagatatagggaaaacaagcaacaaaatgtcagatgtaactcctaccttaataattacattaaatgaaattagattaaacacttaaaaaacagaatgacagaatgtattttaaaagaacatgattcaactatatgctgtctacaagagttacacattaaagtcattaaagtcacaaataggttaaaagcaaaagcatatatatatatatatatatatatatatataatgcaaatagtaaccaaaagagagttggaatgactgtgccaatattagacaaaatagacattagataaaaattgctaccagagacaaagaagagcatgatatattgataaaagatcactctatcaagaagatgtaacaattatgatcatatacgcacctaataacagagcttcaacatacatgaagtaaaaatggacagaattgaagggaaaaattgacaattcaacaataacactttaagacttcagtacttcaccttcaattatggatagattatctagacagaatatcaacaaggaaatagaggatttgaacaacaccaaagccaactagacctaagaaatatctatagaacacccaacaatagtagaatgcctattcttctcaagggcacatggaacattctttaagatggatcatatgttggtccataaagcaaatctcaatagattttaaaggattgaaatcatacaaaatatgttctccaactgcaataggatgaaattagaaatgagtaacagaaggaaatttgagaaattcacaaatatatggaaattaaacaacactcttagacaaccaatgagtcaaagcagggaagtttgaaaatactctgaaattaatgaaaacaaacataccatattgaaatctgtgctataggtaaaagcattgcctagagggaaatttatagctatacttgcctatattgaaaaagaaggaagatttgaaaattaataacctaactctccatcttaaaaaaaaataagagaaaactaaattcaaagcaatcaatgaaaaaaggtaggctgggcgcaatggctcacgcctgtaatcccagcactttgggaggccgaaatgggcggatcacgaggtcaggagatcgagaccatcctggctaacacggtgaaaccccatctctactaaaaatacaaaaaacttagccgggcgtagtggcgggcgcctgtagtcccagctacttgggaggctgaggcaggagaatggcgtgaacctgggaggcggagcttgcagtgagccgagatcgcaccactgcactccagactgagcgacagagtgagactctgtctcaaaaaaaaaagaaaaaaaaaaaaaaaaaagaagtgcctacagtggaaactacaaaattgttgaaagaataagatctaaataagtggaaagacattgttaagatagcaatctatgtcaaagtggatttgatatggattacattgaacctgtgcagttttttattgcagaaattgacaagctaattttaaaatcatatggaaatcctagggatccagaatagccagaacaatctgaaaaaggacaactggagaattcccatttcctgatttcaagttactacaaagcttgataataaagtgatcaaaatggtatagtactggcataaggatagacatatagattaaagaaatagaattgacagtccagaaataaacccataatgtacggccaatttatatttgacaagagtgccaaaataattcgatgaaggaacaagagtcaacaaaaggtgctggggcaactgcatattcacatgcaaaagaatgagattggaaccctatctcatactatatacaaaaattaaaatggatttacaaactaagtgtaagaactaaaactgtaagaaacctgaagaacatattaaatcttagtgaccttggattagataatagtttcttagatatgataccaaaagcacaagcaataaaagaaaaatagaaatattaaatttcatcaagattgaaattatgttcttcatgggatactatcagtaaagtgaaaagacaacccacaaaatgggaaaaaatatttgcaaatcatatatctgatatatgtaaatagtagacagaatatataaagagctcttataactcaaccacaacaaaaaacccatgaaaaaatgacatgggatttaaatagacatttctctaaagaacttgtacaaatggccatgaacatctacgtgtcaagtagatgaaaagatactcagcatcatttaccatcaggatgatgcaaatcaaaaccactacgagatactatttcacaccccttgtcattgttataataaaaaagatggacaataacaagtgttggtgaagaagtgaagaaatgggaatcctcatacaccactactgggaatgcaaaatgttgaagccactttagaaaccagtttgtcaattccttagaagattaaatctagagttaccatatgatccagacattttgctcttcagtgtataaccaagagaactgaagatatatatccacgcaaaaacttgtacgtgaaaaattctcatgacagcatggttcatattagtctaaagtggaacaaacccaagtgtccactaactgatcaatgtataaataaaatatggtatatctatgcaatggaatattagtattcaaccagaaaaaggaatgaagtattgacacaggacacaacatagataaacctttaaaacattatgctaagtgagagaacccgggcacaaaagaccacacattgaatgatttcatttatatgaaatgtccagaataggcaaatttacagagacaaaataaattagtgattgtcggaggctgggtaaaggagggatatgctatgactgctgttgggcacttggtttctatttgggatgattaaaatttctagaattagatagtggtgacaattacacaacttgtgaatatccaaacactgattctcacattttaaaaaggttaattttatagtatgtgaattctatcttaatgtctttaaaaaagggatacaaggaagaaaagtatagagatctgagaagaaaatggaggtaaattacttctatggcccttaagcatgttagactatagtgtaaacatccctcatagaggaatatttacagaggtgagactgaattggaggtgttattgggacagtatatttgtggagatgtatccagttccttttaggatgttggcaaaatcactaggaaggcatttaacagcaatgtccagttgcctgggggatacagggattagtcagacacagtctctgcaatttagcctagcaactagttgttaagatagaatgctacaaggcagagtgtgatcagagttatcgaatgatgcaagtgataagaggtaaaggaaaaatgagaaatcatgtatgattggacagtcagagaaagtgttttaaaggaggacatgaggattctattttaaccttgaaggatagagcagaatttggtgcatgaaatttggtgcattttggtacatgaaaatggtgcagaaatgggctttttaaaagaccaggtaaagtgatggttttgttttagaaatactaccagcaagccaaatacccagccacagttccaaacctgcttaaagcctatcattgctaattcatttgccattcttaggtctcttaagaataataaatattattcagatatgtcggttttgttcagtgtagtttttgcagggatctggaaactccatggacactttatgttttcaatgagtcaggcaataacagaataactgaatgaatatgtgggtaaatggtgacaatgtgtcatgaaacaaggattattatgatccgattttgtgcattgcccattaaaacatggaataaaaagagaatggcaataaatctcattctcttttgattgcccccaactaaagctgatcttcatttctgtcatttattcctcatttttagcctccctttcttttccagattaggccctgaaccattgttttgctatatcttaacgcatggtcttcagaataatgtgatataatcaggccatattccttcaatttattgtttcttcttcataaagtagatgactgagagttgttttctttgagatgtttttaaatgagcaagtcatggaactcagatggctttatgcttagttttttgttaaaccacagagatttagaagatcgtttgttactggatcataacagcctattctgattgatacagacatataatgaactactcaataacaatagtaggagccagaaggactgaaatggtatttccaaagtgatgagagaaaataactgacaacccagaattatatcatagtaattatgaacacttatttagaatttacagtgtgccagatacagttctacaagctttacctatgtatttggttaatctccacagcaaccctctaagataggtactataattgtcctcattttatagatgaaaaaacagaagactagagaagttctgtgaacttctaaggtccacagttagtacctggcagaactggaattcaaactcaggcagtctgccccagaccactaatgtaaaacagtctttcaagaatcaggatgaaataaaatttattatataacagagctttgtttaaggaacttaaggaataaggaagataatcccagaaggaaaatctaagatgtaaaaaagaaaggcaagcaaagaagtgagtgagcttttctgtatgtcaagatgaacattgtttgtatgaaataataatacataattatggaatttaaaaagacaattaaaattctggattttagcaatagatgtcagtctaaagggggatgattgcagtaaagtattccaaagccttgcatctcagtagcattgtattacttgagacttagtgatgcaaaatgtcaggatcgccccattacttactaattgaaatctgcatttgaacacatttcccaggtgattcatatttacattaaagattgagaaacccgcttccaaggtcctggaattgtttgggatgggaattgtgatatcagttaacttcaagcttggtcacagtcaacaatataatttcaagaataacccctgaaagaaaagaaacagcatgtataaaacttccaaatcagtccaaggcaaaactggactcaaaatattaacaaataaaaaaagaagtggccaggaaaagaaagaagttcagggcaaatgaaaaaagcacagtcgagttcaggcataacaaaattccaataagtgtgagtagccaaaatttgccagttaaaagagattgtcaaatagaattttaaaataatccaattatatgatttttagaaataacatataaaacacagagcatgaaagtgaaaatatcaaaacaagatatatcaggcaaacactaaacataaggatgttggggtaacaataatacttaaataaagcttggaaaaaagaatgctagagtagttacattaatgtcagactacagataattttttaaattttatttatttatgttttagagacagagtcttacaccatcacccaagctggagtacagtggcatgatcatagatcactgcagcctcaaaatcctgggctcaggcaatgcccctgactcagctgcctagctgggactcagacaaaatatgtgtaaggcaaaaaggttaaacttaggcttaattttaaaatagcctcaaaataaataaagcaaaattgataggcctacagggagaaatttgcaaatgctatatatttgctagatgtcagtacattctttcttatttgaaggccaagcatcaaaaaatcagtaaagatataggacatttgagcaatgtgattaatatgtatgatctagtgggcacatatacagggctgtacccaacaattagagaacatacctccgttttaagtacatgtgaaacatttttcttttcttttctttttttttttttttttttttttgagactgagtctcactctgttgcccaggctggagtgcggtggagcgatcttggctcactgcaccctccacctcagcctgagtgattctcctgcctcagcctctcaagtagctggaattacaggcacctgccactatgcctggtgaattatttttgtatttttagtagagatggagtttcaccatgttggctaggctggtctcctgacctcaggtgatctacccgccttggcctccgaaagtgctgagattacaggcgtgagccaccgcacctggcccatgtgaaacatttttcaaaacaaaataacaaaacttagcgaagagggaagagatggtggtgattagatgagcattaacttgattctttttgacaatcttttcttgagcattagtagcgctaagtgagcacaatacatgtaatcactgtttctgaagccttaatcatccctttgaaacccatccattttttccacttgcagaccatgccatgagttgagagggaactgcctgtgtctttgacaatataactgaatgtacgagcaatctgatttcacctgttcatcaactctaaattagaagaatgtcaactcatgcagtggctacagtattagacaaggactttgcatctagtcactggagtaggaggaatagagatttttgaattctgggcagaaccttttcttcagcatttttgagcctgctgaagtcatttttggcctttccaaatatatcttacccttacatggcgagaagtaaccttgatctcctctaagtcactatagtcttttatctatgcgccatggttggcacatagtggacatctaacaaatgtttgaatgatggaataggaagaaaagattttctttccttttcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgtataatattctcaaagacccttagctgcagcaattcatatggtgtcacttgaagatttttctctcttaagatttcaggagaacacaggcagttccaggagacacaggcagttccgtctcaattcacggcaaggtctgcaggagaacacatagactctgttgtacttgagggaagatttttctagcctagcctgaagggaggccacatgttatcccagacccaccttgccaccttagtagacactataaactcatacaactcctagagtgtaacactggaaatgatttgttgtattagttttctattgctacataacaacacctatttattaactcacagttccataggtcagtagtctacacagggatcttcttagaatctcacaagggtaggaatcaaggtgtcagctgggctgagttcttatctggagacactggggaaaaaaatctgtttccaagctcattcttgttggcagaattgggtttcttgtggttataggactaagatccctgtttccgtgatagcttttagccaggggccactcccagttcctccaggctgcctgcattctttgacatgtggccttctcaatctttaacccagcaatggtacatcaaatccttctcatgcttcagatctcttcctcttccgtctccagctggagaaaactctctgcttttaaagggctgtgtaattagatgaggcccacctggataatctccctattttatagtcaaatctgtcttgtaataacttattcatgagaataaaatccattatattcaacaatcctgggattgtgggggtgggggaatctgggaccattttgaaactctgcctatcacatttgtttataagttttatctcatttactggatcctaagagtcttgagaacaggttagtgcctgccacatcataacgtttagtaaatactgacatttacattatctgtgactaaaaattaatgtgttgggagttatgtatgaggtttacaatcttattcatgtttaaatccctagtctctagcatagtatatcattgatagtatgtatcattgatagtatgtctaaatgttttagaaaacatttagctaaataaatgaaagaataattatataattcagggctgtggctactatgctgattattatatagcatattttttcaaaaatcatgtgtaatttagttttcaaattttttgtagttttaataacatgatagagaacagatagggtcttctagtgttttttttaacagctgctttaaaagtggaattttgcgaattgctgatttacatcaatatcttcagtattttttcctcgtataaagaaaggatcactagactaggagataaaagttggattcagatcttggcagaggggtctgtatgtttgtgtgtgtgtgtgtgtgtgtgtttgaggggtgaggactagttggattaatcttttacattccagtgtcctgtgctgctatttcctatactgttcaactgttcaagcatactatttcatataatcatgtgccttatacattttgatttcagatatccagcagaagtattccagctaaaggaaaaaatacttgaaattgggcatcagagagattagccatttcctccagatatccagatggataccaacagttgctgccaagacaaatttatctttggaattgaaagtctgttaccctgggactatctaatgctaatgtttttcttcctgtttgagtagatttttaacctgtagttatgagtgatggatgtcgttgcagtataataacatttgctcggtccttattgatgatctgctcaaaaaatagattagtagatacttaacccatcagagagcttgtcggtgtaataatgtcactgtaatcaggctgcataatgtaattctctgcttagttcagttgctaatggtcatccggagaggtcattcccatccgagatgactcatgtggaggcttctggaatatggtactgtactttaaagaatgctggccagtgagtgcggtggctcacgcctgtaattctagcactttgggaagtgaaggtgggcagattgcttgagctcaggagttcaagactagcctgggcaacatagtgagatcccatctgtattttaaaaatgctatataagaggagcaatatgacttactcatcatctctgacttttcagtgcaggatggggttttaacccaacatttcctaaaatcatgtgactatagaagtcctatagaacattcaacaaatctcctagaatacagtttgggaaaggctcatttcttctgatttaagaaagtaaggccagccgtgcatggtggtttatgcctgtaatcccagcactttgaaaggttgaggtaggaggatcacttgtgctcaggagtttgagaccagcctgggcaacgtggtgagaccctgtctctacaaaaaataaaacattagctgggcatggtggcatgtgcctgtggtcccagttactcaggaggctgaggtgggagaattgcctgagcccaagaggtccaggctgcagtgagccatgatcacaccactgcactcgagcctgtctcaaaaaataaataaataaaataaaaagagaacaaaaagaagtaagaccaactcttaggagcatcagagtgtttttattagaagtagcttatgacaattggagaatctgaggcccttggggattgaagagttgcccagtatagtgagttggtggcaaagcgtggatgaaaataacgcagatatccctcacttctgtgcttttctcactataatacggttcttaacaaactgataaaaaatctcctagctgctataagccataaacccttttttgtagaaggtggctgtaactttgacattgactaggtttcagttcggagataggattgggaagagggctttgacttaaggtatatgctggttctttgtttaatgaatgtcacaagatagttgctttttccacctccggttccattctttttaaatacagagtccctcttttttgtaaaggccttttaattctttaccctcaggagtacagctgttactaagtcatcagattccacggtgaactaattcaaccatcttcttttctaaaatctgtactataggaatgggcattgcagtggggtcctaaatctttcataaattatttagtctctttgtttgttggttgggtttaaaaaaaaaaaacatataatcagtttaggagccagtttttttttttttccagtttttcttgaccatcatctgcttaaaagagagggaaggaaatagatgaaaaactcaaatatccattctgaatgtccaattttttaaaaatgtggtcataaagactgaagtttgcagttgccctggctgacaccctctaatttcattcctaaataactgttcctttacattttgaagttttttcattcttgctttctcttaccagaaagtaccattatcatgaatcattttaagggagtattttatagaaaattggaatagggtggactcaagataggaacacagtcaggggcctggggacatggagaggtgtgcaagaaacagaaacagacacagatgacacagtgctaaaggcacagtagtggagatcactggaactctaaagtcagcagacttcctgattttgagctatgttgtattggacaagatacttaatctcgctgtgctcattatctggtctctaaaatgagaataatacccctatcttcaggattatgaagattacaaaagtcaaagtatgggtgtttattataatattgcattcatccagctggttagagtttgcctttgggatgtgattgagaaagtttttttaccttctcctttttgtttgaaatggttatactagttatgtagtatcagaaaccagtaaaacatatttttgctttaatataaaaagggaatatgtgaacagcctgccatttagttagcgctcagtaaatgtgagttctcttttcatctttccttccttccccaacacaccttccacctccaaatttccttgatttttttcttgacaccagccttttcctctgtaaggaagggaataagacccagctatatctataactcttctgggtttggggtagatacaggatgattggagggaagtctgcccgtgcaagaggcaatagagtatataaagactcggacttgggagaaattcagatctaagtttgtatccttacccctaccatttaaaagctaagtaacctaagacaagtttttaaataaaacctctgtattttcttttttaaaatagtgatatactgggcacagtggctcatgcctgtaatcccaactctccaaggccaagatgggaggatcgcttgagcctgggagtttgagaccaacctaggcaacatagcaagaccccatctctacaaaaaatttaaaagattagctgggtgtagtgatgtgtacctgtagtcccagctactggggaggctgagacaagagggttgcttgagcccagggttcaagtgtacagtgagctgtgattgtgccactgtattccatcctgggcaacagagggagaccctgtctaaaaacataaaatggtaataattgtaatacttactcttaaaactccaaaatgatcctttgactccatgtctcacatccggatcacatggaggcaaaaggtgggttcccatggtcttgggcagctctgtacctgtgactttgcaggggtatagccttcttcctggttgctttcactggctggcattgagtgcctgaagcttttccgggcacttggtgcaagctgttggtggatctgccattatggggtcggaggacagtggccctcttctcacagctccactaggtgatgccccagtagggactctgggagagctctgatcccacatttcacttctgcactgctgtagcagaggttctctgtgagagccctgcccctgcagcagacttcttcctggacatctaggcatttccatacatcctccgaaatctaggcagaggttcccaaaccccaattcttgacttctgtgcacttgtacagcacagggactctggcccggcccgtgaaactattttttcctcctaggcctctgggcctgtgatgggaggagctgctgtgaagacctctgactaccctgctgtatttcagacttgcatggggcctgcagcccctttgttttggccaatttctcccatttggaaaggctgtatttacccattgcctgtacccccattgtatctgggaagtaactaacttgcttttgattttataggctcctagccagaagggacttgccttgtcttggatgagactttggactggacttttgagttaatgctgaaatgagttaagacttcaggggactgttgggaaggcatggttggttttgaaatgtgaggacatgaggtttgggaggagccaggggtggaatgatatggtttggctgtgtccccaccccaatctcatcttcccatgtgttgtgggagggacccagtaggaaataattgaatcaggggggcagatctttcctgtgctgttctcatgatagtgaataagtctcatgagatctgatgggtttaaaaaggagagttcccctgcagaagttctttgcctgctgccatccatgtaagacatgacttgctcctccttgccttctgccatgattgtgaggcctccccagccacttggagctgtaagtccattaagcctttctcctgtatgaattacccagtctcgggtatgtctttattagcagtgtgtaaatggactaatacacttacctaatggggttgtggtctgtatatacttagcatggtatctgtcattttgaccctcaataaaggttgttattattttcatcatcaggattatcataatctcatcctattcagatccttttcaggtccttcggcaaccctaaagaactagaaattcctaagcactcctatttgatggtttggaggaagcgttttcatcttttagcagatcttactttttagaccttcctctatatcttaagtgggacttctgactcaaaagctttgaatttacttttaatgtcaatatattacccactctactggcttacccagtggttctggttagtaggctgttttttaagaaaaacagatccaaactccttgctcatcagttcactgctttgggccattcattcctagggatattgactactgttccacgttgacaaattagagaatccttggctagtgtagtgtgatgtattattttgggatgcccacgcattaaggggctgggagaaggaatcctggtgtctgataaaatgaaatagaatctgggtcatggcatcattgttgtatccagcaggcttctgggaaggcaactttcagaaacttcttaggacattggcagaaactctgaggtgagacccctgggtgaattggtatggtttgtttccctagaatctctgctaagagggggagcagtgtttgtcactgaaaaacatgagtgtggtgtaacctaaggagaggcttatcagaagtgctctgagtctagaagagccttctgcttgggatctgaaagcaaagcactggtgtacaagtaaaatatcatgctacagtttgactgtctgctatcccctgccccattgttccacttctttcatcagctctattttctttgagggtattcctggcaacttcacagtcagattcaatgaattaattttattttttaattcagcattgattaattgcccctgtcaaatgaacggtgacatgggccacttaggtttggttcactatttggggtgcctatcctgtactcaaacccagcttatagctgtggaagacaaagacctccacagctatagggtatgctttcaaaaattttgcagtggagttacaagtctgttaacccattaaaatataaaagtactaagaatctctcacattatgtagtatttggcagtgtgcaaaatattgcacataattctctaggttatcacagtgacccctataaaccttgttaattattatatagattttctagatgagggctctaaaaccaaaagaggagaaagtattcaaccaaggtcatagcaaattaatagtgattggcagactaaaacataaacctatttcttctgcctccacgtgaaagttcattatactataccacagctgcttccatggatatcttgcagtgcacttttaaaaaaaataaataccccaggagttaagtcatatccggttagcatatggtatataattgtgatacaagtagtaaattctatgatagtccagagaggaatgatcatcatgggctgtaaagaccagggaatgctttgtagagtaggtaagacttgagttgaaccttacatgaatgaaggaactgtcaagaaggtatttagtgcctgttcttttgagtgacagagctttcttgtgcagagggctttgtgcacgttctaggccccgtggtggtcttagtctgtctgttatcatcctaaagaagcatttcattctcttctctgttctgtgctctagggatatttgtggtccagatcagcatcctagttcttgtaccaatatcttcatgcaatatttttttccaccaaagtattcctaaggagaagagtgtacgtatgtaacccaatagttgctgcccttcacttgaaatattttgaaatcttgttttgattctaatatgttatatatgatttacattttctccataatatttgtaattatttaatgtaaaagcccttaaaaaaggaggggaaaaaactctgagtaaaagttatgcttcgagaaaattagctatatttacccctccccatttaaaaaattgaggtactattcacaaaatataagattcatcattttaaccattttaaggtgtacaatccggtgccattaagtgcattcacagtgttgtacaatcctcaccactatctaatccagaaatttctcatcgccccaaaaggaaaccctgtgcccattcttcatttccctttccctcaaccctggtaaccactaatctactttctgttttatggattaacttattctaatatttaataaaaatgaaatcacacaatgtactagttttggtgttcgatttctttgacttagtgtaatcttttcaagtttaattcatgttgtagtgtcagtacttcattcctctttatggctgaataatatttcattatattgatataccatgttttgtttatccattcatcagttgatggacattttgggctattttcaccttttccctattgtaaatagtgttgctatgaacattcatgtacaagttttcatttgaacacctgttttcagttcccagaatggaattgttggatcatggtaactctatgtttaacttcctgagaaactaccagactgttctctataatgctgcaccgttttatattcccaccaagagtgtatgaaagtttccatttttccacaagcttgccaccacttgttggcaatagacaatagtccatctttttttttttttattgtagctatactagtggtgtgaagtgatatctcattgtggttttgatttgcattcccttaatgacgaatgatgttgagcatctttttatgtgcttcttggctagttggatgtgttctttggagaactatctattcaagtcctttgcccaatttttaattctgtcatcttttattgttgagttgtaagggctgtttatatattctgggtaaataaactgttatgagatatatgatttgcaaatattttctcccattatgtaaattattttcattttcttggtagtgtcccttgatgcccagagtttttactcttgatgaaagccaatttgttttttctttggttacttgtgcttttggtgtatatcttaaaaatcttgcttactctaagatcatgaagatttatctctatgttttcttctaacagttttatagttttatcctttggactttgacccatttgagttaatttttgtgtagtgttataatgttaatggtagaatctaggtggggggttctctgtaaaatcccttcaactctcaacttcaccatatgtttgaaatttttcataaaaaaatattgaagggagaaggaaaccaaatttagaaacttattatttagaaatgtactatttcttctttgagcatcccctcttccccaccttctccacagcttcagaagagaaccgtaatgtaggttaaaggcagttgctggacaaggagaacgtagcagtgcactcaccaggctccaagctaacatgagagctttctattaaccacaactcctctgttagcctgtaactttctgttctgtcaccccgaatctttcctccacaatatgcccccaagaaacttgcctttccatccccaatgttatccccagttgctgtttctgttagataaatgccttattaccctgaaatgacttcacctttgtcatttcaaagaatgatctaattttcatctgaacaaaggcatttttgcagaaagaaaactccattgagaatcagcaaacatgtgttctagagtagactcagtcaggtaagtgacttgtgcaaggtcaaataattgataaatggtagaaacagagtttgggtccagaacaccttattccggtttatcattagtactgctctttaggacctaaaggaatgcatggtggagtttcagaaagcaaggatatatttcatcactcagattctgctgcatggacaactacctactttagaatctagctctgtaagtaaaatcaacttttgagggaagaatgtccacagccagttttcagtggctgcataagaacagtttcaaccctcgtatcttgtactttacctacaaaaaagtgccaagaaagttggctgtgaaaagcgtgaatttttgtgccatatatcagatgaaaccttctaggattcaggtttctcctttaaacttttattcattccgtatttttaataagctatcatagggttcttctgaaaccagttccttagaaaaggtgtgcaagggacccagaattccaatttacataggaacttaaatcccaaggggttctggctgatggtctttgatttttgcctccctaaatttacattagggtaaaagattatgttttgggagtgctgtcttgctccccagaatataactatattttcccccagcactcagtacactatgtagcatatagtaggcattctgtgaacttctgatgaattgttggcttcctcacagcagggtctggaattgttcatctctgtacacccatctcctagtacagcacctcctagcatataataggttttcaaaaattaattgcattgatattgttacttcacttttaggtaagtgcctatccttttaactaggcgtttctcagtcaagactgtcagagccctgaatgagtcattgagtcaggattagagggttaatgatagcccagaaaagataggcaccacttgttagctgattcatggggctaatgtcagctcttttaggggacgtggcctagataaatcaaagtctggcaataatgaacccatagcccgcagacagcaaaaattatggacctttctgaactcctgcaaaggaaatgaaaaactctttaatcagatttctggacttgaaactagggatttttgtaaggatgctgtatttcagattgccaacatggaattggggagcatgatcagagaaaggttggaagaagaggggaagataatagggacttagctggaagaaggaaaaggaaaaggttgcccggaaagcagagagaaagatgacctgaaacaagagtaaccatggtctcaccttggttttgtgatcggtcaatgatctggtggcaaacgaactttttgctagagagctatatcctcagagtggccagaatatccactgtcttaggtttgacttcagtagttatcattctcacaacccttttctagtcatatgagatgggatccaaagtaagctttatgtgttttgtggagaacgaggggaagaggcattaaacagtctcctcctctacagtaaagattctcagaggcatttatcatattttggagagggttcccctttgttgattacaaatgtggctgtgagctctaaaatctagggcatactttatttatttatttttgtttttttgagacagggtctccattctcttgcccaagctagaatatagtggcaggatcatagctccctgtagcctcaccttcctgggctgaagtgatccccctgcctcagcctcacgagtaggtgggactacaggcatgcacaccatgcccagctaattttttattttttttgtagagacagggtctcactatgttacccaggctggtctcgaactcctcagcttaagcaatcttcctgccttagcctttcaaaatatggagattataggcattcaccaccacacccagcccgtctaaggcattcttgattggagtctaacctcaggaggaaacaaacgtcattgtagtgtcaatattacccaataattttctgtcctttggaagttacataaaatcagtgcagttggttacaaccccatgtccttttccccaccttcatggatttataaaaagatgtaccatcactgtgatctctccttgttcacatgagcttaaatatgggatcactggatccagttgttattcttagagaaaacaacaaggcactttcttccagtgatctctactgaatcattcagcatttacgttttgagtgacaactttcttaggtacttgggattcaatgttgagatagacagatttagtccctaattgtaccttaccaatgtacaatccttagaagaaatatcctatcttatttaaatctgttctctaaatcaagtgctggaaattacttcagatatattgctctgaattttgtgcctgtgtaagagctcatcattcattgtttagagaggaaccaggagacagagaactaactctatcccaactcaccctcccaaataacatcaggaactggaaccaacagcattctggatggtatgagtgggaagtgccagaatctgttacataacctgtgaaaaattctgccttggggttgcagttagagttgtcaagttttaaatcttctcctctgtgtctgctgtctgcttttgcccttctgggaaaggatagagcttcctgccctgaagttagcagcatcttccccatagacaggagtcagccttcctggagcaaatttggaaacagattcccatatcttcctatcttggccctctgtgccacactccacttagtcttgagtctgagttcctactacctggagggtgttagatgatatgacagttacagagatgcatgtgataggcatgttgcactcagaatttagtgaggttagggagatggaatatatacagtaaaaactaaaaaggaagatgagtgatgtttgtgcagtgcgaagtagcatgacaacagaaacagcagtgaccctttagttagaagatccaggttcaaagtctaagttttatgttcatgagcaaatgtacctcttttggcttagtttactcacctataaaatggggataatcattttgatcctgcctaactttcagggctggagtgagactcaagtgagataatatatgagaaactttgagtaatgcaaattaaaatacaaacacaggcttggtgcagtgactcatgcctataatcccagcacttcaagaggctgaggcaggaggattgctagagcccagagtttgaaaccagcctgggtaacatagcgagaccctgtctctaaaaatacgtgaatgaatgaataaattacaaacacatgtggaaagaagtcttattccattttacagatgaggaaacaggcccagagagatggaaaagcttactgaaagtaccctgttttgtgatgaaacagttatttatggtttaagcacaaagtagaataacttttcttctttttcttcctccttcatagactttgtctgccccaggactgttaagtagcccagaatgctgttgacctcatataagttgtattttggtagagtatgaagaagtttagggggtccatattttaccttaaggatatttgttatagcattataccatcaccttatttattgggcttggcaaaagtttaacacagtactatctgataaaaatataatgcaaattgcaaatgtgaaattttaagttttgtagtagccaaagcaaaaaaacaaaagaagtgaaaggatacaggtaaaattaatgatgtattttatttaacacactgtatccataatattctcatttcagcatgtactcattataaaacaaattgttaatgaactattttacattcttttttcataccaaatcttagaaattgggcacgtgtttcccctcacatctcacatctcatttgcacttgtggttgatgccactgtattggaaagtgcagcctttcacaaactccatttttcctgcttttcagttctggctttctaaccttcattcctgtcctcactatattattttaatagatctgcctatcttctttttctttggtccttagagaagcaggcttcttttctgcctaagtgtcagctatccttccttggttaggttaaaaaaaaaacaataacaactcttctggccactatttgaaatcagctagtgctgcctgaactatgcctttccttccctgtgaacattcagctcttttgaactgagcttcccatctcactttatttatgtgtctgcctcttctgctaaattttgtgctccttgaggacaaggatagtgttttattcatttctgcaatcgtagcaacctaacacagcttttggcccctagtagaaatttgttaaattgttaataagtgaagagagaggcttctcctgaataccttgccagctcctttttcccccctaacagctgtttttctctcttttctctctaataacagtttttgcatcagtgctgtggtttggcacatacaggcaacttttgttatttgtggttttatttgcaggaaagcatgtagccatattccataattctttccagaaaccctttcttttagtcacctttcaggttgtctgattttacctatgtcaggaaagcttttgggatctatttggaagctttgctccttagctgcctatttcttgattccttatgtctttcccaggttcgtttcctcctctctccttcatacctgcctttgctgtctctatctggaccttcccttcaccttgagttttttatacagtgtcaaccccaatgatctcaaggtagaagctttcaatagcaacttatggaaccacaaaatcatagacccctgaagctagaaagtgtcttagagatttaagttcaaaggttttcacagtttaaaaaacatctgaattttttttctaacaaagatttaggcagaaccctatatataaagctggttaaaaaaaaaatggagctcctttggttgaaatgaggttggaggttcccagagataccagggctccatagaacatggtttgagaaccactagtctagttcaaatccctgacaatacaaatggggaaacagaggcctaggaagttaaacaccttgcctaattcacacagcaagctagtgacaggatctggactagaacccaggtttcctttccaggtcagcgcttttttaaccacagttttttttttagagctttatttcccaaggggaggaaacagtaacaatgagtcttttattttattgcccttgatgagatctgacagagtctacctctccttccccactagtaagtcaggttggccccctcttgttattgtttttctctaggacccaggctggggcttgccttagcctttgttctgttcccagtttttgtggtgccaagaaggatagggagagagcggattcaggcaggtcatggtggcacagatgtttcctgtcccttagccagtctggctgtgtctttcagagaaagccaaatgccatggccaggtgtggttttggggccttccaagcccttggaggtggtagttgtttataaccgcaatttcctcattagcttctgtttttcacaggcctctagccactacctgagggaatacatctcaacctctatcctaggagtcatcaatcattcagagctctttgtggtctggccatgacctacctctgtattttatttcccagtgtctccttcatgtgtcctatattttctcccagaatgctgtgaatttctcccccttccttctcatcttcgcctgttaaaattttacttatctttccagatcaagcttaaatgacaccttcttcaagaagcctttctgaatttccaaccttgcgcaatccccctctgttatagtatcataactttttagtctcatcggccatcattccttgccttatattttaggtacagtaactttacacataccatagtgtttctcactttcatgcctttgcttatgctatttgcccagaattccctctcctaacctttacttcacttttgcctggctagctcctacttaaatttaggataggctcaggcatcacttcttttaggatgtcttctctgacccctccaacctgggttaagttcttctcatcctagagtgtacctgtctctttctgcttacacattatattttatctgtttgtagccgagtctcgtactagacagcattcctagaacatctgtgcctcttcctagttctagcatctagcagcatctcacttatggtggatgtttaataaatatttatggaatgaatgagtaaataattgttatgctattgtaatgttttgagttatttctgcattttttatagttatttgtttaccactagactacagactctgtgaggacagggaaagggattgctctttacttgttttttgttttttttgttttgctgtacataaggccttattcatagtaaatatatcagtcaatgttctccagtgaaacagaaacaataagagggaaagaaagaaaaggaaggaagggaggaaaggaggaaagaaagaaagggaaggtaaggggaagggaaggagaaaggaagggaaggagaaaggaagggaaggggagggcagggaggagggaggaagggagggaggaaggaaggaatgaaggaaagaaggaaggagagagaaagagatagaaaaatagagacttatttttaaggaattggctcagatgattgtgggggctggcaggtccaaaatctgtagggcaggctacaggctggaaacttgggcaagagctgatactgcagacttgagtctgaaattggtaagacggggcagcaggctgggtttctgtattacagtcttgaggcagaattccttcttctctgcaaaacctcagtttttactcttcaggccttgaaccgattagccaagacccacacacattttctagggtaacctccttcatttaaagtcaactgattatagatattatcacatctacacagtatcttcatagcaacatctagatgaatgaccgaacaactgggtaccatagcctagccaagtttgcatataaaatttaatcatcacagtaggtgacgaataaacatttgctgaattggagtatgcttttgaacttcttgtctaaagctcagaaaaaagagaacaattttcttttttttcccagaagtaatttgaactcaaatcttaaaatcctcaactctgaacaaaaaataacaacattctttgaaatacactgaattttcaagaattaagagactctcgaggctgaaaataaaagcagactgagtagtaagcctataagaagatgttgtatcaggcctcttgggatatctgtcttggtaacgctggggctttgattgtaataccaacacagcaaaaggagatgataatttgagtcttcacaagacagagttaaagctgagacccacaagtgaggctgggaccctcagtaaagtggcagataggaaaaaaatctcatctgtacatggaggacaacaagttgtccatctcagcctatgtgctggacagaaaaaaatgcttcctttgagaattcataactacaggcctgtcttcacttggacttatactacatggataatctgaggccccataagtcaattaatataaaattatgcccagccactgataccttggagtgcttatcagaagaaaacataaaccctcttaagctgttaaaaaatctaaagttataaaatggtaaaaagatctctactgtaaaattaatagatttaaaattgtaggaacaagaaagacttaaaaaaaaacaagaaagaacatgatactatgaataaaataaggcagatatgacaaatagaatttctagaaataaaaaataaaagcattgccaatggccatataaacagtagatcagacattgccaaagagaaagccagtgaactggaaggtaaagctgaaattacccatgatgcctctcaaagagacaaagagaagaacatgcaagcaaagtgaagagacatggaggatacaatgagaagattcaatatgtgtctagcaatagttatagaaggaaggaatagagaggatggaaaagaggcaatatacagaggtaatagttgaagtttttccaaaattgataaaagacatcaattgggaagcacatcaaagttccagaaaaataaagccagatctagacacgtcgtagtgaagttgcagagcatcaaagacaaaaagtaggtcttaagagcatccaaagataaaagagatatcctacgaggaatcacaactggactgagagcaggggcaaaataggcaaaggaatattgtcctcaaaagctgagaggaaaaaacaaaacaatctagaattttctacttagttaagcctttattcaagagtgagagtaaagctgggtatggtggcatgccactgtagtcttagccacttgagaggctgtggcaggaagatcacttgagcttgggagttcaaggccaacctaggcaatgtagtgagaccctgtgtctaaagaaaaacacaaacacacacacacacgaggataagatggagacaattatagacaagtttaggccaggcacagtggctcatgcctgtaatcctagcactttgggagttcaaggcgagtggatagcttgagctcaggagtttgatgcctgtaatcccagcactttgggaggtcaaggcaaatgggtcttgatctcaggagttcaagaccagcctgggcaacatggcaaaaccccgtctctacaaaaaatacaaaaaaatcagccaagtgtggtggtgtgtgcctgtagtcccaactactcagtaggctaaggtgggaggatctcttgagcccgggaggttgaggctgcagtgagccatgatcacaccactacactccagcctggcagacagagcaagaccctgtctcaaagaaaaaagaaaaaaagacaagtttacatctcagagatcgcttctgaaaggactacaaaaagtagatattcttcaggaaacaggaaattgaatccaaaaggaagtagtgacgtgaaaaaatcaaaattgagcaaaaaatgttggtaaacctatgggtaaatctaaagcaaaacaaaataaaaatagaaaaaacttgactgtacaaagtaataaaaactgacgaattcagggaatataaaaatgaggtgaaattaaaacattgcctaataatatgtgacataggaggagagtaaagagagaaggggaatgaccagtcctaaagtatactaaaactagggaggagagtagagctactgattaaagttatgtttaggtaagtaaagtatgtcctttttttagaaaagaagttaaggctaaccacaaaaagaatagaaataaaatgtgtaattactagaaaattaaagagaaatgacttgtgcaagggacccctgtacaagaaagatgaactcagcattacttgcaataagaaatttcagagtaaactaaatgtccatcataacagataaataaattgtgatgtattcaagtaataaaaataaataggccagggttttgtatattaccatgaatacatgtcagaaatataacaccgagtgggaaaaatgcaggtcgtaggcagatagatataaaatagcatcacttatattaagccccaaacaagcaaaacagtactatattcagtctacggatatatacacatgtagtaaaactatataaaaacacatacaggaataatgaatgttaattcagagtagttatccctggggaagggatgtagaggaataggattggggaggaatatgcaagcgatttcaacagtgtatattaatatagaaaaatattaagatcaagtagcaaataaacaagtatgttatattctttaaatatagctgtatgacaaataatgaaattaagtttggagaaatgtatacagctgctgaggatttttcttttttttttgagatggagtctcaccctgtcgcccaggctggagtgcaatggcacaatcttggctcactgcaacctccgcctcccgggttcaagtgattctcctgcctcagcctcccaagtagctgggattacaggcgtgtgccaccatgcttggctaattttttgtatctttttcaccatgttggccagggtggtctcaaactcctgacctcgtgatccacccacctcaggctcccaaagtgctgggactacaggcgtgagccaccacgcccagccagctgctgaggattctaagtttattttttccacagtaaggcataatataaagtgacggaacaaatttaatactgctgggtctgattaaaatttataactttgaagaaataaacagatttgcatttctccaagattatgttttccctaagtggtagtttgtcaacagaaagctacactgaataaaatctcagagatatccaacttccaatacttgctgctttattcaggtctgatctgaccatctggaagaatttcattaggttttaattatcatgcactaagaacataagcagagcattttcaaagaggagccttcatttcatgctgagtctgaaaaccttatcataggaggaatgtttgagagaataggggtagtatagcctgaagaagtggtctcaaggggccctgttcactgtcccagacaggatggacatggacaagaaagaagcagaccagttttatgtggacagagccagaatcaaacagcaagcttcaaaatggcaaatgtcagcccagcttgaaaaaatgaattgtctaaaagtgaaaaaaaaaaaaaaacccacaaaacacacaaaaaaactgagaaatttctctgatgtccccttgttataaatattacagaggagatttttgcattggggtatgaggtaggatatgatgatgtcattttaagtttcctacacatgaatgacagagacagactagagtctttaagtcactcaagtgaagatagtcatataccaaaattgtttacacataaggggaaagctactcttggcctcaggcttttagctgtattttaggaaactctctaaagcacagaatctggaaactggggaaacaatatttaagtagaaatctcgcttctagagagtactgtcaaggtttctgcttcatcattccccaaattccaaatgatgtgcttcatagatcggcagaagtccctctcctggccattggcaaaccaagaagcaaggaactggctttatcctactttatccctgttgccctggcacttcctgtctgccatatgtatattctgtattatacgataactgcaccaccactgggcagtgatttgtgaatttcactttcatgctgtactacctttgttaaagtcacttgaaatgccctttccacatcacatattgaaatcctactgtttaatttctacactgtcagaccctgaaaatattagaagccctgtgggtaaatcccctcccaaatgaagaaaaaacaattcagatgaattcctaatgtacaaaaatttttgaataatgccatattttagttgtagtatgaagtggttaatctgctctggagtcagttttcctagtttcaaatcctgaatcttccacccagtagttgtatgaccttgaacaagttacttaatctctttgtgccttagttatctgtaaatttgggagataatgctatctaccttatataattcattatgaggattaattcataaggtgtataaagtggttagcacaggtactagtgcttaatagatattagttgatattaatttcattgcagttataattttggtgcttgtactttagataacaatctacggtacttctctcgaacactaatttatttttattcttctttgttttagagcagggtaaagtctttccttccccttccccctaccaagtgcctttcatataggtgaacaaataataggtgcctaatctaatgaatctttgttgcatgagtaaattaattagaattacaatattttgaaaggcttatagaatatatttcattacaacagcactacataatgaacgtcttttcaaaggaatgtgtccaaacactaggggtaaaaatgaactaggttttcaagctaaccagcttgagttggtttttaaaactactttttagagcttttgaatgtgaagtgtatttcaatggatcattagaggtggctgaaaggatggacaaattcactgagaaaagagcaagaacagcactatctgtcttcatatttctctattaaggcatgagcttatactctgggctaaccttgatctaacaaaaaggacattgtattgagaagacatcagctttcccaccgtgtgatcttggtcaactttctctctttaagcctctgtttctttgcctatgagaggatagcatctaaggtccatttctccattcagagcctgtgtggttccatgttgctaaactcaagtgcatctgggaacctgtggcatgactcttccagaacagtgccagttctcccagcctgccaaaattcagttgttagtgtctgttctggtgaataatatccccactgaactggcaccagttggaaaattgtagaatggaatgtgccacctgggtttggatttggaaatccaaagtattgttgccttgaggtatgaggatgtttctgctgcgccatggtggtgagtaggctgataatgccagccatgtcagtttgcacttggaccaggaaaagaggatcaagtctcctttgctaacaaaagcagaatgtgaggagatctcttttatttccttgcagcaatttgctctacgaactgtgtactgatgatgtggtattacaaacagaatcaatgcatcagcaaaatgataaaaataaaactcccttgtgcttctataatactaagctgtttacattttttttttcagacagcatctcactctgttgcccaggctggagtgcagtggtgtgaacatggctcactgcagcctcaacatcccaggctgaagcgatcctcccacctcagctcctaagtagctgggaccacagacactagccaccatgccagactaattttttatttttttgtagagacagaatctcattatgttgcccaggctggtttcgaactcctggactcaagtaatcctcccgcctcagtctccacaagtgctgggattacaggtgtgagctaccacgcccagccaattatttacattctttatgatacttgatctcacaagcgctctgagtggaaatcgggtcctcagtttctacatcctgttatatcacttagggatttctatgtgttgaattccagtcttcttcaatttggaggagagttacctttcttgctctaaggaggcagcatggtggaatggaaagggaacatggcctgcctcaaactgttgtttgatcttgaacttgtcaaatttcccttcttcaggcttctgtttcttcacaagtaaaataagtaaaagatctctaagcaaaattttccctctcagaaggctgagggaatattatcttgttaatttttcatattatcatgtgaataaaatgtataaatacttcagtaattgttgacttatacctaaaatagaacattaaggtggaagatggtcccatcatacgttggaaaaaacatgtatttgtctatatttataaatgcctgaccagcattaaaagaatgaattcattttgttgaaatgctctccatttcaaagaactcacgcaggaaagttttttttaacccagtggtttttacataaaaagaggaggaaaaaaacccctgaaatgtgtggctgtggtgcacttgatactttacattctcatttactcattcaacaaacattagagcactaacatgtaccaggcattgtaacagagctgggcatgagattgatacagtggctaccaccacaaggtcgctattctcatggagcttacattttggttgggcagatggataataagtagttgaaaaaatttcaaaatagaaataacgaagaataataaaatgaatcataaaaaatttcaaaatagaaataagaataaaatgaataataaaagatttcaaaatagaaataatgaatattatgaagataatatagagaatgatggagggggcacagaggaaactacttttgttcagatagtcagtagaaacataggagggaatatgtgagctgagacttacacattaaaaaagaagcaggacatgcaaaaatctgagggaaagtcgtacaaaagcccaagaggacagataatgtttcaggaatacattaaaggcagagtcatttaattctaacaaactttggaaatgggtactgtccttaccttatagatgaagaaacaaggaagtaaaagagcccaagttcagacagcaagtagaggacctgagatttaaacccagattagtctagctctaaaattcacactctttccactgtgccactcagcagttgatgaaaatgcaaaatttcgtgcaaaatgagaaggcataaagaattttttctgtgtaacatggtggggagggcactcttccttctttttgattcagggagtgtgtataccccagccagaagatgtaaatggctatttgtttttgtcatctgataaacatatggtattgtgtatttttgtgtgatattgttttgtgtattatggttccttgttcccttaagtcccaggtgggcaggtgtcttctgctgggaatcaagaaataggtctttactgagagtgttgttatgggctgaatgtttgtgtcccccaaatttatatgttgaagccctaacctctaatatgatggtatttggaggtggggcctttgggaggtgattaggttgagatgaggtcatgagagcggggccctcacgatggtgttagtgtcctcataagaagagagaccacggcttgctcactgtccttcacatgtgaggacacagagaaggcagctgcaaaccaggaagagtgccctcaccaggaactgaatctgctggcaccttgatctggactttctagcctccagatctgtgagaaataaatgttgtttaagccagccagtctatggcattttgatatagcagcccaagtgtgtgtgtgtgtgtgtacatatatatatgtgtgtgtgagtatacataggtatatgtgtgtctgtacatatatacacagagagatgtgtatgcatctctgtgtgcgtgtgtgtgtgtgtgtgcatgtgtgtgtgttataaagaattggctttcacagttatgaggctgagaagtcccaaaatctgcagtgggcaaatgggaaacccaggagagctaatgatagttccagtccaagtctgaaggtctgagaactgggagagccaatggtataagtttcaatctgagtccaaaggcaggagaaaagctatgtccttgcttgaagacagggagaaagagcaaattctcctgtactccacatttttgttctaatcagaccttcagtgggttaaatgatgtccatcctcagtggggagggcaatctgcttgactcagtctactcattcaaatgttaatctcatccagcaacaccctcacaaacacatttagaaataatgtttaaacaaatatctgggcacctgtggcctaatcaagttaacacataaaattaactgtcatagatgtgctttgtataaggcagtggtgagtgtgaggttgagttgttggagaataggaaggatgtataagacagtatgcactatcagggggcttctgatacagaggagaaaagagacacaaattaaaaatcagctgatgatactagactgtctgtttaaagtgacaaatcaacaggtttcattcggactaggcttccagaaggaggagaaactactgcaggagaggaggtcagggaagatttcctaaggaggcagaacttgttttggaccttgaagaattatggcaggggtgatttcacagtggtccaaggcacaggggctgggaaactgtctgaattatagaaggagtagggcagggctcctgcatatgcttatgcaggttgttcactgtacaaggacatctatctgaggagacaagtaggggctgggatgcagccccacattccactcaccaatccaagtgccctggtgcaggagtgtgtcctgcaggcatcctgaggaagaggtgcctttttctaattcctatggagacactgaagcagacttaaaagaagagatactagttgcaaacagaagggtgagaccaaatcatggaggacatttccttgtatctagactgctaccaaaggatgggaacctgcagctctggtgacagcggtgactgtgggtgtgattcgtgaccgtacagtggaggtagacctgcagtattcaagatgctaggagccttacatatctggcataaaataaagccaaatcttcaaaattatatttgcctgctcttcaaagcaaacttgataactgacccactttgctccaatatcaaatcagcctgatttaattttataagtcagtcatggaaagaaaatctgtcccatgactccaaagcattctgttctgtagctccactataattacagacaaatgcatctaatcttcccgtcatgtgttctcctgagttacaggattctttttttttttcctgtatttgataatcttgttatcttgtgatactgcatcatttaattattccccaaaatagagatcttcagaaaatctattcagaaaaagtgatttgctgttcccaactgaaatcacagctgggatgtttacacagaaattagttattttcagatctttgggattgctgcttttcttaagagatctcatctgccacataaggctgttgaagcctcccacagatcacctgatgaaatttcataaactccagagaaggcattcacagaggtcttcaagcctaggactctgtattagattgagcctggttgctctctctgatttttttctttttctttttcttttttttcctttcttttctttttcttttttttctttttttttctttttttttttgagacagggtttcaccatgttggccaggctgcactcgaactcctgggctcaagtgatcctccagcctcagcctcccaggtagtttggactgcaggcacatgccatagcactcagctgtcctctgatattaaccttcagatatctagctgtgttcagtaactctataaacatttcatgtgtcaaacagtaggacaggctttggtaacacaaaatgagtagagcagagtcctcacctaaggaagtatatggtctctaaacttgatcatcaaaagagttggaatttaatttgactagctctgccaccttctaactgctacctttaagcaagtcagttaattcatctgagcctcatttttctataaaaccagtaacattaagatgacattcttgtaagaggcatattgtgaggattaatttgggtgatctgagatgagtgatttgatttgtgtagggtcactcagtgtttgttttttctttccctcctcctccacacccatgtgttgcctttgtatctttacagactgaagacgactcattattttagctttactaaaatcagagtcatttcattttgttctgtttttctctggaccatttctactttcatcatgtcacttttgtccagataagtggacctaatatgctgtatcataaataggaaagcattacagcttgtacaagatggggttagggcatgagtagccctttatgttgggtttccataagctttctagtgataactaacatttttttacctttcattctatctttttggtttttgcctgttacagctcacaggactgtcttcaggaaacaattttctgtcattccaggttcctttaccagattgtagttgagcattccagttcatgatcctctgataagattatttcccctgaatgtgttttcttacacttaggcacattaaaactcctctgccacttttctgcccacgtccacatcttctttcagtttacccctaatcatcttggcattttaatccctggaagagctgaatgccatctgtaaccttggcaatttccccatgcactctcttccacatcatttatatgaatgttaactaagacaccatgcagcttgctctctatctaagaagtgccttacttgcagagcatttgatataacaatttaatcagtgaattaatatcaaggaccagccacagaatgttgcctttatctgggaaagtattcatgtcttcctgttctttgtttcttattctgaaccaaaccaatgatccataacagaaatttctccaggtactgaaagttttatggtccataaattagataacaaatccaaatttgagttgagaaccccttcaatgtaaagcctgactgtttgaggtcttatttatgtctctgttccagaacatctacagtgggagttctataaagtgttatgtcatttcattaaatctgattttttaaatgtcgttgtcatttcccagctagctactaagctcctagacctaatcaatcaagtgattaattgaattgtcaggtgaatgctgtgcaataggtattggcctgccaagtgccagtaaaatagaaaattctgaagtctaattactacactggcttctgaaatgatcttaagcactgattcattcccttcagtcttctccacattccagagaaagcagcctctcagatcttaggcatatctgactgtatgatctctctgcttaaaatctttcagtattttctgagacagttgggaaaacttgaatacagactcagtaaagatgttaataaaattaattttgtttggtgagacaatggcatggcacttatattttaaaagtcattatcctagaatattggcaaattaatacagatgaagtagattagagattacctgggactgaggggagaggggaatgggcacttattgcttattggctacagagtttttgtttgggatgatgaaaagttttgaaaaatagatagtggtggtggttgcacgacattgtgaataccattgaagtgtatacgtaaaagtggttaaaatggaaaatgttgttatgtctgttttgccactgtaaatcataaaaataacagtcattaacagaatgcttaaaaattgacaggataaatgacatgatgtttgggacttactttaaaatactcaaaccgtagtctcaacaacaaaaacagtgagggtaatagatgaaaaagattggtaaaatgttgatgattattgtggatatttctgcagtgaaaagttgtaaaaaatcatttggagattagccctcaagttccagagactccacctgacatttaaagccctttgctctgccacttccctgccttgggaacctctggtcttcactgttcagccagcagtgtgctgggcccctgtagtgcccagagcctcacccaagcttctgtgcgtttgcccttacatttcaattctgcatcttccttcctatgtggctaattcctactcattctttaagactcagttcagtctctttggagcattcatggacttctccaggcagggagaatggctccctcctttgggttcccataatgctgtgcttgtatgtctactgcagttgataccctgaattataatcttttatttttgtttctgtctctccactgacatatgaggtagaggaaacttgctttccactgtacatcctcctggactatatgaaacttttattattgttttagttgtgtgcttaaatttttttttaaaggaaaagattaaaaggtagaaatgtgagtgctagatgtaaatctgaagagttgagtgggaacttagcagtgacccccatgtagatattggcgtccttttgtagactctgctttctgtactttgttatcactaatggttgccaatttttatagttccagcacctaccactggatgctcagtaaatttttgctgaatttagtgacaaaccacggcgtttctttctacaagttgcaaaagccagctatccagcttctttgagggagggaagtggatgcatacttgttagaagagacagttaatgtttgggtatggtttttcagagcagcaaataagcagctggagggatacccctgtgccagtagagtctgtggctattcagccagtgcagtgagtggtgagctgtgactgcaatcagctgcagtactcatcttgccagtgggtggcggccggcgctcacaaacttgcaccaggacaggaaggcatgatttttaccctaacagtgtaggtggggaaataggaatctcctactatttctagtttattttctaacttcttgaagccttcagatgtttggttgaaagaacaaggcctgagtcagagtcagtaagagctagaaactagcaccttgttaaaggtaaatgtctagaccagtgctagatatttactaggtgctggactgtttacagagctctgggaagtcttttcctccctaaatgccttctggagtatgtgaatccatcttcagtgctgtcatcttctagcctgagatttgatccttatgcaaattccagtcatcttgggaggatttatactctaggctctttcaggtccattagctccaatatagacagagattgaaaacagattttcatgtggaggaggagaggaaggaaagaacttgaccctcaggattgacacatgtgagaagaagatggcagggcctgcagaaataggctctgtcctgagggtgctgtcttctggttttctccagtggtccagcccaaaccaccactcctaacatcccagtcaataagcaagtcctgattgtgaggccactaagtcacagctctgtgaaggatttggaaatttatggatataatgattatatttgtacaggcctagagcatataatcaaacaataagacataatcagtatttaaaatcaaaaattttctgaaaaatccaagactcacatatggatcatccctgctctgaagcattgttacataatctagtggtctgaggcgtaggtgggggagcagtgtctgattattagacaaccgactttgaaaggtggtatcagatgatgatgctgtgagccaaatatcatgagcagacaataaatgtgatgaaatttcagaaaaggaagaagccatgttggctgtagtcatattaaaatagcataaatgtttgctgctttttgctaacagtgcttcatatttgcataaatttcagcatttccaaaactttcatgtcatctgatttcattaaatcttcacaaccacctgtgagccaaacattattaaatgaggtaaaatacataaaacacttagaatagtgcctagtacatcacaggtgttcactattaagatcaccattagccctattttataaatgacacaactaagactcagagacgcattatttgcccaaagtcacacagctgaaaagtggtagaagtaggcctgaacctagcttccctggcttctatttctagaactctttctccattatccaatgcataaaagagggcgtatttaagctaggcttgcctgggttgggccaagttttgtgggggcgttaggagagaagtctctgaaatcatattcctcagcctcacaagccctagttgttaggtggatgggaattgatgaaggtattcacttccttgagtaacaagagttaaatctagaagcttctgctcattttagcaataaggggagatggttcattacctggtccatcaaggaagctgcaagccattaaacttacatagatcctcagctgctaggcttgttaagaaaaatgttacaatagggggaaattgacaacacaggcactacagatatttttagtctgtgtttcaaggatgtacatgttgggttctgtttaggattgagcacaaggggatgaatttagatttatgtgacaagactgccaatcagaaagttcatattggtggggcatggtgactcactcctatcatcccagcactttcagagtccaaggcaggaggattgcttgagcccaggggttcaagaacagcctggacaacatagtgaaaccttgtctgtacaaaaaaaatttaaaaattagcctggcgtggtggcatgtgcctgtagttccagttactctggaggctgaggcaggaggatcactggagctcaggcagtcgaggctacagtgagctatgattgcaccactgcactctagcccgcgcaacagagcaagatcctgtctcaaaaaaaaaaaaaaaaaagtccgtactgggcatcttatctgttcctatcttatgcaagggactgtgtgggaaaactaagggaagtagagtagttttcccagactttcaaatgctggtaagagtggtatcatctttttcttgggtgggggacagtttgggaatattagtaaaaaccgtaactgtgtctgttccttgtaccagcacttctgtcataaattattcatcctgtggatatatttttaaatgtaagccattgtagcactgtttgtaataccaaaagcaagaaactagaaatctaatgtgctcaccaatatataatgccaatgccaatacatgtttaccaataaaatactgtatgtccttcaaatggaatttcatgcaactattaaaaaggaagaggcccatcaatatgtgctgaaagcatatcactaagatatatttttaagtgcaaaaaacaaaagtttaaaaaaatttatgtagcatgccatatgtatgtgtttgaagcatatatgtatgcaggtatagccacacattttttcccctccactggaagtatatgcttataattgataatgggaagtatatgtgataagagaggaatgggaaaaaagaacattttactttttgttttatccttttatataattttaaagatagattgattgattggtttaaccacatgatatactatttttaaaaaatttaagcctccctaaggtcatacaaccaggaaagggtacagctagaattcacaccccagattgtgattccagagcccatcctctggattctagcacactgccctgtactagtgttctcttagtatcaggaaagacttctatcatttgctagcaagttacacaatttttcatgaaaatacctagaatcaaaatgtccaagagcctggagctgcaagaatgtgctcattctccagaagagggctctgtgccccatctgccggccatcttggctccttttctataaggttgtggctcagccaagacaggtcagtgaccctgggccaggaaacacacactaagatttccaacaggacaaattaccttaaggaaaaggcattaggatagctagagaggtgggggtggagggaaggcatgaaaacagttcattagccaacttggtcaatgggcaggtgcaggaagtggcagataaacccagccagagtctataaatatatttcaatatcagtgttcaaaacccacaaaataaatgagtgaattaagaaacttggcagcatgtaagcacctagatgtaaactcttagttctagccttaactcccatgaacttttctttctgatttgggcatgttatttaattgtcctgggcttcagtttccccatcagccaaatggaccacattatctctcttggctccttcacagagttgtgaggaacaactagggcaaggaacatgctttgcaaatgcaaggcatcatacgaaatgcgaggttattgttaatgtctctgagatttacctcacagaaggagagctattttgagacaggaaaataggaggaagcatcagaaaagcattgctgataacaaggtagacatacctcaccaatgaaagaaagggatctcatgggtcattcactccagttccttctttttatagtcatggacaaaaacctgcagagtccaaggtctgcagagaagtgatagtgccatactagactctattagttaaacctgtaaataaaatggaatagtagccaaagaaagggaatatactaccgggcccctgcctgaggggctcgctgagctgtgaatgttgatcagggtcctggaaacaagctggtgtgaagcttaataagaaattggggcagaggtggggggtggacttaagtggtccagctccaggatggctgagtgcctcagaggagcaatttgagggtggccagggacttggataggacaaatgacaacttcctagaacggggtgttccagaacccatagagaaaaggaaacagcctggcctcgtcccgggtagttgacaggaaccagggtaggaagtatttgtagtgggactaatgctcacatcattaagtcccttgtgagtggaagaaggaaaatgggaataaatgcaatgcggcacacacagggcaagtccgtttttgtagtggtgtgagcagagatggagagaatagatcaccagggggagacagtgcctgcagtgtgaagggcagtggtctcagagtgccacagacttagatgtgaatactggctctgccactaacttgctatagggccttgaatacaccattttcaattctgaatcttggtttccttgtctctgaaatgaagccctttctctgtatcttatacgttgttaggactaaatgagatgttcttgaaaacaacttgcatgtaattcctagaacatgatgcccaataaatattggtttattccttcattttggggacaaactcccaaaaaatctccaatgaaatattacagttggaaatttcaagcactggaaaagcaagctcaacttacctaacaggtagagtatggaaaggcccttttgacaaatggagaaccagcctaaaaggacagataaggaaatctaatgtggggagggcaggttagaagcaaagtaggaattaatataaatataagcataaaaatatctgcttataagggattaattacttattacaggggattaattaatgcattaatgtgaggttcctctagatctgtgacaaactgggaagatactatgtactgtgtaactcaccttgacccattttcttgactgctcagaaatgtgggctaagttttgtgttcaaatgcaatggcttccctcagtcttttcccgctaccttctattttggtctaattaatttcctctcattcattgattgttctttaatccttattttgttggttatatttttaaattactaattgcctcaggtcctctttgtatgggtatgaagaagtaaagtgataataacagtttctttaaaaactaaaaatccaagggtggataccaaatagaaaaccatagtaaaacgaaggatcaaggaaaataaggaaactgcagagatgtataaagctgatctagcctttatgaagaataaaactggggaaattcctatttctagatgcgttttatagccaaaagaccagagatgttataacaaaacctgataatgaagggatgttttggattattttatagatgggtaaattgaggttaaaagagaggaaatggtttgtcttgtggtgatctcatagcagaatgtggatcagaacccaggtctcttgaccctcattctggagatctgtctgctgtggtcctcttctttgtaatagtaaatgtctgactttaaatacttgcacaaaactaatttgtgtgggtttattcttttctccagggccaagtgctttcggggcaaaaaagtccttggagattatgatatcaaggtggaacaggtaatcagcctgaagcccagagctgcatccccgtcatcacagtttcctcttgacatgccagagtgaaccatctcgttctgctgagtggaatactgtgtccatcattgggttctggactctgcatctcctctctctcctatcctttccccaggacctttctgtctgtgaggcatggtcctggagtctgcatcttttcatttctctgattcctttttatggctctagtgtctgtagatgagcaagcagtttggttcttagcaccctcttgcagtgtaaggttcccagactgaggaaaactttagagggcttcccagaatattgcacgttacctccgtattgttggtggcaagatatttctcggtaggcacatgtctgcctttcaggtatgctgccccgagtgatggctcctttgggcctgaggctatactttagaggaaacttagaaaagaacacttccttgttttaatacagtgaatcactgaaagtccaattttttttttttttttaaccttcctccatcctttgcttcataataaatagtgattgggtccatttggggaagaggaggacgttcagtttcaacaatgcatgtatttcctatgtgataaaagaagtttctcatcattcattatacagtgtgttatgacttactgactgttttcaaacaacttgttacataggcaagattgataaaaattattcccattttgtagatcagggaaatggaaacctagagagtacaagtaacttgcttaatgttttatgcagctaggtaaggggaaagcagaactaaaaactagttgcctaaatttagacctagtgcttttatgttgaaactgataaaaagacatttgtctcagtccacattctcgctctgtagagaggcagcacaaaggatgctgggctgggagttagaggacctgagttttgctcctttctctgccaatgataagttttgtttgtcctgaaaagttacttaactgctctgagcctcaatttcctcctttggtaaatggggataattatctctgtcccaccttcatcacagtgttgctattagaattagactaactcagtatgtgaacatgttttgaaaactgtatataaatgtttggtggtagggatgttgctgctgctatgtagaggacttggtgaagtcaggattgtgaacttattcccctgttattattttccaggcagaattttcagagctcaacctggtggcccatgcagatggcacctatgctgtggatatgcaggttctccggaatggcacaaaggttgtccggtaagggtctttctgtcctcaggatcattgtgactgtctccagagttactacctctggcccaaagaggtggtttctaagtcaggtgttggagtgagatagcagtgctatgtatggtatacagaatttaatgatgtgagttgtgcagaaatagtagaaaagagagagaaagccagcttctcgctgagcttagtccagtggtagagaaaacaacctgaagcttcacagactgagagctcacttagagataactggattccttataggattatttcccccaaccccttcagccagtgcagctctgtgcttttatcctgcatacatttcccttggaaaacagagttccattgctttaaaacaaacaaacagacttgaaaatgtctgatgtagttcagccttccattttacattgatttgcttagattcccctagtgagttgtggcagagccctgtcttctatgtgagatcacttgactctccatcctgtattctttctatattcctcattcctgggaactcctaagtctgatagaaaaacctagggctggaagagacatggtgggtggaagaaaattagcaattattgagcacttacatgccaggtggtatgctcgatgcctcatagatgtgatgttgtcatactcacagaattttgtgagagaggtaatgagaattccagactggaaagtggcggagctgggagagggggcggcgggaaatggtttcaacaagtgttattcttcccaggagctcattatggcttcaggttttcagacatcagtcttgttccaagaagagtcttcacctcactctcttctccacctcaatctacagtaacctgacaggcttccagtgtccaacaggaactggattggtgacaggaaaggccagactggaggtgtctgggacctaacaacaggaaatacgagcttgtccattctgaagatcaagaaagaagacagaaaaagagatgtccatccgggtggggagtgagcttaggtagcccctacaagagaaaatggatgggctcctccagctgtaggtagagagggtaatggggatacatgaacgcaagcaggtggtgacagagaggcccaaaagcagggcaagaataaaggcaggcccttctgggtaccagggtaggaactcaggggctggccacagtgtacagctcaattcctgtaactggggtgcaggattggagttgtatttcaggcatacagctggtgccagcttcccagaactgggacacaagaaggtcagagcagctctaacagatgccatatttctgtttgtttgtttaatagattgaggggattcatgtacagatttgttacacgaattatgtacattatgtaatggtgaagtttggggttctagtgttccatcgccaaaataatgagcatcatatccaataggtaatttttcagccctcatccccctctcatcctcccctcttttggagtctccagtgtctattgtttccatctttatgtctatgtgtacccattatttggctcccacttataagtgacaaatgcagtatttgattttctgtttctgagttacttcagttaggataatggcctccagctccatctttgttgctgcaaaagacatgattttatttttttaatgactgcgttgtattccatggtgtatgctatatatattttcttcatccagtcatccactgatggatacttaggttgattccatgactttgctactctgagtagtgctgcaataaacatatgagtacgggtgtcttttaatatgatgatttattttcctttgagtagatactcagtaatggtattgctgggtcatatggtagttctacttttagttctttgagaaatctttatattgttttctgtagaagttgtactaatttacattcccaccaacgatgtaaaagcttaagtcctcgagtggccaaggaaggctccttcaaccctcactttaaaagactaatctcagcctgggtgcagctggggctggaggtggtgggcggatggctgcctgggcagagaaccaagtaggtcattgtatatcatatgactctgctgaggcttagtgccttgggagtagatgctgccacagaactgattctctgggaaggtggggtttctctgaagctcagacataaaaacaggggccgtggtcctctggaatagcggtggctagaagctttgctggctagaggggaaacgcaggagctttcccatgcatgggaacattctgtactctcagggcttcctgtagccattgctcaacctcagttctgcgaaaaatatttgtacccctccctagcctccgctttggaagaataacattgggaagtctggcatctgtcctcaaccagcctggccccttgctctcctgggggcctgatgagggcattgcctattttaaggagcagctttaaggagtcagaaaaggacactgagatcatggacctctgtggcagtgtggtgaagggagccaagtactgtctgttgtcttcagttttccaggacttgctttgagctccaactcgaaagccacaaggagcttcaggctcttatacagcctcatgaagtcaaggaaaaatatttttcacttaagatgtgagagtctaaaagtgtttcttccctcctaagggtatttgtaccttagaaaaaggtagtgcttagcccagaggagagaggaaatgtcagaattctgttcctcaaatctcctttggaaagtaccataatattggccaggcgtggtggctcgcacctgtaatcccagcactttgggaggccaaggcgggcagatcacttgaggccaggagttcaagaccagcttgtccaacatggcgaacatggcaaaaccccatctctactaaaactacaaaaaattatctgagcatattggtgtgtgcctgtaattccagctacttaggaggctgaggcacaagaatctcttgaacctgggaggcggaggttgcaatgagctgagatcgcgccactgcactctagcctgggcaacggagcaagacttgtctcaaaaaaacaaaaaatacaaaaaccaaacaaacaaaaaaggagagtaccataatatcccatttcccagtccagaaaggaataataataataaaattacaaccgttgctcatgcatgcactcccagcactttgggtgactgacgtaggagaatcacttgagcctaggagtttgagatcagcctgagcaacatagtgagacctcatctctccaaacaatgaaaaaattagccaggggtcatggcacttgcctatagtcctagctacttgagacgctgaggcgagaggatcacttgagcccaggagttcaagaaaagcctgggcaacaaagtaagaccctgtctctccaaaacataaagaattagctgggcatggtgatgtgtgcctgtagtactacttacttagcaggctaaggcaggaggatcacctgaacccaggagtttgaggttacagtgagctatggttgtgccactgcacttcagcctgggcaacagagtaagacctgtctctaaaataacaacagtaaaatgaggggcttggactaggtggttcctaagccctcttctttatcttgggttttggaaatgggaaccaaaatgatgtatggcctgaagtgctggttaatggcaaacctgcctctaccttctcaccaggtccttccggccagacttcgtgctcatccggcagcatgcatttggcatggcggagaatgaggacttccgccacctgatcattggtatgcagtatgcaggcctccccagcatcaactcactggaatccatatacaacttctgtgacaagccatgggtggtgagtgaggcccccttcccccaagtaaaagggtaggattcaggccctacatctcccaggtccctagcagggactcaagatgcagtaggccccagccccaggagggtccctacatcttccaggcccctaggagggtcctcaagatgcagttggccccagctaagaggatgtgagaggagcttcccctgggacatgggggagggctggccatcagaatagcacagcatcacctgtcacaggctcagcacctttgctgcggagtggacctttggcctcacaacaaagtcgcacaaagataccgtgaagaagcccttataggtctgtaggctctgcccttggccataggctgcaatgataaaaatgtctgtttcttgcctcctagaatgattaaacttttggaaaggcctgagcccagtgacaaccaagggaatagtccaactcaggtagtgacagagtcctaccaagtggttcagcaacctgaaaatgaaatttatcctcatgcatgtgaatcaaatacttatgagctagaagtgtcttggagatcatcaaagcctaaccctaattctgaccttaacctttcatgatagagatatgaaaattaaagaaggaaagtaaggtgtagaaaactacttactataggatgccagtttctgagatttttctgttaatttcatttaatcctcaccttacaaggaagatatcattattgtcactttttacagagaaacaaaacccaaaaaggattaagtaacttgccaaagttacagtgccaggatttctctacatcccactgcctctcccatagattgaggctcctatataaggaggaaactgttctggttttctcttccttggccaatttggaaatctaggagggcagtggaaacttttaggcagatagaaaaagtggggctaggagggagagtgacttatgatggctttgggggcactctggcttcccctccgaccactgaggggacccagctcctctgctggctctgctacttcaggctggccctctcagaaggtaacacctacccctaatcacatcctcattggcttgcagtatgcaggcctcccctgcatcaactcactggaatccatttataacttctgtgacaagccatgggtggaaagtgaggcccccttcccccaggtaaaaggctaggatccagaccctgcatcttccaggcccctaggagggacttctggaccccaagatgcagtaagcccttcttgttttgtaaaaatgaaatttcagctgtcacacgccctggattgccaaggttcctggcacttgtgtctaattgtgaagtttccacacctttacaccactcagagagctgaagaggggtgtgtgtgtgtgtgtatgtgtgtgtgtatgtgtgtgtgttaaccaaacagatctgtcacttctgatcttgatcttttttttcaccctggaactaacagctttctttttccttttgaagccagggagagcttggagtgtaagaaaaagatcaatggacaagtagtcaggagggctgggagctgccatggttaaggagggggttgggttcccaagctccacttgttcagcctttccttctgcgtggcctgaggcatctggaatcctagattctgcagaaacacgctaacagagtgtgattttagtatgttgccaatcacagaagagcatatgtgagacctttaccaagtgtcttttttgtggacctcccctttctcctcagtcacatgtccttcctacggcacacgtgtcctaacccacgtgcacccccggtacttgtcagaatttgactctctcctagccacacagggtgatcctgctattagcagctttttctgggtgatttcactgcttatcaactctctgaccgaacctgtgccccagtttcttcatctacaaactgggaataatagtagcacctgccaccactttgacagcctggttgttacaggctcctagtatatgggttctcttaaagaaatttgtggccagacgtggtggctcacgcctgtaatcccagcactttgggaggctgaggcaggcacatcacgaggtcaggagatcaagaccatcctaactaacacagagaaacccgtctctactaaaaatacaaaaaaaattagccgggtgtggtggcaggtgcctgtagtcccagcaacttaggaggctgaggcgggagaatggcgtgaacccgggaggcggagcttgcaatgagccaagatcgcaccactgtactccagcctgggcgacagagcgagactctgtctcaaaaaaaaaaaagaaatgtgttccctgttttcttttcctaaactgtgccagaggccagggcaggaagaatggggagagcctgtggctagggctttgctcctcccgggatctgggatctggtgaggggtcacactctcacccattcacaatctgagcacattgccttgggccctgcatgaggagaacagcagggctccctggccagaccccaagttctcccttcagtttcacaaagcagctgccacatgaatgacgttttacatattgttctctgctagttcatgggagtggacaaatttggtgactgtgaggggagggtccctttcagctgatgactttgggttgtgtttctcaatatctttactatgactgctgttggtgtgaggagatactttgattgggttggaaaaggctctgccttgcacagctgtgtctctgagcacattgctgtctctgaagttggtcagggcaagccactgggatttggggagcagaagtggacctgtcaatgaaagcagcattccagacaaagcaagaatggcaccaccgtttattgctgccagtctatctgaaattccgtgagtctttctgggtttttggagataagtgcaccagagttaaattaaatcatttaatttccaggagtgataggcatagggacacattactcaaatggatctggaatcccatttttttccaagaaatctttcttgattcattggatgagtggctataatggacatatcttcctattaattgccaacagcacccccagctcccaaattcattcttttgtctatgtgtagaggtaacagcccttatcagatgttacatttgtttaattggtgactgtgtggctgtgatttaatctaagtttccagggagctatgggttagatgccaagctcactaccttgagcagacagggactgctggagaggagggtggggtgagctccctgagacccaacgagagcctgggaactggctgccattattgtgttggctgtcccagggctctgggagtctgccacaggctgtcctggcatctgtgtggtgtctgtgtaactcccccacatgctggaaaggtagggccccacatgtcttggtgccatgccagagcgtgggctgcagcaggacagaggtcgtttggcagagctggcattaactccctagggatgctggagagccttaggagcacaggcaggtgtccagaggcagagcagaagtccagccaggcccagatgggcaggcaggacgtaaaggtcagatgagcaggtgtggagaatcagagaaggcaggaaaggtctgagggttcgttcttgacagttaaagcaaattgaaggaccaaagtcggtgaggacagcagggtacaatggtgaatgcacccagcaaggagaagagacctgagtgctcttgcagtgcagccctgactccaggatgtgatccgggagcctgcactttcctttgctctccagcctcaatctcaatttgtcaaatcagagggctggcctagagactctataaagtcccttttgacaatggtatcttaggggcttgagggtccatgaatcatcctttcagtcctggaggaggccctagagctctagagtcaccaattgtttgtcactaaagggagggacctaggaattccagtgttttccagcatttcaaaaataacaaaatcatatctatacctacaaaaggaccacaacagatgatcacttaaactacagtttgatagcagagtttgggaggaaatataataaagagatattctttatggtacaaagtttgaggaactgatcaaatttaaccatctcattttatatatgaagaaaatgagatccagagaggaaaactcatttgcccaaggacacctaggaagttaacagaacaagaatcagaagattccagttttctaacaacccagttccgagcttttactgccccaacctcgtctcccctccctggcttatgtgccagtatcgcttgtagagaacaggacctgagctgttgaaaaatgttctagccttcctttctctgataaatagatttcatctagcagctttcccttctagccatgccagataccagtggcttcgagtgtgaactaatccagtagccctagagagatgtgtttcctctgctgctgatgcactggggatgggagtgtaggtgtgtatgtgactggattgagcaggaaagtcctgtatttcctgtggaaagggcatagtttctacagagcctgaaaggcagctacttgcaggaataaggagagttatggattggaaatgaaggggccttgctgtgaacctggctcaactactgtgtgactttgggcaagtgacctctctgggcctcagcttcttcatttataagatggagcggggtgggggagcccaggtgtgcactaagaaagcctttcaaccctgacactgtaagtatgtgtactttgccccttccccatggagctattccagtttctcatatgtaggcaaagggtccagtaagttcagtccctcgttaggtagtaagtcccagaaagactgggcctgtctatcccacataccatgaccattctaatcttcctgaagaacagcttcattttatgatgcctcctgctcaaattcttggtgattccatactgcttactggaaaaatccatcattcctttgcctgacgtttgaacttccaagacttggcccatgtcacctatccagcttcatgccttgcgatcactcagagatgcaggtgtggaaagtcagagacccaatttttgatcccagcttcaccttgcagttctgtgactataggcaagttttgtaacctctctgggccccatatgtaaaatgaatatgataaaatactagttcatcaatttgatttgaaacatcattacaattgagaaaggtaattgaattttagctcactctctttcccttccccaactaatgcgtatcatatccttggaaataggaattgtacacttcttttatatcctcacaatgcttagcataaagtcctccacagagcaaatgctcaataaatatttgatgagttgatgtttcatctgtttcagaagttatctaagataagctgtaacatttgcttttcttttgcagtttgcccagctggtcgctatctataagacactgggaggagaaaagttccctctcattgaacagacatactaccccaaccacaaagagatggtaagtggctcagtggggacattagtctttctgctgttttcattttgcacttagccacctggttattgtggggctctgaaaagggcctcagcatctcaaccccaaagactccactggggttgaactatagagcttatgcggctggaataactagattttagctgacagcctcttgtcaaattctggagatagaatagggaaaaacaggagtaagggcagtttaatcaagctgagagaataacaaacttctggaccaacaatcagatctcactgcttttgagtcccagccctggctctgccacttgtcattgaacaagctgcatttcctcactgtgtgcagtttccaataagacggtcaagtgggcatatttatccctgcacaggatattctaatatggtacagacacaatttaagtgagattcattaagtaatagcttctgggaaagtgtgaagcatctactagatgtaaggcattgctcctactattattaatcccctgactctcccattcccctggcgcttccacaactgtgataaggctgggttaacactgtgccttctctgaggccatcctagtaagtcagaaggagcagagagatgggacggttggttggtaaggaggctattgccaatgtttttcccgtgcagggacctggagctcaaactcccttcttcttccctgtccccacaccctctgccccaggctggtgtgatcaattggtgatcgtgcttaacccaccaatggagactccctgcgaagcattccaagtggaacagagattatgtttgtgcccgcctccccacttccttggccaaaaggggtctccatttacaccatttctgcaaatcaagagccttctgacacattgtgcatggccctgctcaccagcagaccacatatcaaaaaacaaccttgggcattgaaaagaaccatctctgtcatctttgccagagcttccccagggagaagctctgaaactctaagctcttgtccttaataaatcctagaggccaatatcaggacttttcctttcagggcaagccaggaagccttgcagaggctgaggagccctgagggtcctttggttggggaatctcagggagcccaaggcacaatggtgagagtactcagctgaagggtacagggggctctctggggatcaaaactggctttttcctgctgtagcatctagcagggctggctgctggaaaaaaactgccttaattgccaggtatattccctacctaccgtgctttcccctcaagggcctttgtgttatttctctccggtgctctatcctgaaatttgccctcaagagaggaccacctctctgtggtgtaaaaagccaacaaagggggatttcagctctgtaagaaaaaggctttgtggcttttaaaaagttctgaaataggaatgaagatgttagtaatttaaaagagacagaagagaagccttatggacatcagttgagggcattaaggatagttaacttggagaggtagtacctattctgagacagtaagtgcattcttattcaaagaggtgtgctaaccaggtgggaccctctgccagaaatggtatagaggggataacagcattggaaggcaggttagtccattctggctctcacattgagtgattctgtgtctcccaaatgactcccccaaacagatgaaagtgtatcagaggattaggatgagttgagacaggggaagtagaggatacacagccacagtatgttcttgttttcattcctgccagtcagcctgtttatgatgctgtcaaaccaccttctgatactgtacatcgcaaggatataccatctcatgtgtatgacattcgccatttctcccctaccagatcgattaagacaaaggaaaacacatattcctggggaggaaagggaatagtcctggctttagaaaacagactaagccagaagaaacacttgcagtaacagctacaaggctagactaatggggtttgggaggcaggggcaacaggctgagggcagggcagaaaagtcatggccccttccctgccttgacagtggccagactgtccacttggcacttcttattagctggcagcaagaggtcaggtggtaatggccaaagctctgcagggaaggagaactggcttgatcttcaggactcttgaagggatgtgatggtcactggtccctactagggctgaacgatgtcaacaaactccttcctgagaggcaggtggccccggtaccagctgcaggtgccgtcaacatgcttcatacagacataatgctgagcctggtaaccatagagctttcgttccaacagccagtctgtccagaggcactcgttaggggccgagatggtacagggtactgtgtagcaggtggtgatctagagtcatggccacacaacattaaagtgagtagggtgtccttctttttccattgctgcctttcagattcctacgtacctttccagcccatctcaaatgccccctatcttatcaagcctttcccagtccccagtcttctcctggattctccttccccaaggttccccatattcaatattgccacttagtggcatctctggagtcagacagctctgagggtccttactctaccactgaccttgagcacttcacttgccagagctttcatttcttcaccttaaaatggaaatcttaattcttcataaatatgttttggagactaaattaaacatttacagtaaatttactattacagtggctggcaaagaatagactctctttaaagggtagctgtgttacagttatctcggtctgcctcctgtgatggccaccttcccagccaaagtgtaagtactttgagatcagggcctatagactgtattgctttctcatccccaacttcatacagtgcagatctcaagtatagtctagtaagtgaataaattcatgcatgaatgaaggctcagaacccttcccccatccctaaagactttggaaatggacattcccttacttggcagccacagttcagatggtagtgatgattcagactttccctctgcaccaaggacaggtcctcccagggctcgatgtagttgcacagatggatgaagacttttccatcactgaggacctgaccttcaaggggagatggaggagagtcaagcatcaggattcttctcctggagccccaggggcccaggtccttgaaaagcccagaattgcagcctccccaatgactttggtggcagtggtggcatggggctcagtgaagggaccaataaataaaactactataatctttctagcaaaaagataagcagattatgtttgtacgaggcagagttgtgggatctggtgaaggccttttcgtttagcatggtacagagagaagaatgtggtctttaaagtcaaagtctgtgtgggatccccctttcttttctgtcatttactagctgaatgatcttaaggaagttgtataacctctcagctggaagatgaaaattataaagttgtcagattaaatgagagattgtctataaagttcccagcacagtgtggtcccacagaagatattcaataaataataggtcccttcccctttccagcccttcccagtatctgcacaggccaggctcctgctctagattggtgagtcttttaccttccccataggaaatttccccctttttacctatgaagctccttttcacctttcaaagaccctttcagtgccacctcaaagccatctctgaccacctagctagcccatgcctcttttagaacctcagtcgctcaatcatttactcactgagtgactgctgtgatctagtaccaggaatacagatataaaaatgacaggatctctgctcccaaggagcttagaaatgagtagggtagatggataagtagggaaaaattacactattgtgtggttctatacaaagtgcagtataagaacaaaggaacatacaattatttccatctatggaaggagtgtggggcaaagaaggtgtctcagagaagactgtgcttgcattgggccttgaagggatgagtgggagtctgcctaccaaacaggttgggggaagggcttcctgtcattgccactatcctgtgcagaggcagggagacacagcctggcagcataccttctgcaaccacaggtagctgagttcagttcttgggaaagtgaggggctgggaactgatattgacaaagctagagagggcagcagtgttctggtcacaaagagctttcaacaccaggcaaaggagcttgtgccttctcctgtaggacctgggcaccattgataacttttcttagactattttttgtcatttctccccaccctcagttagacttgacctccctgaaggcagggaacatgtttcctcatttcccctgctgtacctccatgcctagcagcgggctagacacacagagggcaggtgcttaggaaggaggtgcgataatagagtttgaaagggcctggtctgctagacctgggaactgcagggctcagtggtgtgtcctgcctctgcctcttccatccaggagctcctcagttctgtacaattccacatcctcagagctaggaagcccttatcattgtagcctccagtgcctatgactcatcaagagccatgtctggacagtgaactcttttaaggactgtgccttgttactgaatctccactctcctggccaaggcatggcagtgactaagtggtcattcattgctgaatgtgtggatagatcgtggaatcccttcacctgttccctcccccactgctgtgctttttctttcccttgctttctttctaaatattgttttatgttttcaggccagtttagatcccacctacacaatgaagcttccctgatagttcacaactaccaaatagttccgttctctgaactccaaaataatttaatgttgcattcatttatggagtcatatttttgtgtgattctttaactgttctatcccagccaattcagtatggaggaatcctgcctgggcccaagttcacagagacagaactatgttagactcaagctcctgttaagtcctgtgcaaaaggcagagttgacctgcaaggagcagttttagagaggagactttgactcaagttgccaaaaatcttatactaatttaaactatttgaaaaacggaagcagctgccctacactgggtgagcagcctgtccttaaaatagtgaaacggtggccagggtcactgtactaagaactcttacatttaaagggaggttacaaggctcctcctaacccagaggttgtctgtcactaacacagctctgttttatgcccaagaaaatgccacctggctcagcctactgcccaaggaagaccctggctcctttctcactacctcccctagggcagaatctattatattaaggccagttgttggtcttttaacttaccagtcaagagatactgcttctggctgttggcttctagtttcacaccacagagggaagagtcaaaaggcgtatagatatactgaacatccttgactttctcaaaccctttgaacatctgacaggcaattacaaaaaaaggcaatattgggtcagtgagtgtactgtatatattaacagacaaaaacctctcacttctcagcctaaaaatgtaagcaaaagtctagttgaggattttgtgtcctcagatgtccctactgggttattttctctcttaaaacaaaacaacaacaaaaaaaaacacctaaaccttggtttattccagtaggtacctgtagtggcaccatacaccagcagctgtgggaccagatggatgctgaggccctccctggcaatatccctgggattctatgggctctgcctccaaatctcatccagttccacttcagtatctagacccaaggattactgagccaggccacctgaaagctaccagccctcccagaacacagactccactttctccatcagccttaggggctacacatcccagcctgcccccatgtacctttatctgtttgatttcataccggagcattttttcagtgtcagcagggtctgcactggccggaactaccttctcactggagattttggcccgaatcactgcataggaagagaaaagagggaaccttcagcagctggtgggggcaatacacctgaggtctggatgatccagggtccatgaagaagtctatagggcagttcttggttttggtgtggctgggttgtgagcaacgtgatgtgtgagaagggggacctggaaacacctcccctgcagtcactggaagttccaaacccctcaggcttattaggtcctataaccgctaagctgtttctgccttttgaaccagttagtctggagagctctagttctccatagccgtttgtgcagtggggcacagggtaggagtcagagtagagaagggaggaggagccccttcagggcagtcggtgtgaagtttatctattgctgtggtcaaggcctctcatcccgcctacagttgatattagtaaatgtttattgaattcataaatgttctgaccctgcactgaggtattgcatctcttgccatttgagcattaataaccaaaaactgttgatgatgttcttcctctgtgcctggccttgcactaggcactaggcccatagatgtgattaagacagggtccccatcctgccgagctcttgatctagtggagtgcacacgtgtaaagaacaacagcacagcatagtaggagcgctaagacggttagagatgctgaggcggcaccaaggagcccgggagcctgcagagaaggggagagacctaagttagcccttgaaggatgagtaggagtctgccaggaatttaagggtgtgagggagggcattccaggcagagggaagagaaaggacagaacgtgtgtgttgccataggggcttggtggcaacctcagttataggcctggacagacacgggtagttacaatgcaagccctctcccctcccctttctgtccccagtctagtagttcagaataatcatcagatagctccggtgacaccttgtgtaatgacactccataattgcagtatggccggagtgagggaggtcgctatggaagtccctgatgaaatcttcatttccttatgaatcagtcaggttctgggcttgcaaggttgctatggcgcctggtccttctccacccatcagcctcagcaagagacaaccggtaagaatttgagctcctcccttttcctctggactcctggtgtactgctggccagatactaatcccccacaaccaccccctgctgtggacctcgcggacctcggactcaccaagtgccgagtggcagatgtgctgctgagggtgcgccggggcgcagctgcatgcctcacccagccccgggggccgcagcaacgccagcagccgcagcaacagcacccagcttggcgcgggccgagggctcccaggcatgacactgcagatccgcgactgagcctgtgaggtctgggggactggacggccccagcagggctccttcccaaggccgttgtgcccctcgccccaggctttatgaggtggccctaagggccaatcccgccccgacgggctccgccttcctttggctctaggccacccgcggaggcaggacccgaggctcttccgacctgcatactcagtaagatgcagagggaagcctggaaggaggccctgacctctgtttccctgcctaagtcatgaagcgatctggaagcagaggggaagcactgggagaggggatggtgtcaagggcagaaagacggaaagagccacaaagacaaatgcatgaggacagaaaaactgagggctgtgattcaggcagaaagaacaagagtgaggagaggcacagacagaaagagtgagacaggcagagtcccagagaggcagacagaattacaacaggcaaaagagacagtgacagagaaggacggaccccttgctgagctgcacgctgggaatgagacgagctactcagggcttctttcagctgcaggaagtgctttcaatgccctatttatgaggctccaaagcaacagcaaacagtaatagaacaggacagagaaagttggggtgtgtgtgtcttggctctgttgcctggggggtggggagagatgtcaaagaagcagccagtgctttagaaaccctttctcactcccagagcctcagactctccagatagctggagacagcgctcttggtgtacaaaacacaaagtgtcccatcacttagggcaaaccttggacctcaaagccctctcgaggccctagactacattgatttttattgcatgtcccttctcactggagactctgtcatgttctagaaggtgggacagcttagaaaacaaagaagcaggctgggcgtggtggctcacgcctgtaatctcagcactttgggaagccaaggcgggttgatcacctgaggtcaggagttcgagatcaccctagccatcatgatgaaactccgtccctactaaaaatacaaaagttagccgggcgtggtggcctacacctgtagtcccaggtactcaggaggctgaggcaagagaatggcttgaacccaggaggcggaggttgaagtgagctgagactgtgccactgcactccagtctgggcgacagagtgagactccgtctcaaaaaaaaaaaaaaaaaaaaaaaagtaaaagaaaaaacaaagaagcaggggacttgggggtgactgtgaccagagccttgtctgctgtttgggcacagtgttgcaagcctccaaatcccaaatctccatgggattattgctgtgggatgtttccacatggtgctggactggatagtgggaggctgggttccaattctgactgtcactgtagctttgtgacttttgcctctctgggcctcagttttttcttcataaagtagagttgaactacgtgatttctaaagccctttgaagttcttcttcccatccttggctggcctcaaccaggaatgctgagatcctcaggccagatacccccagtatctgttcaaatcttagttcccataggagtctgacttttcatcagggtcaacattatttccttcaaaggataccttttcattttgatggtgttagtgatatttgaaaagaagggaattgaaagagagctgagtctgactgaaagatgaaatgcccgggttagcatccaggctggttcttcatacaatgttcagaccaagatagaggctgatgtactatttgaagggagctcagaaagcatcccatctgatctcttcattggacagatgtgaaggctgaggcccagtgagatacagtgacttgtagaaagtccgtggcagaagaggactagagtactcgtctcctgacatctagcccagtgctccttccactccacaatattacttcttacatcaccattttgtagcagcttgaaatcttgcccttagaggataatccttcttttaaggttttgttgctcctctgttaaagtatggctacctcagtgtagagttcgctcccctaaggatctctctgcatttataaacatactgaattcttctaccggctctctttcaaaccccaagctgggaagaaatgggccttcacatgcaaagccttgtttggtggtgagattggggtattggtgagcagtgaagagtgtgaaagagggagaaaacaaccaggatcattacaggaaagctgggcctttgaaggttgtaggtaccaagagggtacatgctgacagggacatcaagatgccaaagatgtgtttttaaaataaaaatacaggtttattaaagtacatctacatatagtaaagttcactctttcagagatactttctttttttaattctctttgtctgagggccagtcctgcccaggttttgtctaatgcagagaaaattgacagtgcattttaaagatgtagggtataccaaataagagtacagggttcttgtagcactgccactaatatgctgtgtgaccctgggaactcactgtcattccatgggtctcagttttttaatctgtaaagcaagtagattggactagttctttaaagaaccctcccaagggtattcccaagaaaaatatgtgtaggattccacggagagatgggcacactctgacagtttattcatttctcttctgatttcagctgacactgcccacgttccctgtggtggtgaagattggccacgctcactcaggcatgggcaaggtgaggcagagaggcctgctgtgcttcagggttgaaccaagaagggcagttttcagagcgcccatttgtgaactgctattctccctctgtcactgatgaattctttccaaagagaagatgatttgccacctctaaagccatgagtgtcacccaaccagacctctttcagtaagcagaatgcaagccacctgcttggtcctctgggtcctttgcagcaagtgtggcccttgagttctgggaagggaagctagggagaaggggcctcctggggagatgtggcacccagattagtgtctggatcggatacatattggtgggtttggaggctcagggcccttgtgacttctcagtgtgtgtatgtgtgtgtctccctttccccctttctgccctgctctaacattaggtcaaagtggaaaaccactacgacttccaggacattgccagcgtggtggctctcacccagacctatgccactgcagagcctttcattgactccaagtatgacatccgggtccagaagattggcaacaactacaaggcttacatgtgagtaagagtggggtatgttttctcctcagtgatgatggaaaagctgagcctccacattgcagccaactctcagataacagagagggtgccacttaagtcagagatttttttacctgggttccttttaagtcagaggaggggtctgtggactaagatgagaaaatatattaatattcattttcacttgcctctaagggaaatttagctttctcttcattttgaacagagacgacagactacattagttacctgtacataggagtttgtcactaaaggtgattactgattttcttagatcttagatcttatagttgagacacatatctctatggattattctcattcctactttaaaataatggtacttgttaggcttgccactacctcctgttacttagaaacacatattttactaatcacagatttgtttaatatttttgataactctaattgggtagctctgggatcccatgtactctatcttatacagttacacatcttatatattgtgttcattggaaggaatccataggcttccccagactgccacagcacaaagttaaaaagttcctggtataaatatccagcactgaaaaatgctacagaacattaaaagcccagtgcatgacttctctgtaactgtgtccatttgccaggatggaaagttaaaaatttcctgcattagaatttagtaaaggaaaagatttcaaaactacctgactttccataatacgcataaaatgcaggtggcttataattccaattttggaaatattaatcccccacttaaagtttacagtgggccaggcgcggtggctcatgcctgtaatcccagcactttgggaggccgaggcgggcggatcacgaggtcaggagatcaagaccatcctggctaacatggtgaaaccccatctctactaaaaaatacaaagaaattagccagacgtggtggtgggcgcctctagtcccagctactcaggaggctgaggcaggagaatggcatgaacccggaaggcagagcttgcaatgagccgagatcgcgccactgcactccagcctgggcgacagtgcaagactctgtctcaaaaaaaaaaaaaaaaaagagaaaaagtttacagtggtgttttctttacaaagaaagaacattattaatatatagatttgatcttggtcactcaggacttcagcagacttcaaggttgagcagccttccctttctcttccccacctgtgtctgtttttcttctcttacccccccttttcactacttacactccccaccccttgagtgagttaggccccctccctgcactcctgtcccataccacccttcacacacctcttggttagcacttgccacacatgtgttttgtgtcaccctcctcctccagactctgagttccttgtgaacaagaatgatggaatcatctctgcatctccattaccatgtatagcagcagaaacattaataggcacccaataagtattcagggaagaacctttatggaaaactgaggcatagaatttttttttacctttattgtctagatttgtacttttttagtttacaattttatatttataatcttcctgcttccagaaaataatttaggattgctttagaaatatgcgcaatgtggccaggtgtggtggctcacatctgtaatcccagcagtttgggaggccgaggcaggcagattgcttgagcctaggagttcaagaccaacctgggaaacatggtgagaccccatctctacaaaaaatacaaaaattagctggatgtggtgcttgcctatagtcctagctacttaggagtctgaggtgggaggatcacttgagcctgggagatcgggctgcagtgagctgtgattgcaccactccagcctgagtgacatgggaccctgtctcaaaaaaagaaaagaaatatgcacaatctaagacagaataatttaaaaaccattataaaaacttgctaaaagaagcaaaaaaatatataccttcaggcacctaggaaagcagattacctatcttttaattttaaaatcccctaaataaacacaaaacattaatgacaacagtggagtaaaagtgtcttgatccttaaaagaagacacctaaattttaagggttaaggtttcaaaaaacaacttaaactgaagcataaaaaaagagacttctaaaacattgatgaaggctgggtgaccagagaagctttagataacatttatttacttttttggtgtgcaagggaccgtcagttattggagaaatgtttaggccctcttagcttctcctcaccacacttcttccccaaacttgtggctatattcctgctctcagaagaaggaatttacttagcagtagccaagattaggcttgggattcttttcgtctaccccagcaatcaccgtggagatccagagacagccactttggtgtgaagaaggtaccattcctgcctccatctgcagtaggcaataatgtgggtcagctgtggaggtcatatgatttttgggtctagagaatggcctctcagtgtcccctttgctcccacatgccccaggtagcctgtatggatctatgccctgcatcccattgttagagaatggtgtgaagtgttggggagctttgcaaactttaaagtgccatgaaaatgtaaggatgatgttattttccactcaaaaaggattttaacctataaatcaacagggttatataatattttttctaatatcttaaatattgaaaaagtcatagaggtcatagaggttatgggactggcttgaaaccaattatatgaggttcagtttcttcctttttttcttttctttttttttttttttttttttgagacagagtctcgctctgccaccaggctggaatgcagtggtgcaatctcagctcactgcaacctccgcctccctggttcaagcaattcccctctctcagcctcctgagtagctgggactacaggcacccaccaccatgcctggctaattttttgtattttagtagagacgaggtttcaccatgttgaccaggatggtctcgatctcccgacctcgtgatccacctgccttggcctcccaaagtgctgggattacaggcgtgagcctccggccctaacttcccgattttcagtatttatgtaagtgggtccttcaaatgtatgatatggtgatgggcagccatgaagtcattcaaaatttgtgattgaaaggttctactactgagacttctcattttgaagtgaagccttctcagattatgaaaattattaaaattactattaatgaaataaatgagcctatagatgaaacagtgtttcacattgtatatgcatcagggcagtaggaatatcctgataaaccaaggaaacatcgtgggaagaaagttaacacctacagacagaattgtaaaatgaattttggctcaggttgagttgggtatgcaacctgaaaatagtgggagtcagtgtacaaatccaaagtttgtgagactctattatgtgccatggctctgtgctggggacatggaagtgagtgactctctgcccctgccttgagcagtctggtcacagggacacatttgtaaaccatgaatgttaagaagacagttatttttattatgattctgtcttcgtgtttctactcaggttttgccagccactcagtagtttgtttctttgcctttcctgaattaggtagtggagtgtagggaaaagcacatcatgtgaggaaaccaggattcctggacttttatctcatacctgtttggactagatatataatctcggacaagtcctctaacctttctgagtcttactcttatctgtcaagcaggggcaagaatttcagcctgctcacaacagggggtttgaaatgaggggtttggtgaggaggcaccttagaaagcagtcagtactgtccaagcataaggactgttgtgaccctgttcgttaactcatggggccacctcgtggttctgaaaaatgagccatatatctaggttcctcagtgtctgaaatcagatctctggggaggacactctctaacagtattgaatgataagggcagcatatgaggggctctgtcgacagtgtaagcaggactcttctgtcccctaggctatctccttcctcttgactgtgtctggatgaaggctgataattaaaaagacatattttgggtgtttatagttaatttaaacctgtatcaattggtctttctgacagccctgtgttaacagataacaggctcagaggggtgaaatgactctctgaaggtcacccagcccatcaagagcaaatccagaaccagaaaccaagtaatccacctcctatttagtctaagactagttgacaccaacacatattcatggatggagggtgccgtgggcacagcagagaagaagctgatggcttgatgccatcggctccatttgacagacaaggcaacttaaccctgaagagttaattgacttccccagagtcacattgctaatattatagtggccttcagaagttaataatgaatgagtgagtgagccagtaaagaagatattggaagatattcataaagaaccctgcgggagtttcaggattgatggaattcagtttgtatgtatcaagtcagtatagatactgaatgggtaggcgtctgggaacacaagacacgatatgtaccttcaagtggttttcaggcttgtggaaaaatctaagcttaagactcagatcaaataactaaaataaaaagtagatttaagattgaaaatcaggcagaagcaaagtcctgtagaagttctaaggacagtgaaaggtcatccggttgagagatcagggcaggctctgtggagccagagctgtctgggcaagacccttgtagagaggaggagggcattgcaggtggggatttggcagaggcacccaggctctaggctcagcagacagacccctgggctacttgtgggagaagcaggtgtggaaagcaacagtgagctaaaattctggaaagtttcatgccctcctcttgctggtgtggctcactgcctgtcctatcctggtgggatcttgttgcaggaggacatcgatctcagggaactggaagacgaacactggctctgcgatgctggagcagattgccatgtcagacaggtgagttgagagaaggagtccagtttccagcccagtgagagggaggcttccttagatgaagaagtttaggaattaagctctgtccaaagggagtcatggagcaaaccggacagataaaacacaaaaggcccaagtagcccatttagcaagatcaggcaggactgatgatagagaaagatgatagagttaaagactgcacataccataggtaaaagcttcctgaggcctcaccagaagcagatgctggcaccatgctttttgtacagtctgcagaaccatgagccaaaataaaccttttttttttttataattacctagcctcaagtattcctttatagcaacacaaaacagactaatcaaggagtgaggtgttgctataaagatagttgaaaatgtggaattggctttggaactgggtaagaggcagaggttagaagagtttgaagggctcagaagaagacaggaagccaagggaaagttcagaacttcttagagactggttaagtggttgtgaccaaaatgctgataaaaatatggacggagaaggccaggctaacaggtctcagatggaaataaggaacttgttgggaactgaagcaaaggtcacccttgccactccatagcaaagaacttggccgcattgtgtccgtgccctggggatttatggaaggctgaatttaggattgatggcctagagtacctggtggaagaagtttctaagcagcaagtggtcaagaagtagcatggcttcttctaacagcctatgggaaaagactgtacataccatagaagctccaagaaaggagtaattggcatgggctggaatagccaaggaggccttctagatatggtgagaactgctttgggcctgcaaaaatgggtagaatctggaaaacagatagaggagggcactgtaaataagggtatgtgcttgatacgggtagatggagggagcagtgggaatgggaggtgggagagatggaggcagcaaggagagcctgactggcaagcaagctttgtggtgagcgaattgccccagcttcaggacaccttcccatcacctccaggtacaaactgtgggtggacacctgctctgagatgtttggcggcctggacatctgtgctgtcaaagctgtacatggcaaagatgggaaagactacatttttgaggtaagtctggaccaagcagtaagaggtaactcctaaggcttaagaactatgtgggcagctcagactgcctttaatttggagtctcctgaaccatggaaatgttccagcaagatcagtgggtagctattgtttctaacctgctaggctgacccacgccatgggtaaaagatgttgaatacgggttgatgggatcctagccattcctctgggaagactgtggtgatgttaccattctctgtctcagaaagccacccttgggagtcattctgtccaacctgctcattttacaggtgaggaaactgaggcctaacaccatgagcatgtgcccaagaccacagggtgaatcagtgtctcagctgggcaccagatgcaggagattcttcttagtgtctctctgagccttggagacactactcagcctggtcctctaacacaactttgctgactcccttttacctgttgtaaaggaaagccagtggcagtatgaatccttcacacacattcctacccaatctggctgggagcaggaaaggctccttactaggagttggtggtatttccaggatattggtgtcaggagcccaaagtaggcttcaaattcagaatctatctcatttcctgcatggtctataaccttctaaatggtcacacctctcctcgctaggtgggcctctgttttctcatccataattgagaaagttggactatggagtctgtgaggcatacactttctaaaggaggaaaacattgatctgagccttgaggtacaggaagaatcaggattggtggtaaaaagggagggcaacccagttcaggtacaaagggatgaacctggtcatttagtgagcagagagtgcttggagacagagattctgtgggtgaaaagtaacagagatgaaaagcacatgctcctaatcagagatttaaggggatgcctttcacatctacgtgctcccctgcctgcaaacttttgcgccctgaggctttaccctctccttgctttctacctcttctggctaccttcatccagcaatttttggtctcactgagccctggcacgggtaaagcttggggaaaagacctgaggcaaaggtttgtagaaggaagggacaaagatcctatttctgcaaatgatcacacttccagctgaagagaagaactcctgcttcatctccagtccatctctgctggcttaattcctacccattctgaaagattgtaccaggccatttatgtttccagacccctttcctcacctgggacacatctcccaccaggtcatggactgtagcatgccactgattggggaacatcaggtggaggacaggcaactcatcaccgaactagtcatcagcaagatgaaccagctgctgtccaggactcctgccctgtctcctcagagacccctaacaacccagcagccacaggtaagcagctaggaagagacatagcagagccaagaaccattcccaagcccactcctctagatgttgatggctaaagaatggagtacaggccagatgcccacaggcctaaatgggatctaaggagacatctccctcttccttcccttccctttaccctggagtcctgattatcttctaccaccccttataggggccttctcagcaatctgcaatatcaattatataattaaccagaggagcactggttccctttcctctgaacctgaagtctccagggaaccagagccagtttctcctgggactcaggatgctcccatttttaaactgagaggtatttgaggaagagctgggtcacatcacttactgtctattcactgcttcactgtgttgagcctgctatcttcgtaaataaggaagtctctttctgagaaatgtgctggtctggaaaggggagagtcaggtccctcattctgggagagagtgacaaggcaaaactcaaattagaaatctttctttcctaagagagaagtggccttcttcagttggctgtagtgcatgactcatggccaatcacactcatggcaacagcattccagctgcgggtctagtgggaaatccacactaaagttttgtgaaacatcaggccctgtggcagggaaaggtctttattcccatgcaagaggtatctcatctttcaaaagtatccccaaagtccactaaatgtttatattatgaaatgggaagaacttgggacaatgaatcaaaagctgaaccttaagtctagctcttcctctaaatagctgtgtaagtttgcagggaaatgactagcctttcttggtctcaagtttttttatttattaatgagaattctctcggctatctttccatcaaaatccaactttaaacagggaggtagaatagaatagtgattcagagtgtgggctttgaagtgagaactacccaaatttgaatcctagactctccatttattagcttcgtgaccagcacataaaacagtgtaacaattgataagtcagttccttctctggatctcaagtttccccactgatatctagagaccttttgtgctctgaaaatttctttgagtagaatacttccgtcttcactgatcctgataaatgggaacttctgggctaataaatgtggaccctgactctttctgggtatctgagttgagaatagccctgtatggtgggatgttatatattagctcttatgagtgttttagttactagagaatcacagtagggtaactaggaaaatgaaagttaattgcctgttagagatacaaacccactatttaattactatatttaactagagatgataaaaagatttttatggttaaaaaaatatcaggcctatggtgagattttatgattttgtaaatgtgatggaatcaagatatttgaatcctagttctgccttttagtccacactagattatgagagagaatctgtgaaccaggttactgcttgtccctgctctagcagaagagtgacaagtagtcccttcttccctttaatactgagaaaaacagagaacatctggtagtatcttaaagaatttatgacagggtaagagaacctgacattacccagacagaatgggctgctctgggattctgtgaagggcccttaagtacttataaaagtgtaaactttcatggccttctacaaggaaagtcattctgaactaaagtaaaggccgtgctaagagtcaggagacctgcatttagccctgtccttgccactgcttcaccaggtgaccttgggtaggtttattcccatttctgtgcctcagcatctttgtgtgtaaagttaaaggttgaacacactaagacacttttagcaagacaatccatattatacaaaaatggtatctaaagtataaaagttaagcaaagagataatttatagaacaaaattttctaccccacaaaaagcattagcccttctttggtataagccccttattttataaacattaagtgttgtagcttaaacattttgtaagagaaatctacaatgtgtcagagtcaaggcagaaaacagcaaggaataagctccctaaatatagcatctcttgcagaaattccttgtagcaaagtcagtttgactcaaggataaggttgagcttttctttgctcaaccttacattcatatccaaaggatattgtggaatgcataccatgctgggagtcaggacacacaagggctaatcctcactctgctataacattatgtgaccttgggcaagttacttcccatctctagacctctgtttcctcacctataaaatggagttgaattagatgatgtctagatccctttcaattctaaggccacataatacctggagttagccaaactgcaaagtctgaaagcacaattctccataagaccctcactcctaacatcacctgaaagttcaggaagttcctaaaaccactctcaagtttgacagttctctggaagaactcacagaactcactgaaagctattatactcacagttacagtatattatggggaacggatacagatcaaaactaagccaaaggaagatgtgtagagcagaatttgggagggtttcaaacacaaaacttcgattagttaggactcatgactcattcccctcctggctttgatatgtgacaatatgcatagaggattaacaacgaggaaagctcctctgagcttcagtgttcacagtttttattggggcttcatgatgtaggcatgactggttgatcacctggttgaactcagcctctggcttctccctccttggaggtcagaataataccatgtggcctgaggggcccactgtgagtgacaaagacactcctatcactccagaaactccaagagtgtagtggttacttctgaggagccaaagatgaaggccagaattctcttagggaaaagccaaattctttactatacacatgattaagttaatatagtaaatgtttctcaaatactttcagcccatgtgggcaaggactgtgccttattgatctgcatttccattgactaacatggaaatgcagagtgtgtgcttaaaattagttaatagccttaggacttaaagttgctgtccaaaagatttatattctaaattgaaataatgattgaattcacagaggtcatcaccatttctcagatggtatcttctggtaacctctattagcttccttctgagccttgtgccttcacctcaggccacccagaaggcagaagacacccaatagttggccacacttgtcaaaatgccacaacttgagcttaaagccatgactgtactggtcatattcccacctcccatttcttctagataatagcacattttctttggttaaatttgagcagacatttcagccatcatgagaccaggactatggagctgtcaaactagattacctttgtgtccctgctatcacatccacccacttatctgcacctccacccacatgagtctgctctaaggctcaccctccacttgtgacctagattccatctcctttttgttttcaagtatctgctttcttctccaccatcaatttctctttttccaaaagattattggaaagttgttttagccaccgtctcccttttaccacattttctctcctatcctctctagtcagcatcccgctccaaccatcccactgaaatggcccttgtcaaagtcacctccatgaggccagacgcagtgactcacgcctgtaatcccagcactttaggaggccgaggcaggtagatcacgaggtcaggagttcgagaccagcctggccaatatggtgaaaccccgtctctactaaaaatacaaaaattagctgggcatggtggcaggtgtctgtaatcccagctacttgggaggccgaggcaggagaatcacctgaacccgggaagcagaggttgcagtgagccgagatcgtaccactgcacctgggtgacagagcaggactgtgtctcaaaaagaaaaagtcatctccatgtcactgagtccagtggtcacttttgttcttatcttacagacttttcagtagcatttgacacagctgactactccctcctctaaacactattttctaggcccctgaggcccccccgcccatcgcttggttttcattctacatcattggcttccccttcttggcctcctttgctgattcttccacttctgctgagtgtctaaacatcagtgccccagaacttggtcaacgtacatttgttggtggtcttggccagcctgtatctatctcctgccctgaccaccccttcaaactccagactcacatttctaactcttgcttgacatccttacttgcatatcttaaaggcaccctaaatataacacagccaaagcagaactctagtttttccccttagtcctgtccccccaacattgtttttccctagcaatttatgtaggcccctacctgcctctttcccttgtactatcctaactgttgctcactgtgccctagccacactggtaagggcctttgtattaggctgtgctctctctctgaaatgctctttcttcttagttttgcattttttttgagacagagtcttgctctgtcaccaggctggagtgtggtggtgcatctcagctcactgccaccaccgcctcccgggttcaagcgattcccctgcctcagcttcccgaatagctgggattacaggcacgcgccaccacgcccggctaattttttgtattttagtagagacgggatttcaccatgttggccaagatggtctcgatctcctgacctcatgatccgcccaccttggcctcccaaaatgttgggattacaggcatgagccaccgcgcccagccataactgacttttccttaacagtataactgatacttcctcaactatccaatccaaagctgccacctactcactggctaccacctctcccttctttaattttctgcatagcactcactatcagttgagattattcttgtctatttaattgtctgttctactaaaatgtaaggttctcaagagtacagacttgtttatggctatatctctagggccactgtatctagcacctagtagccatttaaatacatcaagggtgtaccaaggggagacaggtgagagtggtttgcccaggtgcaatcagttggctatagaaaatttttaaaatagcaaaactaagttggcctgctttttattatcaacatatgatagcaattctatacaaatgacattgataaaatactcttcccaccaagcaaaccactcctgccccactccctttgatgtgccattgtaatacatatttgttgagtgagttcaccatttggaagaggcatctttaatagccctatcagcctattggattgatgtcaggatcctttggatgatcttggcagtgtgcaagtggaaaggatgtgaaccgaggaacattacctgcatccaagccaggactttgcatagccagctcagcccttaggtgttgtcactgacttgctcacaggcattgtcaccattcctcacaggcacctcttgctggcctctttcttctgtggctgtggaagctcaggctgaaagagcttctggtctgagtcataagccctaggagctgctcctgcccagaattctagaccaagaccaggacagacctgtggctagccacttgtctacccttctctgtttctccttctctatcgttgtccttagctccaccatgagtgctttcatttatttgattctagaggaacacctaaaatggggacagggagctggggcttggggtgaggatggtgattagagggcacaccttacctctagcctgggatggattaattatagaacgcaaagagcaaagacatggtggtgggcccaagccagctgcagtacacatttcaaaggaatagaggaaggggcataagaagcactggccatgtcaccaagagcagggaggtgagtggtaaagcctgatctggttgatgacagcttggcctcaggcctggacagactgccagcttgcgggctgctgtgagggtcagcagcagcaactgaccctctgtacatggactctgaaatgctttagggagactgttctcgaggtggcagtgacacctggtggtcactcatggccaaagcctccaggctctatacctgcagagtctcttccctgtaccactgccttcccaccacccctcctacacattcactgactttaggggtctcttgtctaggatctgagctgggccttgcatcctagggctctgatgaggtgtgggctgctcctcagactcccaggaaacagggagagaacttcagggggacagagctttcaggccatgccagtaaagatggcatctggtcctctccttcatgtggctaatgtttttttcatttctcattatactggttccactctttttattttcctgtaaaattctccagagccagaaggctgaattgctcatgcaggaatttcagacactgacgggctgaggtgggaactggtctctcttcagtgcccctcatttatgccacagagctggcttcccgtttggctggtgggttagacccatggggaatgattctaagacttattctttggaagcattcatatacatttggtgtccagaatgaaaatgaacctcttctcctaccctgagctgatcagagcacatctgaaatgtttccagtctgagggtcacagtataacaaggacaaactctaactccgatcagaatgtgctcagaggagagaaaccaggaggttgaggcatttggcaaatctatgttatgagtaaaagttaaaggaattgcagttgaatagcagacatctcaatgagtgcattaattaatatctttagctctctgatgccgccatggagtagaactgattccaaaaggcaaatctgttagcagacaggttttgacccagtgtagggagtaaactctctaacactcagaaacggcatgcggctgccacattgttgctgatgttcaagcaggagcaggatgagcagcttgtaaggcacatggtgaaaggggagggctggggactggggctgttggagcaggtaacttataaaatctccttctaagcctgacatgctgagatccagactgtgtgcagccatgggacctggaaaaggctgtgatgagaattcagaattgaaggactgaggctgaataacctctggtgtctggtgggacattctaccagtccttttttgtactggttctctggtatgaagagaaacagaacacatttccagctaggtttttccagccacaaaggctctgaaacaagcttgtctaacctgcagcccaggatggctttgaatgcgtcccaacacaaattcataaacttccttaaaacattatgagatattttgcaatttttttagcttatcagccattgttagtgttagtgtatgtgtggcccaagacagttcttctcccagtgtggcccatgaaagccaaaagattagccacccgtgttctaaaatatgaggtctcctgagtgcaagaagaccaagcctaagaaggggtttcttcactctgagaagtggagtctaaagggctgtccagttagggaggggtctctgatccccggcatgggactaacagggcttcacttgagctcagaagaggtaaatttaggacaaatgaaaggccttcctgcttcccacagcaggaatggctttagcaaatttcttccccagtgagtataagctgagaatgtgaggagatttggggcaggttcagataaagccactagtgactagatcccttaacagactattaagagaaactaactattctgggactgtcttaacttttcagggacatctttaatcatttgaagctgacattctgaccttgagtgacctgcccctcagtgcccccagaagactcagggactgcccccatgggatatttcttgggttctaggttatgggagggccccactccaggagatgagctctgcaagcagagaagcaactccccccaggagggaaggagaagcggctcatccctgggcaccttttagaaccttttggaggaaggaaggtgggcgctggtgactgcaggggcaagcccagaaagatcccaaggtgcctcaaaacatgcggtcccctttgcaccgactaaacctacaacctcctgaccacattctttcccgctgcctcattctccctggggtcctagaccagggagcggggcctgggggagctgatcagaatagttctgtggcgtgtccggcaaggagcttggcctggcctctttcctggggccagaccctgggaccctttcccaatttcctgtctcagatatgctgagcaagcacaggccttcctccttggttggggcagctggtctcaggccaacagctcacaagtgttgagtcactcaatgtctttccttcctcagctttccatcctgctgggacttcaggagctcctttctccagcttgtctgccgaaagccacaggatggcattttaaagttacctttgacaaaaacccacaaaccctcatccatgggcttggtttctgtcacaggccagtgatttcctttccaatcatctcaagagctaatatttaccatttctgcaaggaccttgctggaactaagcaatatacagaaggcatggtataacccagaccagaattccctgcacatgaaactgctatgcatcaggtgacaggaaaccacacaacaatatcttctccactgatgcacgaaattctaacattagacctcccttcctttggattgatatttattttttaaatagtagtaggatgctcacttacattgcctaacactttacagtttacaaagcacactctttagtttaagcctaacaatccttatttaagatgtcttgggctggcaaatgtatctttgtttcacatatcagcaaagagaaggcaactgccttgcccaaggtcacacagctgctaagcaggagagctggatcttctgggccccaattcagggagttctccacaatactgtgcaccatgcccttttggtgctcccacatcagcagaggcgaaggtaagaatggaatgagctgggcatttgtgactctatatctctatgtaaggaaaatccttgcattcctcccttaacaagtggtggacctaccaacctggaggagtcttgagcttcaccagctctctccttcctccctggcttctctgatcactaagcccagtagattcagcgtagcaggataccagcccaattagctttgatggaagcggcacactctccttgccaagctcctgaaagcctatacctgcaagacatctctgcacaggtccaataaccctagggtcttgctgagtttaagactctgtagctggtccaggctggtctggaactctgtagctaagaagggattgtctcagttctcacacaccggaagaactgaaagaaaaaaaaaaaaaaaaaaaaaagcataaacgaattcatggaagcctagagccagaagggcctgtagaagtcatgtgcctgcagctacatgagcccccctaaccaaagtttgtccaagcactgctgaaatacctctcatgccaggaagctcactactacccaagccagcccttgacactattcagatttatatttgactaatttcaatcttctactaagccctaggtgcttccatggttacctcatttataccatttgggaaactgtgactcaggataagtaacttgcccaaagtcacatgtgtaaagttgtcatttcgagacttctaaccatcctatttgctccatgtacccatgtttttctgctagcatcacccttaagaggtggccagaactggttgcagtgctctctcatgaggcttgatcagccaaaagaacagtggtcctatcacttccccttgtcaagacatagacatacctccagctgcatccaatttttggcagcatcattacagactgacaccctttgagcctgtcgtcactctgtaaacccaaggttggttggggtttattatttatttatatatttttttgagacggggtctcactctgttgcctaggctggaatgcagtggcgtgatcctggctcactgcagcatccacctcccaggctcaagctatcctcttgccacagccctctgggtagctgggactataagcacatgccaccatgcccacctaatttttgtattttttgtagagacagcgtttcatcatgttatccaggctggtctcaaactcctgggctcaagtgatccacgcacctcggcctcccacagtgttgggattacaggcgtgagccgcacccagctgggtttttttttttttatgctactataaggtcatttattccccttccgttttgtgtacagctaggcacaagcactgcacttcacattcttacctgtttgaatcaatccaacttcctgaggaaagctctgcctctcagtctggccatgagttcctgctgtgggctggctccaggccagcctttggcagtgacgccagagtggccagacttctgtggaattcggcatcccaggatgctctgggtgactggaaacagatcccatggtagccaagccccacagggaataggcccggagcccctagtagacagcaggcttgtaggtggagccagggtgtctcagcctggcaagggacagtccttgggaattctcctccccgcctcccgtagcccctgagaagtcttccatacacaatctcagtggagccggggccaagagaagcttcctaggcgccatcaagggtggccaaagcatattcccaggctgcagcccaaaggactgcctccgggagctcttcctctcaagcctggaaaagggcacttctgggcttagttcatccgtgggtgtcttacatgtatattcctatggctgaggaaagacaaggccagcctacatggtgtgatcacccctgtgagctcatcctgtgtctggagttctaccattaaagcttaatctatgggatttaaaacgttttcttggaatcatagtttcactggattggaaggaaccttagcattcatccagtcaatctcatgtttaaaaaaggaatattatctatgatgtctttgtcaggtcattcactacccactatgtgaacacatacgtctacctcccaaaacagcctatctcactatttttacaaaagaaagttctacttgtaggtgaaagtctgcccagagcttttgtgcccactggccctggttctgctcttatgccacatagtcttctgtaaccctctctgggaataccaattctctgggaggagaacatcgtaagctgctcttggccaacatttgagatgatgcattgggacccttcagtggtactgggcatgaggccctgggggagagaccagcgagagccagtccggtagcttcacaaactgggactttttctgtccttcacctaagtatctgtctctgaccatgagaggctgtggtgttgaaggcatgggccagactagagaatgaacagtagaggatcaggcctggactgagcagctgtttatgacataaaggagggagaaggctagaaagggcaagcccagccatgctgaagcaaccaggagtgctgatgatacctcatacggtactgtgaggtacagggagatagtgcacaatagtgcatccatgttacttggaacacagtaagcacgccataaatgtcagctctaggtgatttagagaagttaagagacacaactagaaaaaaggtttaggaggttaataggtagccccagagaagatagattggaaagaaaaagatgaaagaattaggagactattctagcaagaaatgataaaggcctgaccaaagttagtccagggaagatggtgactcagataccaggagggaaaagtggaggagtcctgaaggctgatgggatggagtggtttccagctggcttcccgggtatgggtattgcagtgtcaggctcagactgtgccttatggatcccaagaaggtccccagaggaagggaaaggaagtagtgttctcactgtgacttgtgggggttgagggttatggtagaatgggcactctgatgtggtggcactgaggacatttcaaaggcccccctcccagctgctctcccaaatcctctcagtagaacagttccgagtaatgaggttaaaagactgtgatactgagaaggtaacacttcctggcagtggagctgaaaacaggccataatgggcagggagataaatggccagaatgggatgtccaagggaaatggggagcaggaggagaagcagctttatgtgggagtagggctgaggggcacatcaagaggggagaggagcactgatggtgaagcgagtgctcactgaggacatgcttgtttttagccaccgccttgccttggaagcccctcattgacatcaccgttggcacacttggcagactttaggcttcacagaacatttcccttgtgctgaactcagactccaaacgttcactgcctctaatacaagcattagacaaactaagtcgcacaggtctttaatcccgtcagggcataatcagaatcacggctgggagagggagcatgggatcggagccatgctgttgggttaagtgtagtcatgctgtttgggagggaaaagcagcctggccttgagcgctgttacaaacattaatgtcttactctttccctctaaggtaaggagggttctgagaaacaaatgacgacccctttctttaagtccctccctttgggagttcccagccgagtccaaagagtggatctgatctcctgagtcaggcctagaactgatcccactccggagttaactccagatgagaagtgagccaagcctaggctagtcactaggtccggctgggcgcaggcatgcgcacacatacactcctcccctgccctcctgctcacctgcccctagagccacctatagtccaaccctgtctctggggtttggcgttggccctccctttcctttagacagccaggcctgtacgtagaagtgggagctggacttggacaggcatcagaaaaccagaaaagaaaccaggtggtgctagaggacgcaaagcttctagaaagaatgagtctaaatggaggaaaatgaaaaaggggttgaagaggtctcaggcattgttaccagagtggctccaagccccagactgcccacactgccccaacaacacccgaggctgagggtcccctttaaagtgtttctggagcagcagaagcctatggccagatcccactggatcccaccaggtcccaccggattccactgcggccttgccatggagccacgtggtttctctttggaattcagtggcttggagttttgtttttatctcttacatttttgtcttccagagcggaacacttaaggatccggactcaagcaagaccccacctcagcggccaccccctcaaggttgtttacagtatattctcgactgtaatggcattgcagtagggccaaaacaagtccaagcttcttaaaatgattggtggttaatttttcaaagcagaaattttaagccaaaaacaaacgaaaggaaagcggggaggggaaaacagaccctcccactggtgccgttgctgcgttctttcaatgctgactggactgtgtttttcctatgcagtgtcagctcctctgtctggttgtttacctgttcctgttcgtgcttgtaatgctcacttatgttttctctgtataacttgtgattccagggctgtttgtcaacagtatacaaaagaattgtgcctctcccaagtccagtgtgactttatcttctgggtggtttgatagtgtttttaaaagtaatatataatgtggggtgaaatgggagtaggggggtggacaggggagaaacgaaaaccacaaaaagaaaacccaactcctctcctccccccaagctcagttaaatcccccacctccaactttccctccaccagtgtgcttgggatcttcaatgaactgtgcttttcgctttctttctgcatgactattgtaactagatagaacattaagagattttcaagatcaaacttccatagcttcatccactgaatttgaaggcatccacctttttctccatttgctaaaatttggtgcagtttgagtttatgtgaataggctggctgtgcctgtagagctcttgtgtttttagtgatgacatgaaatacaaagaacaagctatttccaggaatgtgttctgtattttacatcccagtgtaccctttattttattattaactaattaactatgagatttttaaaaaatggggccgctgatgtgcaatatcaaagtgaacttgtgagtattttgtgtgtgttgatctcagttgtttcttcattgttgctgtttctggatccagccatgtgtgcgcttgtgtggacctgaggctgctttctgttcccaaagcttgacctgtgtacagagataattccttggcaatgttggacatagaatgcagggagctactgaaggtctgtcagggatttgtccattctgctcttggcctctcctgaggcctcataatgggagaccaaatcaaaaatgtcccatgtcacttgagtgggtacactgcctacagaaccttgaggttgactcctgcttcagttctcagctgtttaccacagccctccagggtccaaagattgaggagctttctctttcctgggaggaactgtctcagatttagcttgtgtgtgttttggacagaggctccacagcggtggctcttgaggaatcctcaccagtttgttctcttccctctgacaagcagcacctgagcagatgctgaggcagttcattaaaccaggcctcagcttcagtgcctcatcttgccatctcccggccaggctgggaacgggcaccaagcagccgcctctaacaaacaccatggtccgtggaagttcatgccagcagcttgcctttgagaagaaatgctgctggctctatttttacattcccttccacctctatactgtcatgtcaccgttctgaactcccagatctgagaaggaactagtgttggtggtatgtaacaagagttacgtatccaggggcttgtgccttggtttctcctttgattgctggtaaattctgaggccacagagaaatgcattgagtgtgaatgttgtcatctgtaatccctccctcagctgataatggtagttgatctgttgtaaatatatacatatatgcatatttgcacttccagatgggttgcataagaatcaggtccttaaatacctcccaatctgatgaaacgatagaataaagtaacatttcccagaatggaggaatacattattttatcgtatatttttgtccaagcgatgagctgacggtggtattgcttctctgcatgttatcagtgtgtacatctggtgcttttcatgtgtcatttgtgagccacaaatgcaaagttgccatttgaattcagtcaggctacagggtggtgtcagtcaaggtctttcaggtgggggagaaattggttagggctcccactgccaaatgcaagcagatagcataacctgactgttatgtgccctcaggcagcatgcttagggacaactctgtggcctgggggacatctgtgtcacagtataggattgccattcaggtgttttgtacctatttctttcctgacgttgtcccctttttttgtactgatccaactgggagaacctcagccaatgctggaagtatgattgaagtacctctcttttgtgactcttgtacagcttaatgtgcaataaaggaaaagttatatctgtcttcagtgttaagttgtaacgtttctggctatccaagtatctgcacaaatgggaaagcactcaggtttctggtgcaagagactgagctattaacctgtattaccttacaggagaatgctaatgcaaatgatgccaaactttggaagtggcaaaagctggttaatgtgaaataatctgctaatctatcatcttcactagttatttgatttgaatttggagcttcttaaacctgcagaattccattgatttatgtatgtgtttatttctctgtaactaactctggtattatttggttagatgataa

SEQ ID NO: 15495 - DNA, 5588 bp, Human; identical to SEQ ID NO: 11828

SEQ ID NO: 15496 - DNA, 51631 bp, Human
  misc_feature (1)...(51631): n = A,T,C or G
gcagccatacctaaaaccgttgtgaagaaagctacacaaagggtgatctgaaataacctttgcgtggcttcttaagcctgcagacatgaggtagtcactgaaatagtgacacatgtctgcacttacgagattccaatgacctttcatttgcctggggactgtccagagaaatctcttgatacttaacccagctctctccctactgcccaatcctccgtccagacttttgtatggacaccccagtcccttctctctctatacctccctccccaagccaccttctaaggcaaggtgatactcacctaatcagtctccttagggaggaactttgacattctttttcttctcagagtttctgtgctattgaaaccctgtagttagagttctgaggctcaataagctttacatgtattcatcagacctaaataaaaacaaagattgtcttctagttatataggtcaaaattacagatacacacacacagctttatacatacatacgtgtaattttaaactgatgaattttaatgatcgtttggcaaaacatgccattatgcaaaggggcttttactcgtataactttatatgtttatttagacattttaattaatacgtctatatggagtacaggtgtattatcagtgtaattaaactctgatatgatattagaaagctacagtacactgcagacaatttacaagggtcatctctggcctggtgttctcaaaggcctccggatttgccgttcatcaggtaagatgaacagctttgcgttgctaccttcaaaaattctttttttttttttttgagagagagtctcgctctgtctccaggctggagtgcaacctccacctcccgggttcaagcgattctcctgcctcagcctcccgagtagctaggaccacaggcgcgcccagctaatttctgtatttttagtagagacagggtttcatcatgttggccgggatggtctcaatctcctgacctcgttatccgcccgcctcggcctcccaaagtgctgggattacaggggtgaaccaccgcgcctggcctcagaaaccatctccatctcccttaccacctgaggggtcactggtgaccacacccatggaatcggctggatctcctgcggggctggacaatttgaccctcctcctccccaggccccgccccttcccccctgagtctttcggcctgggtggaggacgcggctgcttcaagtccttggctctgatccaggccacagattccaggttagtgagcaagtttattttctggccagctaccgctgtccccacttgtctggagagtttgacccgctctgcaggtcgggttgggggtggttcacgggtgaaagaagaatgagggagacttctgcattttcaagtgaactcaagtttgggaagggagcacagaagaggcacctttgcagctgggaataggccgtgtaaagagagttaaacctctattccagcagctgtggaaactgctttagggaatcactgcaaaccattttgtcaggcgtggattcagagtcagcatcccttccccccttcccccgttctccccttccccnnnnnnnnnnnnnnnnnnnntaatcaggccaagagcataatataatactagttataactgcacagcttgcctccgttgtgtaaaaaaatcactgagacttaactgtgtccaacttttaaaatgtgaatagaagtacaactaaagctatattttggttaatatttgcattgcatgcttttccattatttagtttcaacatatgtgaaatataaatataaattataaaaactttaagagagcccatccccccttcccccttcccctcccccatctccagcctggccgctccaggaagtgagcaccgtttatcccccaccccaggcggcccgactcctcccagaaggagttgggagatgagccttccgcaaactcctgacctgtgggtccgtccgttcaacggccaaaggctggcggaggagggatcccctgcctttctcggaacggaacggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagaggtatgtctaccgttctgttgactggctcttattgtcacttctggcagaggtgacagggcagtgaaagagataaggtcctttccctttcggaactcattatatctttatttctttttctttctcactgcaaatgaccccactgaggttagagacattttaatcagtcagtcaatagagacagaaatgtgtggttaggagcatagatgccgcagccagactgcatgtgttcaaatcctgactctgacagacactggctgtgtgcccgaagactgctaacttaacttctttgagctttagtttcttccatctataagatggacggagtaatatgtatatcttagagttttggtgaggattaagtgagacagatttaaacacgtaggaggctgcctgacacaaattatggtcattattactggcaaactccatgcctagctttaaaaaaatgcacaatcaaaacaatttttaaattataggtttctgaaatgcagggggtagaaattcttttgaagtggaaattaaattttttgttttgaaactgattatgttccaattcaaatatttattgagtcctgttagataatcaattgcagataataggttaaatataaccctacacaaagataaaaaaaaatgttattcctaaagtgcaagaactcatgcccaactcacttataaatgcaactgccacctattttattccactttcactagggctcccagctggtggacgggcctgctctgtcattgctaactctgaacccccagcctacaccagccccagtatcccctgctgagtcactgatttttattctgaaagccattttgatatcgatgcaagcttccattctaaaagatgcttcatatctaaatagcaggccattctctgtccccctccctcttctagctgttttgcaccctaaattgtatccacctgggaaagaaggtcctttatctaaggcagtgcttctgaagccttaatgtgcgtaagaatcacctagagaactttaatattaaagtgcagattctgaatcattccaggaaagactgagattctgcataaagaactccaagtgcttgcagtgttgctagttagcagacctttttcaggcgtctggttctgatttaattggtcccacctggttgtgaatttgggctctttcttctgctaatttgatgcactgggctctgggactgcaggctcttctcgtctgcactcctcacagtcagaatgccttctctcagcccgtccacactgctctggagacttggcctcagttggaaactggcagcctcccatatctcccttgggctgcacttagctgcagtgggcagtcagggcttgctggtgtgtgggcaagggtcacctatgctaactgtatgctcccctccttcacaatttctttcccaagcctcagctttgacaagagacctcaactcttacaaatcttttttctgctcaagaatttttctctgtctaaagagagtattagatgaatatctacagcgcatattagataggaaaaagacatataatgaactagaaatagaatgaagccacatatgtaatgttacatactcaagtagcctcattaaaaataagcgggtgaaattaattttaatacatttcatttaacccaatacatgcaaaatacaattaggacatgtgatcaacataaaaaaattaataagatcctttaacttttttaaactaaatcttcaaaatccaatgtgtattttgtacctaaagcaacccatttctgagtagccacacttcaaatgctcaagagccatatctggctacatgtttgacaacacagttccattatgcttagaagatcagaaaccaagcttttaatttttcttgtatttttttgtttctgtcagtttattgagttctatctagtaagttacaaattgtaagcatacagttctgtgaattttcacagttgcagtcagctgtgtaaccaccaccatgatcatgatacataaagggcatttccctttatgtattcacccttcaaatttccttatgccctttgcagttcaaacttttctcccactcctgggccctggcttccactgatgtactttcaaataccatagctttctcttttctaggatttcacataaatagcatcatacaataacttaaatttgatgtttgggttctttcactttgcatgcttttgagatttatcttgttgtatatattaacagtttaattgtttggtaatatgccactgtatggatacaccacagtttgttcatttaccagttagtgatgtcatggattcttttcagtttgggactattactacattgcatttatgaggcagtagttctccttcaagagaattgggtacgctaaatacagttttgcctgaaatgaaagtgtgcatgtgtttgttggggaggatgaattggaattggactttcaattaaaatataataccaacacaattattatatttatttatttatttatttatttatttatttatttattttgagacggagtctcgctctgtcgcccaggctggagtgcagtggcacgatctcgactcactgcaagctccaccttccgggttcacaccattctcctgcctcagcctcccgagtagctgggactacaggcatccgccactacacccagctaaatttttgtatttttagtagagacagggtttcaccgtgttagccaggatggtctcgatctcctgaccttgtgatccgcctgcctcagcctcccaaagtgctgggattacaggcttgggccaccgcgcccggccaacacaattattttttaacagtaacactttgataagatagcacatttatttctatactctagtgccaacatcaaggccaactataagctcagcagtaagctataattttcaatccattataaagttaattgatcatttcctgtgttagctgcagtgctaaggtctggggcacctggaagataaatagagcctctattgcctctagagcctctattgcctctattatcaaaggcaatagagccttatagtgcagtgtgctaagtgagatgatgtgggtatggtaggagatattaacaaaggaaataatagtgcagttcccacaggtgtgattaatttggttaaacagactctcagatgataggtaaatacgtctgtaacaccaattagtactaccagttagatgcacagagttcattaatttgttaattatattttgcaccctttatggagatgaggaatataagggagtaataagagctccagctctgcagcctgcgtatctgcattcaacaccggccccgccacttgaaggatctactaaataccagtttatacaactatgagatgagatttaagggacattcataatgttgttatgtggaattattgagttattatgtacaaaataattaaattcttgctgaatacctaatgggctttctgtagatatttgctgtgagcatcgctgctgctaagcatggcaaagctgaagagccaggctagtacttgcagaagcaccacagaacactagatggcagcgccaagaacctgttttcggctcgctagatcccccagcagggccgctaggaggcttatgcttacgtcccatgactttttcttacccttatctgagacactttctcaggccctttcttctaaggggagtgttgttattgggaggcagtttgatatactttttaaatccaccaggtcctcaagatgggggtaaattggtacaatttacagggccttgtgttgaggcccacacggactatgttttttacatcagtgtacatttacttttgctgggaaaccagccaaagacaagttagagaattctgcctgctccctacgcactgtggcctgttcagaacagcgaggtcacgcctggaaccagggccagagcttcacataggcagtgttagctggctcttctttggtggcccaaacacaactccaggtagacaagcagaacaaatggctcccagtgaaaataactcagtgctggaaacagttttaaaaattttctaaagcgtattctcagtgtgattttaaacaatggtaacgtaatttatcaacaactcttccaagaaaaatagacaataaaggtcatatttctcaatgaagatataaggtctcaactgccttaccggccacctctccttacatatggacccccttaggatcctgctgaagtttaagacaggccctggcaaaatcccatcatcaaataggatctctctcatttccatacttcgaaagcacttggtccatgcctgactttcacagcctttaccactgactgtctttggtcaaagttatgagtttgaggacgaagctttgaactagcaccctggaaaggttaggttatgccaattctacaacttacaaggtgcatgattgtgtaaagtcacttaatgtctcttcttattaaagaatggagaatactcttatttatgcagagttgtccatgagggataaagaaagcaagagaatgtgatttctaaatcacagctggttacagaatcatgagttgtaaaaatattacctccccaggctgggcgcagtggctcacgcttgtaatcccagcactttgggaggccaaggcaggcagatcacttgaggtcaggagttcgagaccagcctggccaacatggtaaaaccctgtctctactaaaaatacaaaaattagctgggcatggtggcgctcacctgtaatcccagctactcaggaggctgaggcacgagaatcgcttgaacccgggaggcagaggttgcagtgagccgagatagtgccactgccctccagcctgggcgatagagcaagactcagtttcaacaacaacaaaaaaattaccaccccttattgtggccattgctgtttctttggtttttttctgagaaggcgagcatgtggtgagagggctctatgtggagcagggccgttaagaagtggaagtgttttcacagtcttagagatcagataccagagagtgatgcaaaggtgatggcagagaggtgaaagagctcatggaaaggtcacagatgatcactgtagaggatgagggggttctgaccccctcattcatccaaagttgaggacctatatgtcaggctctatgctagctgccgaagatacaaccatgaacaaaaagtctcagatctcatggagcttacatttcactgcgaggattcaaacaagtaaagatctgtattaagtggtgtaagaagtaaaatagaccgggtgcagtggctcatgcctgtagtcccaaccctttgggaggccgaggtgggcggatcacgaggtcaggagatcaagaccatcctggctaacacagtgaaacctcatctctactaaaaatacaaaaaaaattagccggacatagtggcaggcacctgtaatcccagctactcgggaggctgaggcaggagaatggcttgaacccaggaggcggagcttgcagtgagtcgagatcacgccactgcactccagcctgggcgacagagcaagaccccctaatgaggtgaatatgtggagagtgattgtatggtggctgtgctctaaatagactagtcagagcagacccttctgataagggaataggtaggaagctagtaagtcatgcagatagcagagtaaagggtcatctttacatcacgaacgacaaatgcaaaaatcctgaggcagcagtgtgttttaggtgcttttaacattgaggatatgttttgggtgagaaaaggtcacacagtctccaggtgcggtggctcatgcctgtaattccagcactgtgagaggccaaggcaggagcatcacttaaggtcaggagttcaagaccaccctggctaacatggtgaaactccatctctactaaaaatacaaaaactagccaggtgttgtggcacgtgcctgtaatcccagctactcaggaggctgaggcaggagaattgcttgaacctgggaggcggagattgcagtgagctgagattgtaccactgcattccagcctgggtgacagagtgagtctccatctcaaaaaagaaaaaaaagaaaagatcacacagacagtgactcacacaggcccctcctttccagggcctcagtttgtctctattcaataggagcaagaggaaattatcactgctttaatatggggagaaattggtgccttgtatgagccgggataaagaacgtattggatatgagaatgagaagcccttgttaccccaggtgtctgacctctttatccaggactgggcagtcagtattcccttattctccctcctttcttaccctgatcctttttttgtttgttcatctacctaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggtgagaccccaggatggaatgggagacagagaaacagggtctttggcaggttttaacgttttatcatgctctgatctaatctctttgtagtctttatttacctagagaatgaacctggaaactgcctccctgattaagaatagattctttatcatttacttgctattccagattgagtagatagagctgcttggggtaaaaggggtacttggttgattgagtgtggagatatgttggcagggtaggtaaaggaatttatttactcatgtatttattttgagaaggcgtctcgctctgtcgcccaggttggagtgcagtggtgcgatcccggctcactgcaacctccgcctcccgggttcaagcagttctcgtgcctggcctcccaagtagctaggactgtaggtgtgcaccaccatgcccagctaattgtgtgtgtgtgtgcgtgtgtgtgtgtgtttagtagagatggggttttgccatgttgcccaggctgatctcaaactcctgagctcaggcaatccacccgcctcagcctcccaaagtgctgggattacaggcgtgagccacaggtgctttgtggtcaggcaccttcccaagggggatggagaatcagcctatccctgttggttttcatcccatgtatatatataaaagatttgttggccctctcaagttttcatcctaggttaggacaggcttcttttgaggttagcagaatctctgtcccattcattctatgtctgggtactgagtcaactgaaggcttgatcctgcttgacctgatttgttttcttcaaggagaagtttcaggagtctctaaagaagctgaagaacgaggagcaggaagctgagaagctaacagcttttatcagagagaagaaaacatcctggaaggcaagggagactttttctgaagatgtcctggggcaggaatcatggcaggtcataggagctgagggcaaaggagtccttgtcctgtctgtcctctgatgccatgactagaagagcttccctttgcctggtcctccactatattccttccaaacagggggaggagaggaggtaaatagcaaatatatcaaaactgaacctaggagacaatcacatagcagaggaaccatggctaggggtcgccccaattcataattctgggtcttgctctacagtttcagtctctttggcttttcccttgcattcagagtacaaatgcaagggaaaatgcaggtaaggcttgtgaagaagcccagatctgagacaggttagtcacaggccagtaatttccacctcagtactcgaaattggaagaggaggctgatgcagaggtgagggaggcttcctggaatctaaacgtcacccaggaatcacagttgatgtctagatggcctagataaagcagcccggggccaatggtctgggcagagctgaagggagaaaagaaggaaagaacaggctacaaaggctttctcctgcagcatttaccctccctctccctgggaggcttggcccaggaaagcagtcctgagcccaacttccccgcttttaatagaggagaccctcagtgtgaccgactagcagcctctttttcttccctgttcctgaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggtaaggcttgtgaaggagcccagatctgagagtcaaggaaaagagaaactaactttccttcctttctgggacatcagactaccatcgttgcagggacaagagaaaacattcctttggcgctatagtgcctatcccctattaaactgtttagaggtatggagtaaagcgtaagataattcagagtacaaatgcaagggaaagtcccatttttatttataaagggttgtctaaaagtttatttgatgctgtggagaagttctgttgtatccagtgatgttgttctttctttctcagtcttggcactatttacatttctggctggataattctttgctgcgtggggttctcctgtacattgtaggatgcttagcagcgtctctggcctctgctcactagatgtcagcagcaccaccccagatgtgacaaccccaaatttcttcagacattgccacgatagccccagggtgaacacagtgctctcccagttgagaaccactgttcattaggcacctctcgtctctgatgctgtgttgggaatttgccaagtgcttcttacccagcttagtcacaggcacacttacgccaagctaaattcttagagatgatgtattaccagcccttctttgttttcactctcttctctagagcagaatcatttaacatactgtagcaattgatatttgaactggttttgggggtctgggctctggtctgtatgtgtgtaggtcgcagattacaaggtatcaagcctagagagatttgatggagggacttgaactgaggttgaaattctagcagctattttctgcatagaatgaatagtgtggttgtgaatttgaggcatgatgtagcttgtgatattctgtaaccttcagagtgtaagatattctttatattttgtttgtcttcgtgctttcctcttgctccttctttcttggtggaataattgtttatttacatattcttgggtcttagtattagagccatgggtagctactttctgcctgttacagctttttctcattcactgcttcctgctttgcatcttcattttattcttcttgcctttttgtcctcatcattgatattattaccctgatactttctccttcaccttttgttctggctcctcaacagtcctcaaactgtaaatattttttaaatgcaaatgaatcgtcaattcatattgctagtttagacacttccacattcattagtatgactgccccacggacatttaaacttgagtagtcttttctaaaaataaactttctggaattttcccatcacagacattgttctttctcttttccatatctgtgtgaattgttgcccattaagattttatagccaaggccgagcgcggtggctcacgcctgtaatcccagcactttgggaggccgaggcaggcggatcatgaggtcaggagattgagaccatcctggctaacacggtgaaaccccgtctctactaaaaacacaaaaaaattagccgggtgcggtggtgggcgcctgtagtcccagctactcgggaggctgaggcaggagaatggcgcgaacccaggaggcggagcgtgcagtgagccgagatcgcaccactgcactccagcctgggcgacagagcaagactccatctcaaaaaaaaaaaatattttatagccaagataaaagcttcaaaatatggacataaagccaacataagagaagtagccacatgaaatagcacatcgatttgatcatttcagttcctcagtacagccacaatgtaagattgatacaatcctggatatttactgcaaattgacacacacagcacctctaccacattctatgttcaagccagtttgagttgtgcctctatgaaatgccaccataaacagccctaatacagagaaaatagttaatcctgtattatgtggaccaaacttaagcttttcttcggggtcattgagatgtatggagcacaagataaaaagaccaaatagaaaggaataggccaattccacagaaatgagactagcagtggcagtgataaaggtgaacaactggtgaccaaatgaaattgaggatgtgaagtggactgacttgggcaaagataggatgccagggtgaatatatggtagttatttcctattttgtttaaatttggtgacttaagtggttgctagtgtgattcagtaggatggaagggagacaagagttgccgaactaagttcttttaaacatcttgcatttgaggtacctgtgacatatctgctggtgtatatattaatcaaaatcataaggaaagggggctgagcagaagtacagatttgagaatcatcaacatgtgtacattaaaatgaaggaaatggatgaagtcagcaaaggtagggtagaaggttagagaaggtgaagtttgagaaacaaccatatataaagtccatgagcctgtatcttcagcaaccagaacaggatgtaagctactcaaggatagaaattatgacttcatcatctgaggttctctaggccaggcacaatgcctgacaaataatacatgctatacatacataacattacacacacatatgcacacacacaatgttgtgaaaatcaagacactgatgagtcaattgagttattttttgatgtcttcacatgggttcttagggacagtctgccctgagttttttctctactttgtggcctccacattaggattatctttatttgtatcatatcatggggtaggggacatggaaggagaaatgtggataagggcatgacctgttactccttgacttaacctgtctttttccttcctaggatgtgagtgatgtcacagaaaggtatgtgtaaggagaacatgaggtagttcccctggactgacaaatgattcctttacccatgatcagtgggaaagggaagaagaatcagagtggggaagattcaagagagtagtcttgaatcgcgcatcacatggagttttggcatccccaaataaaggggatgaactggcctctctggtaggaaaatgtgggtgatgggaggtcagtaggtggggacagtactgttatttagaataaagagttgcagtattgcgccactgcactccagcctgggagacaaagggagactctgcctcaaacaaacaaaaaaaaatgaataaagagttgcagtatcagtgactccccaagtaccctgttagtgtacttttccataaacctctgtgcctgctttcatccctgattcttaagtttatagttacctcaaaatacacaggaattttctttgcccataaatttttttttttttttttttttgagacagagtttcactctgtcgcccaggctggagtgcagtggtgtgatctcggctcactgcaccttcctgcccgtgaattttatcagagtgacattcccatctgcattatttctcaaggtctaagaatttggtcttggcacatctgccttaagtttttctttctcccaggccttgctccctagtagattttcttttgtctcaattccagtaaaaacgtaaacccgagctctggaggataataatttagcccgggaatcaaacatgttctctatcacatactccagagtctcatccaacaaggtgacatgtcaaactgcttgcacacttggttcctccatgctcctcacagacacacgaaatgggaaccctatcgtcccttctgaaatctgtactctccgtttggaggtgaggacatcttttctccagctagtggcataacattcccagagacggcaaatcctaaaatgctgttttgaaggttttctgagaaatcccagggcctaagcccacagactcttctgaagaaaccccttcacttgatactttcaaagccccagcaataggcccctggtgttctgcctgtcaacccagacatcttcaacccctctgattttaaatattttatatctttttttagaggtagcaaaagatttccaagccattattttactgaactgcataacatctctaggacacagaaaaaggaaaattatagtattttctaaaaacaacaacagaaaaacaaaatgagactttaagaagttaaatcttggacaggcgcagtgactcacacctgtaatcccagcactttgggaggctgaggagggcagatcacgaggtcaggagatcaaaaccatcctggctaacatgatgaaaccctatctctactaaatatacaagaaaattagccaggcgtggtggcacgcgcctgtagtcccagctactcagaaggctgaggcaggagaatcgcttgaacctgggaggtggaggttgcagtgagccgagatcgtgccactgcactccagcctgggtgacagagcgagactccttctcaaaaaaaaaagttaaatcttacacaagtttatgtagatggtgagatgatagtttctagtctagctcttctggctccagtgccagggctgtttgcagaatgatgctaagtgtattcagaaaggaggattggaattcatcagtaggcttgggaggtaagggagatgggtggtggaggaacccacagtcagcagtgtgggaactcagaagtcctgtcctttctaggagtgagttctggaccctgaggaagccagaagctctccctacaaagctgagaagtatgttccgagccccagatctgaaaaggatgctgcgagtgtgtagaggtaaggagattcaggggaaagagtttggatgtgaaattactgtcgtgggaagaaataaacgggatagaggctatagtcggtatttgagcatagtggcaaagagggaggtcccagagggagggacatagtgtgctgaagaagatgcgttttgtatttaaggggagatgaaatggccaggtgacatcctcacaggattcctcaccattcccctcaatgtagtaaggagagagataccagacatgagacagttggtcctattcaacattattgactcttttcatcattacagagctgacagatgtccaaagctactggggtaagtagaagccatggcctctttgggctggcacattctgatctcctttcacatgccctccccagacatagccacacagatcctaggtgttgatgcctcccccatccccgccatatagttccagttcctccaaccacttcctgtgtttcctcttctcagcataacgagacccatgtccccgttctcatctgctgatgttgtaccttttcctacagttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctaggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcattttacctgtttcattttacttttttaatgtggatactagaaaccttaaaattacatatgtggcttacattgtatttctattggacaactctggagtagatcctataatgaaatttctgtccctaagtgagccctagtgtaaaagcctatggactcaggatacagaggaggtttcaaggcacatatgtttatctctacagaacctgcaccttcccagctgccctgaggcatttttatggaaggtaatgacagagaaaagaagatctcaacatatctagaagtgtagaaatttggaagatcatagaaagggctcatgaccagagaatgattctgcagactctggcccctgccgttagtcctcagtctgttgggcacttgaagctccttcatggtttgatgaaacactgatttgttatcaaggctcagcttgggtgtctatggtgagataaagtagtgcagattatagtaaaagctcactactggtttgttctaaggcaccgttttataatatttgggagatcatatctgtggaagcccagaggctggatgcaaactccttatcctggtctgcgtttcaattggaagagatataaaaggagatagggccagctgactgggacctatggggctggtggaagttcaggaaagagaaagatctgctggagtagttatccccttcccacttattttcccatataataagtaagttctaggcaaaagagttagcccagctctcttctgtaaactcattttacaagtaaatttactttccaagtgaatttactttataagtaatttttcttttttgtcaccagagttctagggatgtggtatagttatcctaatatttcccaaaatgtgagtgcttgctagagccgatatttaagtttgatgctaacttaaaaagaagattttggaagggagagggactttcttaacagctttattgtgatatttactttataagtaaattcacttggagaacccaaagtattgtccagtgaatgactttagataatagtgaaagccaaactaagtacttgctggaattctataggtaagacctggggaaggttgctcaatctgagacttggggacaattattagggtaagttcacagctctgaccttttcttgaggggttatgggggcttgacagaggccttctgttcttgacatgtgatagagtaggctcaactactatgaaaaagaactctaaaaatacataatggatcaaatactaaagaaatgtacttcttgttaatgtaaaacaatcggtcatgagtgtatgtaactggtggtgagtggcactgttccatgtgggattcatgcaccaagcttgctttcatcttgtggcacttgctgtaccccagaatggtaacagcatgaagctggcagaaaggtgaagaaaacttaggggagaaaacgtgctttttaaatccttagttcatagatgggattcgtaatatctgctcattttctattaatgagaatagccatagggctaaacctaactgtaaagattttttaaatgtctagctgtatgcaatcatgtacaatcaaatttcaaggaaaagaaaactcagattttggtggaaactgcctggaaccctaagtaatcctttttcccattatagaggactcaggatctcagcttttttctggaactatgttaattccattctatagcctaaagtttgtaaaagagaactgtattgtcactaaagttctagacatgtggtatagttatcctaatatttcccaacaagcgagtgcttgttagagctggcatgtaagtttgattctaacttaaaaataatctttttaggggaagaggactgtcttaacattattattgtgatataactgacatataatacatttcataaagtatataacttgatacattttgacttgtgaaactcatcaccatcaaggcaataaatcagatggggttcttttttgtatatatagcacttagagctatacatttccttctgtggctttaaatgcatctcacaaattttgatatattctccattctattcaagattctattttcccttttgatttcttctttgaccattgaattatttaaaattatattttttcccaaatctatgaggatgttcatatatctttttgttattggtttataatttaattttaaatggtccagatacagactttatatgacttgaatcctttttaattgtattgagacttgttttacggtaaaggatatgatctatattggtaaatgtttcatttgcacttgaaagaaatgtgtattctgtggtcctggggtacagtgttcaattaacatcatgttagttgatattattcaaatcttctgtatctttactgcttttctatgagagaggggtgttgaaatttacaactatatttgtggatttgcctatttctcctgcaattctatgagattttgctttctgatttttgaagctcttttgtaaggagcatacacatttaggaatgttacatcctgttgatgaactgacacccctttctcattatggaatgaccctctatctctactaatatctttttctccaaattctactttgttaggtattaatttagccactccagctttcttgttttttgttttttttttgttgttgttgttgtttgtttgtttgagatggagtctcgttctgtcatccaggctggagtgcagtggcgtgatcttggctaactgcaacctctgcctcctgggtttaagtgattctcctgcctcagcctcccgagtagctgggattacaggcacctgccaccacgtccggctaatattgtatttttagtagagacggggtttcaccatgttggtcatattggtctcgaactcctgacctcaggtgatccacccgcctcggcctcccaaagtgctggaattaccggcgtgagccaccgtgcccagcccagctttcttttgattattgttttcataacatatcttttcatttttttttttttttttgagacggagtctcgctctgtctcccaggctggagtgacatggcgcagttgagtgacgtggcgcgatctcggctcactgcaagctccgcctcccgggttcacgccattctcctgcctcagcctcccgagtagctgggactacaggcgcccaccaccacgcccggctaatttttttgtatttttagtagaggcggggtttcaccgtgttggccaggatggtctcgatctcctgacctcgtgatccacccgcctcgcctcccaaagtgctgggattacaggcgtgagccaccgcgcccggcctcatctttttacttttaaactatttgtgtcttcgtactccagcctgggcaacaagagcgaaacgctgtctcaaaaaaaagaaaagtatttaagtggcatgtagttgctctaggtaaataatatagttatcttcatttttcccaacaagttactgcttgagttggcattttaacttagttttaattaaaatttaaatattttgctactttatattttgtcagaaatgatcttgattccatgggactctcagttttttaaacatttgctgtataactgctttgtgcatacagtctagcccttgccttcacagagactcagtcagttaggggataaaacaaaggcatattctgtgcaaggtttatttcaaccatcttttagaagataaatttggggttttagggttccaagatttgaaacattacatttgattggtgaagggctagttctcaggttctcatggggttgatgtttgaggccgagaataaccttttttttttttttccttgagatggagtctccctcctgttgcccatgctggagtgcagtggcacgatctcggctcactgcaacctctgcctcctgggttcaagcgattctcctgcctcagcctcccaagtacctgggatgaaaggtgcctgccaccttcggctaatttttgtatttttagtagagacagtgtttcactatgttggccaggctgatctcaaactctcagcctcaggtgatccacctgcctcggcctctcaaagtgctgggattacaggcataagccaccacgcccagcttttttttttttttttaaataaatgcaagcttaggtacaggctcttgtcaaataaggaatcaacaaagaaataaaatattgattcatttttatccatcttgaaaacatactagtatttgaagggcaaataattaaaatatgaaaaacaattagggaaatggagtctattttggaatctttgaaaaagcagaggagaaatgttaggagagaaatcaagatagaactgcaagtttaaggcattattgcctatctcagctaagcattggcctttatttcaagagatcgaaggaaaccctcacatttttgaactgaaagtcaacacatacatttgaatcacacacatttccacctgaccactgagggtacttgtatgaagacagcaactgagttttctatatcgcttcctctgtgtcaatcacgtttctatacattatatatatggactcaatctttttttttttttttttttcaggcagagttttgctcttgttgcccaggctggagtgcaatggcacgatctcggctcactgcaaccttcgcctcccaggttcaagcgattcaccagcctcggcctcccgagtagctgggattacaggcatcaaccaccacgcctgtctaatttttgtgttttttagtagagacggggtttcgccatgttagccaggctggtctcaaactcctgacctcaggtgatccacctgcctcagcctcccaaagtgctggaattacaggcttgggccaccgcgcatggcctgggctcaatctttatagtggtcctatgaaaataggtactgtcattatcctttttttaaaaaaaatgagaaaatggaggtacagtgagatgaaagaatttgctcaaagttggacacatatgaagtggcagaattgacctacaaaacagggcagcaaaattcagaggcaacatttttattcatttctgtctgttagaaatctgaaaaggtcagtgtgtgagtcaaatcctactttgatacctatttttgtaaatgtactttattggaatatcaccatgcttatttatgtatcatctgtgactgctttcaagttacaacagcagtgttgactggttgcaacagagactgcttgacctgcaaatcctaaaatatttactgtttgaccagcctgaccaacatggtgaaaccccatctctactaaaaatacaaaaattagccgggcatggtggcccgcgcctgtaattccagctacttgggaggctgaggcaggggaatcgcttgaacccaggaggcaaaggttgcagtgagccgagatcacaccactgcactccagcctgggcaacagagtgagactccatctcaaaaacaaacaaacaaacaaacaaatagtcaaagtaatgtataatgctcaaaatgtaatcttaggcctaatgaaggaatagactcctatattactcataaatgatataagtaatattaaacttggggtctagcttacgtgaccaagataatgatgaaaactttaagttgaaagcttatgttgaaaaacaaaataaaatcatttcatatgcaaattttaacaccacagtcaggaatgtcaatggatatacagggtaaaagaagagagaaaattaacctagatgataaactgtatacattgcatattgattaatctactataaaacaatggcacaagtacatgattgttttgattcttgaaccttgattgattatagatagcatcaaatgtagtatactctgggggagaaaagattggactatgagaggaaattctattttaagctttgtacaattataagacataaggaggacacaaatctcattaagggcagatttgggagagaaacagtgacaaagctaaaaccgtgacttatttgggaaacatcagtgtagcatgataaggacaagccattttatatcactcacatgagcaggcttcatgtcattgggtaaaaattcacagtaatcctggagaaaatgaagaatgtgtgaatcaatgtattgtgtgcaaacggtgatatgagggtagcctgagtcatatgaactccctgggaaaaacgaccagctttgtgtatgtagcaagtggacttggtactcctattacctaaaaagagcctctgcaagtacttattgacaaaagttgacatctactctgcatatggaatagctgtccctgcctctcaggcattttgtaccataaaggccaacagattgccattatcaatattttgatgtcctcaaaacagtttcagtggtaaccacatgatcgtacaagaatacgcctccttcattctgttgccagagaagtacaggaatcttcagttctttgtcttatttggagaaagcattctgctttccagtcttttccagtggagagtaggcctttgttatgggggatgctctgaacatatttcagaatggttcttttactctctctctgccagaaaagaaaggatctttttcttggctttccactatgggaactcactttggtttttggaggtaaattccaagcaagtggggcgggggcggggccctaagtctaggtgctaggagtttctctctctcaagctagtccataatcagcctccggcaatttgtcagaactactatttaagtgttcctaccagtatatgactcaggcaactcctgttttaaattttttttttttttttttttttttttttttttttgagactgagcctcactctgttgcccaggctagagtagtggtgtgatctcggctcactgcaacctctgtctcctgggttcaagcgatcctcctgtctcagcctcccgagtaactgggattacaggcgcccaccaccatgcccggctaatttttgtatttttgtagacagggtttcgacatgttggccaggctggtctcaaactcctgacctcaagtgatccacccgcctcagcctcccaaagtgctgggattacaggtgtgagccactgcgcccgtcctgactcatgcaacttctgcttcaggtaagcagatttaggctgtttattctgtgtttacctgtctctacattttggggtggcagtttttttcctgtgactttatctgatgagacttaggaaagtcattgatttttagttggtttagcttttttttccttttctttcttctttttttttttttttttttttttttgttgagactgagtctcactctgtcgcccaggctggagtgcggcggcgggatctcggctcactgcaacctccgcctcctgggttctatggattctcctgcctcaacctcccaagtaactgggactacaggcgcgcgccactgcacccagctaagcttttgtatttttagtagagacggggtttcaccatgttggccagattggtctcgaattccttggccagactggactctaactcctgaactcgtgatccgcccgcctcagcctcctatagtgctgggattacaggagtgagccactgcgtccagccaagctttttttctcttgtgagggttgcagtaatgagtctcaagctctttacatgttggaactaaaactggaagttcctggtattcttttctacttctgtagtaattctctttctttggaaatcactttctctgtctgcccagctaagtctccatttttcaggttatgggtgcacattatgccttacggtgggaggggcagaagtactgtcatgggctccctctgcaatggtgtttgtcagtgttctcttcctccagattagcttcttctttccattaagtgagaggctctggtagacctcaggaatgaagcaaagcctgttctgctcctacagtgagatagcaaggcaaaagctgctgtgcagtgttcacatagtatatatggtagagtccctgtgtcttttggcatttttgttgccaactatcctttctctgcttctaaactagtaaagcagttactgttctggtcccagctttactagaatatttttagtccccatatcttggtgacctttggtgggggaagcgattccaagttagatacaggcagtttctctatgtgtagacacacattcctatctccagcactcatccatagcaactggaggaaattcacttctatccattttcctttaacccctgcatcccagtcacccctttattgcaatgcccgaggctctggatcactccaggctgctgcactctcttaaattccaggtaactcttttgggatatttatgactttcattttcagggctttgggacctgggagaatggtgtgagtaaagccagagggatctgagaagacagatactttactcctgcactggtgtctctagataatttcccagctggctctctctgcctgtgtaaacaagccttgaggatatgacccttgccaactcttgttagccactcctgtttacatagagctctaagtacatgcccatggaaatagctgcatattcttgaatgactaaacttgctcatttttctgtccaggtcatttctgctatccagaagcacagctcagctgagagtgaggcaccagaagaatgcctaagagtttccaaaagtgatgatttttctaccattaatatattatatgttggtagtatgaaaggaaaataaatcttggagcttcaaaatcactaggccaaatagaaaagtcaagctgggaactgcttagggcaaacctgcctcccattctattcaaagtcatccctctgctcactgacataaatgcctatctgattgactcctttgaaaaggctaatcagaaactcaaaagaatgcaacaggttgtccttcaccaacctgtgacctggaagccccctccctgcttgagttgtcctgccttttcagatggaaccaatgtacatctcacatttattgattgatgtctcatgtctctctaaaatgtatacaaccaagttgtgctctgatcaccttgggcacatgttgtcaggacctcctgaggctgtcagggacacatgtcttcagccttggtaaaataaactttctatattatctgagatctgtctcagattttcggggttcagactagacagttgttaagaaaataacaaaaagacattaaagacatagcatagttgcatgtccattgaactcagagaaatgagttttttaaaaaggaaaaaactcagctgggcgcggtggctcacacctgtaatcccaggacttcgggaggccgaggcaagcagatcatgaggtcaagagtttgagaccatcctggccaacatggtgaaaccctgcctctattaaaaatacaaaaaattagccgggcgttgtggcaggtgcctgtagtcccggctacttgggaggctgaggaaggagaatggcgtgaacccggcaggcggacgttgtagtgagccgagatcacgccactgcactccagcctgggcgacagagcgagactacctctcaaaaaaaaaaaaaagaaaaaaagaaaaattagctggacgtggtggcgcatgctgttaatcccagctactcaggaggctgaggtaggagaatcgaacctgggaggcggaggttgcggtgaccaagatcatgccattgcactccagtctgggcgacaagaacgaaactccatctcaaaaaaacaaacaaacaaataaaaaaaaccggaaaaaactcaagtgaacaaaatgaatgattgaaaattgaatgtcatccacacagaactgatgggctaaggtaatatacacatctcaacacatgctttaacaaatctgtctgatgctttactattgtaaatgaaagagtatctgagaaaactctcaatcaatttaggaagtttattttgccaaggttaaggatgcacccatgacagcctcaggaggtcctgacaacatgtacccaaggtggtcagggcacagcttggttttatacatttgagggagatgtgagacatcaatcaatatatgtccgcaaaggcgggacagctgagtccggaagggggtttccaggtcataggtagataaaagacaaacaggttgcattaagcaatagggcaaaggaagtaaccagatattcatttatctcacctgagcaaaggggtgactttgagttctgtctggagctttttttttttttttttttttatcttagtagctgtctttttttggaatagaatgggagccaggtttgccctaaccagttctcaacctgacttttccctttggcttagtgatttttgggtcccgagattttcttcccttttacactatctaaatgtattagttaccaatattgaaataaggaaaagaaatctgaaagtattaggttggtacaaaagtaattgcggttcttgctattataatacttttatttattttgtttatttttatttttttattttttgagacagagtcttgctctgacacccaggctggagtgcagtggtgcgatctcggctcactgcaacctccgcctcccgggttcaagcaattctcctgcctcagcctcctgagtagctgggattacaggcgcatgccaccatgcccggctaattttttttttttttttttgtaattttagtagagacgggggtttcaccatgttagccagggtggtctcgaactcctgaccttgtgatccgcccgcctcaacctcccaaagttctgggattacaggtgtgagccaccacagttggctttataatacttttaatttcaaaagccgcaattacttttgcactaacctgatagtaattgactcccttaaaagtagtcaaagcatattcccaaggtattggatgtggatacatttttgtgggaaagttgttaaacttccaacaagtttataattgtccttgatcaccatgcatgagtcagatggagagggcaaaaatgaaaattgtaccttgtcaggtggtttccaaaggtggcaccttttattatgtaatgtgctctacaggaggtagactaggattgttttgatgcatacagcacagaaaatgaatctatcaacttatattcctcatgaaaatggagcatgctgtttgtggaggcacaatgtggggtcatcctgtgaccaaacgagtggcaactcttgttcaagtttcctcctcgttcggtttgatttcaaggttacctcagtttcaaagcagccctttctgtccagggcacaaaactcctgatttactacttacaactagtggttctcagcctcagattcgcgtaaaaattacctggaagacttttcatttttaaataatgttactgatatatatgttatatgcaataatatgcacccatttactgtgcacagtttgatgagttttgaaaaagttttaccccttttaaagatttagagcatttccaacactcccaaaagttccccaggtcctttgtagccaacttttctcagcaccatccacctctccgccacccatcctccatctcctagcgggtgacatggtactttggtaggtagcacacaagtggatcgttggagctgaaggataattcaaattggtaaactgattcgagggaccatgtgcaaccatgaaagtggtaggagaaggggagttgggtgtttagctggcctgggaggcagggaaggttaaaacagggcttttcaaacacagcactattgatgttttggaatggatcattctttgctgtgggaactgtcccatacattgtagaatgcttagcggcatctgtgacctgtacccactaagatgccagtagcattcccctagttaacaaccaaatatctcttcagacattgccaaatgtgccatctagtgcaaatcctccattctgccctcgagaatcactggattaagagcattaccttctgtccagaggctctaaaggactacacagctcatttcacctagacgctccttccccttttctcttcctgacagccccaaaaatttcactttcatttctcaggcagttcctcctcaggagggagggacttcttcacacagaggaacctcatttgttgaatgaatcctgaccacacccaccctggcttttcttcacctcttcaaccaggagccgagatttctgttgctctgaaggtgtgtggggaggtttgtggggggtagagggtatgagactccaggagaaaagttctcagtgaagttaggggaatttgatttatggccccaagtctcccctgctctgtcgggagcaaaggctagcttgcaggcttcctgctttgagtgcacactgatagcagcctagagtctggggagggacagccttgaaagcagtgttaaagaggcagaaggccgcctttgttttctggggtgtctttttttcctccaggctgaatctatttccattcccttcctattgtataattttgattttctaccttgcaaaggaaacaattctctctctctctttctctctctcaaagagatgaacagaagatctcttattttccacctcctactccctcctcaaaagagaagttggtgaaaggaggtctctgttttccaagtgtgtgcagggcttagctcctagtatgtggcgtcagatagaatggagccatgggagcacggccaggggttgaagtgggttcttttgctgccctcctggcaaccactaaggggctttctgtggccatcctcacgtattcttagtccttggcctccctgacaatagcaggttgagtgatgtgactgctgcacaccgctctgttccctctgttcctatgtctttctgcaggtcgtctcagggctctccttgcacatccctgaacatacctgtttacttttacttcagtaacccatgtgctaccagcgtcttcacctgtctcagaacttgctcctcatcattcttcctcttagacacaccttggcattgatttgtaacctcaatttgttattgcttttctttgctcacaattacttaacagaagttgttcattgtgggctcagaaggagcccacggatttaatcttcttgttaagaatttgatatagagtatgtcctatcttaagctcacttgtgagcaatttgcaccttgattgatatgttacagatattctgacacatgccattctggcctctgctctcacccttcagagttcactgtaactgccatcctgtgtctctgccttactcctgggtagaatccatgtctgcctacatactgactgtctcccagaggcgtctagtcaggcacaagacccaacatatgggataaaattgattataaagcaggctgctaatgtaaaaacgtgcaattagcatccatttaacattcaataaatatgaaatatacgtggaagcctacatccaaatagaaagtgatcatagaccatatcgatgaatgttagagtacacaagaagatgactaatactatggagtaacatcttcaagaagttacattagggtaatgactctgtaaagacctcatgaaggccttgcaactttaaatagtttttatgaaagttttaaatagttttcattgtaagaacacatttgagtagaatcttaaggatgcgaggaaattaaaggctttaatggtttttcccacgggcttaaaaggagaacagtgtggaagattaagatgggagtgtgcctggagaggcataaaaggtgagttcttaccaggcgcggtggttcacgcttgtaatcccagcacttagggaggacaaggcaggaagatcaccagagatcaggagttcaagaccagcctggccaatgtggtgaaactgtgtctctactaaaaaaatgcaaaaattagccgggtgtggtggcggatgcctgtagtcccagctactcgggaggctgaggcaggagaatcagttgaacccaggaggtggaggttgcagtgagccaagatctcgccattgtactccagcctgggggaaaagagcaagactctgtctcaaaaaaaaaaaaaaatatggtgagctctgaggattgaggcagtgggaaggcatgtgtgatgtggacctaactggaccattatgaagtctggcctcgctctgggtggcatgggtttgaacaggagagtgacatgattgacatctgctttaaggtgatcactctgtctactgatgtaagaacagagatgagagcagagtgaagaaggacagtgatgggtgggcacagtagctcacacctgtaatcccagcactgtgggaggccaaggcgggtggatcacctgaggtggatcatgagtttgagaccagcctggccaacatggtgaaactctctctactaaaaatacaaaaattagctgggcgttgtggcaggcacctgtaatcccagctactcgggaggctgaggcaagagaagcgcttgaacccagcaagcagaggttgcagtgagccgagatcatgccaccacactccaacctgggtaacaagagcaaaactccgtctcaaaaaaaaaggaagggcaatgatagtatcagcaagactagtggaagaacaatttcctgaattcaggtggtttctaccagagtggtggcagttgaggtggttggaaactaatttgaaaaaaaactctttcagcatattctcacgaagtaacagacagaaaaagacattagggattgcttaatgaaaatgattctatgttaaaaaatagctttttggagatatattgaccagaacactacagctcttggggagagagtcattaatgtggtatagattgggccctggactctaaggagtagctgaagcaagaactcagtgcacagaggaatggggaggagatgctacaatgtttctgagctctcagggtctctggatgtcaaaacaggctctactttccttattggcagtttctgaccaagaatccagaagaagtgtctaggatattgtctagaaacttcaaaagacatcctcccctaaaagtcactcgtagagacactctaattttactatctacctgcagagagacttaaagtttgcattatcatatccagatgttaggagtccagatgttaggagaagactcaaatgaagggtataatcacctggcagctatggtaaccaggtaacctgggagttctgtcaggccaatggcactcatgttcccttctctacctccctgactgctgctgggcttgagccacactgggaagtggtggggtcatttctcacacgtgggaccgtggttactctgcacttttctcattcttttgccattatggtggcagcagctttggcatcaacatgcatcctcactgtgaacatgaagtcacagcccgtggcagaatgcatgttctactacttcctctcctggagccccccggtatttctaactattggttggatactgattggaataaaagataacaaagaaccccacatctgtggttggctcatggctttagccataaacaggggtgaatattatcatatcatataaactccttgtcttactagtcatcagatcctggtctgaccaatggtcattgtagccaggggctaccagtatatctcttttgtatgatttttagtatctgtaccattggctggatgacactcgccagtcaactttcagctttttttcctccttaaggtcttttgatggatggttagaggagtagacaggtctcgaggcctaggtttatctccatacagcttttattgtaccccatccttttgccaagcgtgggaaagattcctaagttgtcacacatcacagatctttctttcactatcaaacctgttcaattatattagtttcctagcactgttgtaaccaattatcacaaactagatgacttaaaacaacaggaatttgtatcacagctcaggagcccagaagtccaaaaccaagatggcggcaaagttgatttttttttttttcagaaggctctatgtgaaaatcggttctattcctctctcctagcttctggtggtttctagcaaacctcggcattctttggcttatatctgtgctattcccatctctgcctctactgtcacatggctttctttcccgtgtgtctgtatgtcttctcctcttataaaaacacaggtcaaggccgggtgcagtggctcacacctgtaatcccagcactttgggaggccgagacaggtggatcacctgaggtcaggagttcaagaccagcatggccaacatggtgaaaccccgtctctactaaaaatctaaaaattagttgggcgtggtggcatacacctgtaatcccagctactcaggagactgaggcaggagaatcgcttgaacctgggaggcgggggttgcagtgagctgagattgtaccattgcattccagcctgggcgacagagcgaaactccatctcaaaaaaaaacaaaaactacaggtcattgaatttagggcctgtctttatccagtatgacctcatcttaacttgattacacctgcaaagatgtgattttcaaataagttcacattcacataagtgaacaatttttgtggagggtataaatctatctactagaacaagtatcaaaatgttactgcctactgagagccaccctttttccctttgcctcacagtttcttgtctaaactgacctcaggttctgagaattggcattgtatcatcatgccactactctgtggtacaccctctggctgaccacaagcaataattgcaggtttgttttgccatttgcactcatgcagcttaactccacagggggaatacaggacaggagatatagcatgcagacagggccgcttcaggtgagctctccgtgaggattcttttgttttgttttgttttttgagacggagtctcgctctgtcgcccgggctggagtgcagtggtgcgatctcggctcactggaagctctgcctcccgggttcacgccattctcctgccttagcctcccgagtagctgggactacaggcgcccgccgccacccctggctaatttttgtatttttagtagagatggggtttcaccttgttagccaggatggtcttgatctccttacctcgtgatccgcctgcctcggcctcccaaagtgctgagattacaggggtgagccaccgcgcccggcctcagtgaggattcttacggtggtacaagaccatgtgaccatgtggatgcgtgtgaaactaacgtagcttaggtaaatcttacatcaacggattgattcccttgtaaagaccatgaacatagcttccagggccctacagagaatattttgttacaagagtctcaatcctcttacggaaaatgaggtctgtgcttaccaaaaagaataaaaataaaataatataccaggggatggtgatggcgatgtgttttttataggaagaaaggacttaagcctaatgataacctttttttcccccacatgtctagtctgacttccaatcttatttcctttaccttaccctacttcccaccctcatctgcttctctctgttaacttgtcctgcatcctcccatccctgcccccacctcctattcattggaaagagactgtcacttttacttcatttaggaagtgtcacatatccaggttcctctaggctcatgtgaggccaaggcctagggctttttgcatatcagccacacatttaaaaactttcgaacatgttatgatgctatgtcctccatgaacggggcattcacttccatgattccttctgcctaaaatatttgttttctttctcattctgtattcctttctcattattcagctttcattaaactcttacttatccaagcaagatatcttggatagttctctatttagcacattatttggtcttctaaaaacctatacctctctatgatggtgttttttacacctaccattttacattttatgaatgattatataattagcttctatcttcttaggtgactgtttactttattctggctaataccatctgttcattactcaactttggattttaatccatttcctgaattttaatcacggaagataatatgtcttcagtgagaatttccaaaataaacacatgaataattggcattcaattagtggatgtggatttaacacagacagaacttcatcgctcctaaatgtggtctccctttatgtattgggacatctctctcatggccaacagccatctccttggtatttctattcctcgatgatctgacattggtatgaatctgtgatctgtgtgtaattcagctggttacacccctcccccaacgaatacacacctttgggttcctatcaacctctgtaacatccttcaggccaagaagaaatcctaccatctacaaacacaagacccccccagaaattcccaacttatgtggtttcctccatttctacactctcataaccctggatcccaatctacttctttcaggctttacctcggcttttctttgtttaaataagtggagtagcatggagacctctgaaagagaactctgaggttattatgttcactccaattctaccatcgaattgggtgatctttgtaaatcatttaattttatttattcatctgaagaaagggagtactcttatttctcaagaattttggaaggaggaacaaacaggccaaagtgatttttaaattgtaactggtaatgaaatctccatattgtggtcattgctgtttctgtcggtatctctggaaagtctgtgagggcatgggaggattttgtgtgggtagatgtgttaggaggcgagcacttcttcactggaaaccacatctggggttctaaagttcagctattgaagaatttccaaataatggaaggaagataatgaaacaatgataaagttttagtcatctatggagagacagggaagttttttttatatgtttatcaaacattgtgcttctctgtgttctaaacactgaggctatagcagtaaaaagacaaaagtgcctaatctacatgtagattatgttttagaaagaagaggtggacatttaaaaatagataatgataataaaagaaagatggcaaatgtacactgaatgatgagtttgtggttgtgctgtacttaagtttgtcttagcagcccttctgatgaagggacatgtaaggagaaagttgaaaaaagtataaacgaaagtcatgcaaatagcaacaggatggtaattctaggctgagtaatgaacaagtgcaaaagccttgaggcattaacagctcgcccagaccactttcagccatttttggtttctcttcctcatcttctttgttctttgatattgcagtctcggccagtctttgatgtctgtgcaattagaatgctttttatttgtaccattcttataccatcccctttcaatcttctcagccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggtagggccctagatggagggagatggggcagaagatggtagttggtggaaaatctcaccttttcatccttttttttttttttttttttttgagacagagtctcactctgtcgcccaggctggagtgcagtggcgtgctctcggctcactgcaacctctgccctctgagttcaagtaattttcctgcctcagcctcccaagtagctcggattacaggcgcctgccaccgcgcctggctaattttttttttttttttgtatttttagtagagacgggatttcaccatcttggccaggctggtcttgaactcctaatcttgtgatccacccacctcggcctcccaaagtgctgggattacaggtgtgagccaccatgcccggccttttctttcttttttttttttttttttgggagcaataaagctttttaatcacctgggtgcaggcggactgagtctgaaaaaggagtcagcccttttcatccttctttaccccttgtggaaccataattctgagtcccgtgatcttctccatgtacatctttcacactgtgctcagcttccaatgcctggggtacactcttgtgtattcctttcatttacataacagatgatcctagagtacagtctcttagccaagaatgagaaatttttgtcttgttttttcctttttcattgtataagtgataaattccttcccaaagttagctctcttgcttctctaagcaggataattgctaaggaacattgtggattgaatgaggaaagagcattgataagaggaaaggactttctgcagggtaaatacttactctaaggaaagacagaatcaggctactccttttgaggggtattgattttcatcacaatgaatgaacaatacattcatctcctcaaaattttccccatgtcatagattctaatcaccagcttcacagtttctgtaaattgcttttttctgggatcaacttgattttttccctgtttgtcctctatccagatactaagaaagcttatagcttgactgtagtgtgattcccttctcataggagaaactccaggcagtcctcaagaggctgaagaaggaagaggaggaagctgagaagctggaagctgacatcagagaagagaaaacttcctggaaggcaagaggagattctgaaggatttctgagacaggaatcttgacaggaccttaatccaaggaggcctcgtcctttttattccttgacattgcatgagtcctgaaaccatttgattagttctcttctctgtcctgtccctgttgggggtggaggctagaaagtggacatgttacaattacacatacatacctggaactgagcacaaagatagactctatgatgaggaaggctagcaaatactgtgttccattgctcttttccaacagggctctactacttctggtggaagacactacataaaggactatggttttcctcaagattcaaattaggagtgtggtaaggcaggcagtcatgaatatccaggaaagctatctagaagctaagccttatgttttatattttgtctcagggttggcctagataagacagtttgaggtcattgttttggtaggtactgaaaggaaaatagtaggaaaaaatagcttccctccaagtacctctattgcttctactcccttgctgatttgaactccctgaaaaaaaaaatcgatatatagataatacaaatatatatatacagataatataaatacacacacacacacacacacacacacacacacacacacatatatatatatatatatttccctactggctcctaatcccttgcacaataggccttagcctgacaaacttactacaactctctcttgtccatccttgcagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggtaagaaggttcgctcaatctgagattctgggaacacagttccctcctgtgtccttgcgttctcatcctggtggtgacactaaggggtttctttggccttgcagtgccgccttgtcgtccattctagatgtcatggacatgaatgacatttttattaatttatgaagtaagggaatacattttaccttgcagaaaagatccattatatctagttatagtctctaggcccctattatatgtgatctagtgtcaagcattcatcagacttctctttactctggttagtcacaggtaaacacatgcattttcaggtttaagagcatacacatttaagaaatgtgttctatttaagtttaaaatatgcttatttgttatgcaaatgttccctgttaatttttttttttttttttgagacggagtctcgctctgtctcccaggctggagtgcagtggtgcgatctcggctcactgcaagctccgcctcccaggttcacgccattctcctgcccagcatcccgagtagctgggactacaggcacccaccaccacgtctggctaattttttttgtatttttagtaaacatggggtttcaccgtgctagccagtatggtattaatctcctgacctcgtggtccgcctgcctcggccttccaaaatgctgggattacaggcctgacccaccgcacccagccccctgttacttttttttaaacataaagtgatagaatattgagccttttggggagaaagatggacaaatatatagacagacagtgctctcctttctttgctgaatttccaaatattccctttttaagatttggaacgaagcaggagagtaactgattttcatttgttgaattgtttgctttgtctctggtgcttatatcccagctttttttaaattcctttttccttttgtcttctttttttgtttaaatttaagattactctggaacagaggttcctaaacgtattttacactcattagtatggctataataaaaaaagatggacaataccaagtgtttgggaagatgtgaagaaattgaaaccttcttgaattgctagtagagatgtaaaatagtaaagctacttaggaaaaactgcttggcagttgctcagaaatgtaaagagagttctcatgtggcctagccattccattcctacctatatacctagaagaactgaatacatatatttgtgcataaacttatatatgaaagttcacagcagtattgttcataaataaaacaactcgtatctccttaaactgatgattggataagcaaaatgtgttatatccaaacaatgtaatattgtttagctgtgaaaaataatgaattaataatacatgctatgacatggatgcaccttgaaaacattataattgaaagaaggcaaacacaagttcttttttgtatgattccatttatatgaaagtctgtaagtagcaaatccgtaatatagaaactagattagtggttgccagagctctggggaagaataggaagtaattgctaattagtgtacaatttctatttgtagtgatgaaaatgatctggatttactgtgcaatgacggttgcactacatcgtgaatattttaaagcctgttaaattgtgcactgtaaagggcaaatcttatggtatttgaactacatctcagtaaaaacaaaaacaaaaaggttccgtaggcccttttttatggttcttccttaagctcttcacaaccctttgaatcgccaccttcacaaaagaacactgtgtttatgtcatttgtccaggcatttgtcctatttcagtcagtcttagttgctatttggtcacttggaatttaaaaaaatattggtagatcaaaaattataaatgctgtgggattaacatttcacttctagatgttagcttcaaagaatggcaaatggaaaacttaggaacttattcttttatctgagtagggactttggctattcctctccaatatgttaagatataatctgttggcggggcgcggtggctcacgcctgtaatcccagcactttgggaggccgaggtgggtggatcacgaggtcaggagatcgagatcatcctggctaacacagtgaaaccccgtctctactaaaaatacaaaaaattagccgggcattttataatatacaaaaaattagctggtgatggcggctgcctgtagtcccagctactcaggaggctgaggcaggagaatggtgtgaacccaggaggcggagcttgcagtgagccaagatggcgccactgcactccagcctgggcgacagagcgagactcagtctaaaaaaaaaagatatgtgctgttgtatttgtggtatgtctcctccacaatcccatctcctgagagtccctgtaacagctttctttctatatggattctcatgatggcgatcgggatggatggtgttatcatatatccattgtttgtttgctagagggactgatactcatttcgtaagagctgcattcaacacttactgccaaagaacgatctagacagaaagacgctcaacttgaaaactgatgcaaaaattagatgagattttaggttgtttcccttataaaggagatactttgatttttaatgctttgctgtaatagttttattatatttggccatttttatttttgaaaggatggaatggtaggtagctaaatgagggaaagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctggtaataacacctggaattactcttgcaagaaagactagcatgtctatttccatccttgtacttgtttagacctgagaaaatcagcactatcaagaatgaatgagttaattatatgtaaatcagcgtatccaatccttacatccctaccagccacacagtgattattttaagttggacatctgacccaatcctgaatgcttgtgggtgacaaaattgtactgtcattgcagtgaagggaagttctcctttttagcagaaaataatatcagtgaagataattcaaataaagagattcaagttgctatcaactaaaatctgagaatacagtcaaaatatagggaagaaatgagaattaataggcacagagaggccagaattgtgacagaggtttgagcttccagagccatctgtgactaaagtaatacctctctggccacaacccttactttcttcccagttaaggcaattttagttgttgaacaacaaaactatgctaatacagagagcaaaaccatttatttggttgtacaccagctggtgtcatgaaagagttaaagccaaatatattggtacatcttgctcaaaacaaattaacccacagtggtgatgatgggggaatgcagatgactaacagaagttaaggatggactggcttgataaaatgttttagtgtctgggacagggactgagtgaatattgataccagtttgacaatacggcataagaaaggaaacaatatggctggagaacagcttatgttttagatattcttagttactggtgccgttttttcttctttgtggaatgtagtattgtacctgtacagaatgaagtctagctgctttttttcacagtccaatgagatgcagacagacttggaaaagaagggagtttatttttgcaactggttacagggagaaggtcagagtaactatcagaccaactcagagttacaaagttttttttttctggtgcttatatacattttaagctctatgccttcacgtgggagtgcacctacatgcaggagtgtttcaatctatatctatctttaactagggtctggggtctagaaagctttctctagagtcttggaaagtttcttaatcttaaatgggccctggtacaagttgtatgtctaagaatgcttttattattcgatcagactttaaggtatgagaaaacccaggcagggtctttaaagggtttgttttcacatttcagccctggtactcactcaggcaccagcttttccagttctttaatgtttaacttacgcattcatcaaaattatagtaaagggttaagggaaactgattgttctggttgctaatggaaacctgacctgccacagtattatagaaacatgattacagacaaaagacaatgattagatataaaggttgacaaaaaacagcacctatgtgtgagctaaaattaagattggaggccaggcgcggtggctcacacctgtaatcccagcactttgggagaccgaagagggcggatcatgaggtcaggagatcaagaccatcttggctaacacagtgaaaccccgtctctactaaaaatattaaaaattagccgggcatggtggcacgtacctgtagtcccaggtacttgggaggctgaggcagaagaatcgcttgaaccggggaggtggaggttgcagcgagccaagttcgcaccactgcactccagcctgggtgacagagtgagactctatttcaaaaaaaaaaaaaaaaaaaaaaaaaaaagattggaagaggttgcctataggcggtggatagaacaggacttttctgactgtacataagactatgtcatctgtaaaaagagagagatttactattttctttccaatagagaagcttttttaaaaattagtttttattggtacttaataagtatacatatttatagggtacatagattttggcacaggtatacaatgcataataattacatcagtacatcagagtaaatgatgtatccatcacctcaagcatttatcatttgtttgtgttgccaacattcagattatactattttaattattttaaatgcataataaattattgttgactatagtcacactgttgtggtatcaaatactaaatcttattcattctatctaactgccaacatagagccttttatttgttttctgtgactaactgccctgactagaacctccaataccatgttaaatagaagtagtgagagcaaacatccttgtcttttctgatcttcgggaaaaagcattcagtttttcaccacaaagtatgatgttagctgtaggtttttcatagatgtgttttatcaggctgagggacctctcttctattccaagtttgttaccattcctgttttgttttgttttttttatgaaagtgtgctgaattttgctgaatgctttttttcatgtctattgagatcatcatgtggttttcatcctttattttattaatatggtatattacatcaattgatttttttttatgttgaaccaaccttgcatttctgggataaattctacttggccatcaggtataatctttttgctggattgccagatttgattttcttgtatttttgttgaagaattttgtatttatatttataagagatattggtctatggttttcttttcttgtgatgtctttggttcttttatcagggtcctttatcagggtaggatgagcctcatgtaatcaattaggaagtgttccctgctcttctttatttttgaaataacttatgaagttttgatattatttctttttaaacctttagcagaattagccagtgaagccatctgggtgaggccttttctctgtaggaagtctttgaattccaacttaatctcttaacatgttttaggcctattcatattttctatgcgttctttaatgtgtattgatagtttctgtatttctaggaatttgtctgtttcattaagattatctaatttgttggcatacagttgctcatcattttataaaccttttaatttccttaaggtcagtagtaatatcccatctttcattcctgattttttttcttggtgtgtctagctaaatgtttgccaattttgttgacattttcatataactcacttctgatttttccatttttttttctactgttcttctttctttcattagtcttacaccagtctttatacactttgactcatgttttctcttttctttctaggacatgagtggaatcatgaaatggtgcgtatgggtggccaggagtggtgcttgtgagttataaagaagtgtttgtagctattagagttatttggtggtcaattggaataaaaaatctcccagagtagtaaaatttggatgtatcgttatcttaaattgctggtccccgatgagtatttgagtgttccgtaactattaatggactcgatcctatggtagtaaattcagtggttgaagttcagagctacagccaaaaaggatattaaggatgagagcttttactgtcagacttcggtgacttcactcatttaattcatcctctgtccctgcatccagccctggatcttttattttatatgtgtttgtcatacacatggagggccttgtcaaatcctaaaatagggcatggagacagcttctttatatgtactttgcttacttagaaatagaaggtaccggatcattatgcaaggttctctttagatttccaaaagtagactcgagcctcaggacggtagctgtgactctggtgatgataattaatctctgccagttcacacactttagaagctcctatggaaaagtgtagtccttgttccttgtgtctaccattgccaacccacttggaaacatcaagtttcttacaaagacataaaattctaaccatttttagttaggttgtcataacttctcctttgccgagtgttcgtgtttcccaggaatctgaaatctcaaatatgcgccattccactggagttcaggctttgaactcgggcacaggctgacaggatttccctacagagccccgtatcacagtcaggatctacagctcagaataccacatctctggcccctcccagaaggcccactgagatgcagtgagttttccacatatcacataccatttctacaggtagcaaagtcttttcctatcgttttatccaattttttattatttccattagatatcaaaggagggtttaattatttcatttttaaggaagaaactgtgctttcaagaaatgaagaccttctcaaggtcacccagaggataagagggaaagtagacacagtcacatttcttctggatccagggtccggctctcccttctccccctcctcaggctcagggagaagggttcaagtgcatcagtgatgtgaaggagatgaaaccagtgatgtgggagggatggacacaggatgagagatgtgggggtcaaaaaatttttttcatccctaggagtgagatctggaggctgaaaaagccaaaaatggtttccaagaaactgaagactgtattccatgctccagatctgagtaggatgctgcaaatgtttagaggtgaggagaagcagacaaagactgtggatgtgggattgttgtggtgtcaggtaataaactgtctaggtgggataacttaaaattgaggacagaagagaggagggaggtcagagaataaggaatattctgtggtgaagaggatgcatttatatgtaaggaaaaatggctaggtctctggtttatcttttaattcactagctcacagcttcatggtattcccttcccctgtccctactctaaagaatatataggtatcagtgcttactcctttgtttctaatcagcatcactgaatcttttattatttcagaactgacagctgtccggtgctactggggtaagaaaaagttagtctttaaataactgttttccaattacctttcagaagtttatggtttcaatgatatcttctgatcttagcctcatgcattctcagcacctcccaaaacatttgctaaatacatttctccagtgttttacccctccaattcatcagtgcaagtttttcagtcacttcccaagttcgttcatcaccatgtcactagataaacctactccatatctgtcacctaatcatatatatcacacagatgattatattcatatacatatatatatatttttttttttcttgcagtggatgtcacactgaattcagtcaacctaaatttgaatcttgtcctttcagaagatcagagacaagtgatatctgtgccaatttggccttttcagtgttataattatggtgtcttgggatcccaatatttctcctctgggaaacattactgggaagtggacgtgtccaagaaaactgcctggatcctgggggtatactgtagaacatattcccgccatatgaagtatgttgttagaagatgtgcaaatcgtcaaaatctttacaccaaatacagacctctatttggctactgggttatagggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggctccctcatttacaagttctctaaatgttgcttttctcagcctgtttatccatatttcaatccttggaactgtccagctcccatgactctatgcccaccaagctcttgaattttctcatttcttcacctacaaccctttgtctcgacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcagtatgggtataacatccttgccttcccatttatccatgtttcactttatcactgatgtgaagaggcccaaagcctgttagccaccatccatgctacctaggtagtccataggaaccacccccatgaccaccaccaacatcaactaaaggttcttggagggtatgtcagtgtgttgctcaggataccccaggtacatcaaggaatcaaggagaggaaaatatgagcaatatgtgtattcagagtgaagattttatgtccagagtatttgagctcaaaccttgcctgttgttttctaatcatgatgaatactttctcagtttctttttcctgaaatataaattgggatttaagactgtacctaactattaagatcactgtgtaaaactaagtgtctctaaatgtaatgcatcgatttagtgtctggaacataataaatatttgctctcatgattgctaaaaagtgtgagctgtagtaatgtcctgtgcaatagttttgtggccttcagaggaatagtagttgattttactgaagtctcatttttcaagttcccagactccactgttaagaccactccaattttagttttgttttatagaactttttatactgagagtgggactgttttttttcttttttattgtacatatttaagatatatatactatgatgttttgatacacacttacatggtaaagtgattactacagccaagtaaattatacatccactgtatcatatagttaccgtgtgtcgggggggtggtggttagtgcatttaaaatctttcttagcaaattcccagtagacaatacaatattaactagaatccttgaaatagttgggatttttgtcctgcccaaatctcatgttgaaatgtaatccccagtgttggaggtggggcctggtgggaggtgattggatcatgggggcctcatggagggcctcgcaccatccccatggtaatgaatacattcttgctgtgagttcttgggagatctggttatttaagagtgtggcacttcctcctgtctctgtattgttcccactcttgccagagatgttcctgttcctgctaatgttaggataaaaaagtgattatatttgacaaaaaaaatttaagttagtacaacaataaaaaagtacgataggctgggtgccttggctcatgccggtaatcccagccagcactttgggatcccagccagcactttgggaggccgagaagagaggatcacgcgaggtcaggagttcaagaccggcctggccaaaattgcaaaaccctgtctctactaaaaatacaaaaattagctggatgtggtggcgagcccctgtaatcccacctacttgggaggctgaggcatgagaatcgcttgaacctgggaggcggaggttgcagtgagccgagattgcaccactgcactccagcctgggcaacaagagcaaaactctgtctcaaaaaaaaaaaaaaaaaaagtgtgaaaaaagtggtttgttatatagatcaccaaaaaattatgaaacattgtcatacaattcaatgctaggttttaaatctctgtaaaatgaataggttaaaattaacaatcttacaatcaggaagaagcagaaaattccgtagaaccacaataataaaatgatgtaaacattataaaattatatgtgttcaagtgcatagaatgagagtacttttgaaggtctaatgttttgggtcagttctacaatcaggaagaaaaaaagacaggcctacctttccttcttcagaagagagtggggacagaggagatttgatgagggtcaagtctaggaaaagcttcacttttgctcattgtatgttgattctctggatacattcccacctgttctttgccctgatgatgagacttttacccagatgtgacaactgctctcttcatctcatctagtcttctggaaaaaaaaaaaaaatatatatatatatatctatatatagatatatatagatatatatatagatatataaaacatgtatattaaatgtatattaatatgtgtatgtatttataacatatgtgtaatttataattatatataatacatatatacatatgtatagtacacataaatatattagattatatatgtataatacatataaatgtatacattttaatatacatgtatattatataaatatacatatacacacgtacacacacacacatatccccaaatacaccaaccaccctcatgtttcttcccagaattccaaccaccagaggcacagcttttttggaaatatcattttaccacagtagcactggatgtctgtccactctgaaatgataaaaattcataatattgactatatgcaaaggaggcagcactgacgtcaattttttctccagaacagagaaagaggaggggactatgttagggcaatgaatttgcgaataatagcatgaaacagtctcttggtta

SEQ ID NO: 15497 - DNA, 245286 bp, Human
  misc_feature (1)...(245286): n = A,T,C or G
acattatgctacatgagataatcctgttttgagaagacagatactgtgtgattccacttacatgaggtatgtagaggaatcaaacacatagcagtagaaagaagaacggtggttgccagggggcaaggggagggagagtgaggaactgttcagtggttacagagtttgagttctgcaagatgaaaaagcctagtgatattgtacaagcttgtacatatatggttagcaacattgtactgtacgcataaaaattgttcagagggtaattgtatgttatatgttttttaacacaataaaaaaatacctgtttaaactcagcaatgaaaagcccagacagtttcttaacataaaagtggatagggccctatttacccaaacatcctgcaagcatcacatgtcgaggttcagtagatggcttcagggttcttgcacaccattcattcattcaggaaaacgtagtgaaaggtttgactccttcccccaccaccatatctatgtagttctatagatctttgttcattctttcactccttttatatcagtacccacacctatctagtacagataatctggtaatgttagagttgtcaaaaggaacaaagaaaggatagtaagaacttatggtctcatgtgaaactaaatcagccagaatgcctgtctagatccatgagaggtcataaaagagtctacttagacatattcatgtgacatagaataaacttctaagtgagagtctgtctctaaggagctatacagcactttgttcctgtgaagatcaagtttctttccaaaccaaatttaactaattttcacactcctcttgaaggaagcactttgaaggagaggcctttgttttcagctgcctggatcccccttcacctttctgggacctttcatgaccgttttcctatctgtaatatatggtaatatacttgccttgatgcgaaagacagatttactaatagccttccaataacttcaatgagaccactaactcctctcacagacttctatactcccccagaggtgatactgtcccaaagagggcaaaaaatggattcttgtccaagagggaggatttaaaaaatcttagagctattagagtggtttccagaatcttattccatagtattaaaggagaagttaaatttaatgtattttttccatagtgagaaaataatgaaacaaaggttgagaaacattgcctttgctggatggtaatattattccgtcacagctgaagtgaactggatttaagccaagaggataaaaatgacttagttctcacattttgattaaaaaataaaatggagaaataactaattttctctaatatacaagcttacacttagtgctgtaattgcatatcaagtacactggcttcagccttatttttagtatccatgttatatctttgaggaagtcttggttcatccgtgcaacatttctattgattctagaaacaggtccacaaccaaaggttctttctacagcagagcatacttttggcttgaaatctgtggttccccaaggtaacagttctaggctgcagggaccatgtacttttattctgtatgttgccaatgcctgctcagtgtctggatttgatacaatgtgcttgattattttaaaatgttgaggcaaggaaagaacttcagttttaaccagaactggcactagggagaagcaagcaagatgcttacagagcagaatttaaggaggtatttgcatgatctttatgttttcatccataagctcaccctggttttgaccctggtttgaacagaaatggagttcagtttccaaacacttcccttttcagagttgatctacacagtcaattctctggaagtgatatgatttacaggcgtgtaggaacaaggaatttaaaacaagtatttaacatatacccccattctatttttatgagtatatttctttctacttgcaggtgactcacattggcctcagaaatctaaacttttcactttgttttccagatcactacagatctgaggcagcgttgcacggacaaccacactgggacgtcagcctcagcccccatggctgcaggcatcattgcgctggccctggaagccaagtaagccttgatctctatatgtcttcaatggtgacaacccctgatctcagggaaaacgtaccccttcccttgtataggacccctagcatgacaacctagaatataatcttcccaatcccacctttaaaacttcaaaggtttgggctttttaaaaaaaattcccctatattaagaagaagattaggtttttggttttacatgcttaaaaaatcaaactgtgtaattactttattatggagtcatagcacatgcatgccagttggctccaactctcttgccttgttgaggtttttattctagtctgggaatgttcctgagcgtcccagagaggttaggtctgcccatttctggtctgtttctctgaagcatgactaggcagctccgattccacgacaatagcacagtcacagactggctctgcagaatagaatatgccagggacgaggacaacccatttatatcaaatcctgttcagtatagtcaaattctatgtcaaaaagattactgtgaaagacccctttaggctatttgtaaataaataggtcctcatctcttttttctctaagaacaaataggttaatttgccttaacgttttgaaaacctaataatacagatctaatatctcttgtcctcaattttaaaatcctaaatgccaggaaaactgaacgttcttttgcaaatttaacactagaattcattttttggcaaagtttgccataaactcatttgaggctatttacagtattatttataacatttattgtgaaatattcatgtatttgattgtgaagtgctggctcagaccccgctggagattttgtatcatgtatgttataggcatcatctctgaaaaaattttgaattccaaacatgtcttgtccaattttagaatagggattgaaggcctgttctctgaggttctccctgcaggaggatcataagaaaaaggaactgaactaatgatataagcgattttctaaaaatagccctgcacctctgccctagggaggaagggaaaggcccattcatctagctgcaccctgaagtagagcgatagccagtgacagagaaggaatacaaggataatgaagaggctcagggattacaataagaaccgtgtggccgggcgcggtggcttatgcctgtaatcccagcactttgggaggccaaggcgggtggatcacgaggtcaagagatcgagactatcctggccaacatggtgaaaccccttctcttctaaaaatacaaaaattagttcggtgtggtggtgggcacctgtagtcccagctactggggaggctgaggcagggaaatcgcttgcacccagtaggcggaggttgcagtgagccgagatcgccccactgcactccagcctggtgacagagccaagactccatctcaagaaaagaaaagaatcatgctagttcattctcaggacacaggtagtttcccagcattcacagctgcccctctgtaagacggagagcctatgttaaggcagctggacctgaatataacgtggatacagcaaattgctaagtcatgtgttggactgaaaccgggggaaggacatgggctctggatatggtgccctgtctctgggtggcctcttgcccaagcctggagattgagagatatccaagctcccatgaatatttggatttctttctttttgacgaggttaaatatgaagtcattttcaacaaattacatcttttaaggtgttaaaagtttgggtttagcaaggaactggcacttatcctattaaattctcactttacaacttttcactaaagtgttctggcagcggaagtctcaattaagtgtctgtgtttttaatttggtgaactctacccaggatttttgaaaaatatattgtttttattctgaaattctaggttgtttctctggaatatgtttctgtccacaaaatattaaaagaaaaaacattaggaattcctctaccatgctccccctcaaaggctatctcaaactaaaacttagcaacctgatactataactattgcttcgtagaattaggtgatactcagctctttgagatattactgtaacactattatttttttaaaaaaaaaacagttcttttaatcacgatttaagctgaaatgcaaaaatcttgctttatgcctcaaataacctaagataaggtcactttggactgcataacacattgaaagactacaattgttttttttttttttttctcttttgcgttttgagcatttttaaagatctatttttgacacaactgtgatgagtagaaggaggttcctaagatacaggctacctggaaaatgcactgtgttttaagatgttaacagtccactctaattgtggggccaaaatggatgatgaactatctgataaactcagaaaaaacaaacctttttttgtaactccattggtttgttgtacagctcaatctttgcctgtaaagtgaagctgaaaatcacgggaaagacgtgtgagtactaaaagggtgggtcagatattgatattaaattagcatcaataagcatcgggcctccagcttaatgtgaaacatatctaaaactaagaaattgaagagaggagctccagtaacagtgcattaaggctgcagttgctctaaaactaaacctaatccttgtatatgtgcctcactcatttacccagccccaccccttgcaatctcctcttacactattgcttctcaacagcccttgaaccttggtattttgagattcagcctttactaacacaagttgaggagcaagatctacaagatacgctcttttaagaagagaggagagaaagccacagctctaggcagagttatgactcaggacactgccctactcgctgggtatgcatggcctgccagggttcattcagtaactggatatgctgagcctttgaatgaaaagctgcaagagtctgccagtccctatttgaactgcatgtcctagctatccctgtactgtcaggagaaatttattgtttctctgaatatcaccagattactgtatttactcagtcataggaacattagagaaaactaggtcctgagcttttcgccagcctctcttccttacattccagatgtctgcctgcatgggtaggactgtggttcattctgtgatgctgcttctaccattggcctctctgccattcaaaaaccttcccaggaaactaagggaaaagaaaacaaatacatccggtagtcctagctactcagggggctgaggcaggaggatcccttgagcccaggagttcaaggctgcagtgagctatgatcacaccattgcactacagcccaggcaacagaatgagaccttatctcaaaaaaaaaggttgtgggggagaaagaaaaagaagtggaatgaaatacaaaacatagaaacagataaacttaaaagtatccagatatcttttccaaacataacaagtttgatcatgaaataactttgctatggccaggaacagtggctcacgcctataatcccagcactttgggagactgaggcaggaggatcacctgaggtcaggagtttgagaccagcctgccgacttggcaaaacccatctctactaaacatataaaaattagccaggcgtggtagcatgcgcccatagtcccagctacttaggaagttgaggcaagagaattgttcgaacccaggaggcagaggttgcactgaactgagatcatgctgctataccccagactgggtgacagagcaagtctctgtctcaaaacaaaaaaaaaagtaaagaaaagaaaaaagagaaataactttgctgtaacagctagtacgactcccaggccatcctttttctacagaatgtataagaatatgtgttgcaacaaattccactctaatatgctcgcagatacttgaatgaaattgttctgctcccaagactagaagaattctcagttcctctgaaaatctttctcctttacctttttttcctgggttggagcctctttggtttgggttgtgttaagctctacagccacctttgacagtctcatcatgagtcttgcctttctgctaaagtgagagatttcctccttgttctcaaagatgcttctaaaaattatggacgattttagaataagaaaaaatactttaatcttaaaagagaggggagaaacaattttttgtgatgtggtaccctcagaacatttttattggttcagaatgtttaatagtatgattttttttctggattttttttggtaactttctggtgtttcagctaaatgaatagggaacatgtaaccagtgattataggatatcatttgggcgattgctgcttaaaatgatgtctttttacatagcctaactcaaaaagttcaaataaaatgagtatgcaaggaagcaggtttattaaatgaaaaaccaaaatgaaagatggctgtactaattttagcttagcaacctggcagaacaccttatgtttgaaaagtgttttgcatctaggtcctagtatatgttcccagtgctatagatctatcagggggaaaaaaataaaagagcttgctgttaaatgatgttttctataaaattgtttataaaataaagtcaaaataactaacattcatgaaagtacagagtgctcagaataataagttgtactgaaagttttcctcacccatctgcaattattagcaatgaaaagcttattttagtggaatatttcatatgtaacaatatcagcatcaactcagaaaatacaaaaattaagttcatcaaagaaacctttctgcttctaattgcaaagggtctttcattggaaaattgaagaatatatgttcagtaatcaagaaatgttacactatacagtgaatggtaaataaaggggactgagtcaggttgaaacttctgaaattatctaaaacttcctaaaagggtattggtataaagaatctcgtacaaattcttgctttaaatgaccgcaaagcctttttcttacatttcatatctcagaggccacaagaataccctgctgtgagaaaacccaatatatctagatctaaatttagaaaataaattaaactaacagctgctcttctacagtagaaatacacctggtgcatattgaacattagctgcctctggtatcttatatatacacagacatatacacattcacatgtttctaggtaggctcacctactttctccttattacttatcttttccctcctattgcaaattaaatttaaattccttgagagtaaggattatatcttatctttatttatgagtatataacaaatatattgaacactacaaaaaaattaaagcatcatactaggcactaagttactcaggacataattcaaatatgtataaaatattatatatcacttgctttcaggggattttatattctcattagggaagcaaatgtacactaacagatatatgcaaattatttaaggaagtcaatgaaatcgttctgggggaagggttgtagggggtgcaggacttggatgaaaataaaaatgcccagctttgatgattcaaattggaacattggttccatagaaatttgtatcctccacgacacctaagcataatgttttgaacaaggtccattctcaacaaatattaaattaattcgtctagtccaaccttaccttttgtacaatggaactgagtcctagagaagttcaattgctcaattagttacttttaccgtccatatcctttagttgatattcattagtgacttctttctcccatactgcctcaactcgtctctcatcctgttgatttatcatttgctagaagtggacctcacctggctaaaataaagacatgaatgttattccctctctcaccttccaagggaatcccctctaccttttgtctttggaggaagggatcattcgagacaaggaaaggtcaaagtgtgagaagttaaaggagtgttgagccaaaggatgattcacaccgtatgctgttgatttcacaaatcacatcttgaaaattttctcaggaaattaaactgaccatctgcatttcttgtaaacctaaaaagtccgtctatataaatcttacataattcagatgaatcaaccactctatgtctttgtttcacctttcattataatctctcttacctacatgtttccagcgttggaaaattgtagggaaatgaccagaatatttgggatacagtgactgtgagaagttaatatgtgggacagtcgagaagggttctggagttttaaacaagccagctctgagttgaagtactcactggggcgaggggtgcttcatatttttagaactgagcactgttaagggaggccacataggaaggatagacataaacatttcttaatattggggttagcatcttagtactgatatcctgtaaactagtcttatcatctgtgtatttttttaaattaaaaacacattttagtataaaatgtctcattaaaaattttcccgagggccacattcaactctatgagatgctgcagtgggcagggagcacaagtgtatttgcttattgaggtaaaattgcagagggcataccaagcttttccttttaagagagttttatttatttcaattagaacttagaaagtacttgcacagagagaaatacaagcatatgtgccctgattccacacagttacaagggtaaagaagcaggtattccacacacccttcctttcatatactcttagagtttttttgtgtattggagtgttgtatgttgggcttaaaattttgctgaaatttctggtatgaatgcttggggtatacagcctgaagagggtgaagagaattaaaagaaaacaagggaggagagctgaaaaggtttataaggtaaaaacaatgcacatttcgacttgaggcctagcggacagagaagggatgtactgtcctgaactattccctatagtgaaataattgtaaccagacccaaagagcagttaccacgggccttctgccaggactgtgcatgaaaatagctttgttatgtctacatatacacagacaatacactctgtcctctagtccttctcaagttcaaattatgtagaagccaacttttcctggactcaactttgtaccttaactaatggtttcaaaaactacagcttccagagatgtctattataactggaaaagccctggtcaacaggctcattcaccttggattatcttgaaatgtagccagtgtgttccaactccttccctatgtgagaaaactaagaaacatgttggatagttgagttgctcagaaactgaactgaagacagaaaagttcttaggagactgttacctgcctctttttccttagctgtattttgaaaaatgttattagtcactaaaaacattttattcttattactataataataaagattgctttttccaaagaatagttgtcagtcctgttgcaatcaccagaccttttccttgtatagctgatcaagtatcattttcaagtgtcaaatgttggaaatgtctcatgttataaatatccagtttgtgctggagcaaggcaagtaaaccatttgggaagccagtgtagtagtgcaggagagattagggtagcctggtcaaggtgatgggaatggggacagagagaagtgggtagatttgatgtatattttgtaggtatagccaacaggtaatgaattacatatgtgcctttgggaaaagcaaaaaaatcaagatctagtttctttgctaaactcaggtaaattgtgatatcatctatggaaatagataccctttattctccccatgggattctggagattagaagctgcataaaaatccagttgtacaagaaagtctctgggcctacagattttgcaccaagacctgtagcaaatttctctggcaattattgactgtccttgggtacaccagcctccccatcagctaattaatctgcaaaaagtgcctacccggagatcatgattgctataagtgactgagacagttcccattttaaaaaagtaaaagaaaacagagaatattatttacattataaattgctcatctgcttctgtgtcttttaatttaaacagagtgttagcaaattaacctttatgcagttacccgataagattgcttagaaactccactgatgtatattagtgagtttacaagaaatatgtgagatttagtattaaatttagtctcttgagggtttgtggattttactcaatgccagggaatttttgttctgatagtgcctatggtaacaccccaaataccatcaaatatgatttttcttgctaagaaaaagagaagatgacttttttagggtccattagtttcacatcatagcctgctacttaatcactttagtcaaagcgtattaaaagactcattgcataatatatcattggatggcttcatcaaatattgctgtttttgtatttgaaaattctcagattatattcctctactctatatttaaacatagttcaaacttaatctgtttatatgccaagttttcttgggctgagttttgaattgatctagcctatggctacattgtcttgccctataattttttacttccaggacatttttgtcacataaaagttaaaattgtttggtgtcatttgttcagaagagcctaattgttcctagtgacactggaatctagtttttgtattaactgataccaacattctttttttcctctgtttaaaaatttataatcataatgcattttgccatcaataggagagaaaagtaaataaggaaaataaaaatgacagattgaaagcatgtcattttactaacatgtaagattttattcatcctgacatcaacaagatgattatgacatctgatgtgttgaaagctccaagcagcacattcatagtgaaataaactgtaatacctggaatagaacatgtaacacaaaaagaaagacattggatgtttataagattgcattatttcttaccatcttagattaagttttcatttctctattcataattctgaaccttattgagtaagcaccatatgtgtgactaagatgaagtaaaagtttatgttgtttgcatatcacagaaaacgcaataagtctgtgacacctggtagtatcatccctaccagtaaagactgtagtacatcagacagtgacatcctgtctgtgacccaaaagattctacttgccattgttcccccttgagtatggagatgctgcatagtgcaaaaagataaaattaagagataaaatggtggaaaaaaacggcagtcagccttcaatgaatgctttatgccaaatactgagctgagtgtttatattggtaatctcattttatcctcaaagcagtgctctaaggtaggcattatcaccatatttcctatgtggaaaatgagggttaggaattcacacaggtgataggtgtggaaggtgaatacaaggtaatgtgacaccagaacccaccattctaccatatcacctttctttgttaagtactgtaacgggacatggttaattacaaatgggcactataaaccgtaaagggaatgaatgagtaaatggagagaaggaactttccctacagttattcaaaagtatggataggtatctattcaggtatctgtagttagtgagatatcgcgccaacaagtttaaatcttgattgattcattcaggaaatatttattgagtcatgcttgttaccataatttccttattttgaaacaaactttttttttcacatttctgaacctgtaatacatcttacaagtcatagttgcaatgtttagctagtttggtatgtgcctggcaccgtgctaagaactagaatacatctatgaacaaaacatgcatggtccttgccagagctgccaggaacagtcaagtaagctgagcacaaatgtgtgtgaggccttgaacttggctccaatagagcctacatttcagtcaagggaggcagagattaaagataattacatctggcatgaaggaaaaaataaaacaaagcattatattgtgctagagggattgatggtagggtaagagtaggaaaggatgaataatggcaaatagggaaaagaagtggcaaggccatcaaggagatgacagcatttttgctgcaactggagtcataaaagtgattcaacttacacttggtttttgtgagtttttactgagttattgctttctggcaacgttaagcacatcttacctttttcgtctaatagagcttgcaatcacaaccaagccttaatagaaggccaaatgataaagaggaatacctgaatgatccataatttttacattcctataacaaatttagaaacctgcctgtatatgattgaaaacaggttgaaaactggcatcacttcacagattaaacttgttcatctagtcagcaagaatgcagttatgtagtcttcagtgagcactcgaatttatttgaaaaacttggtacacaaccagggaatgttggtacgaaggaagagaattctagtgagatttaaaatagggaggtgaggtctctcaagggctctcagcagagtctgcttgtcatttagctattggaaacctttgcgaacaacttggaagaatgtcgtagcgagcttcctggagagagtatgatacaggagtgatcgtattagtcatgctgaatttttattcattgctctgaatttaggtgccattggaattgacatctgatagcctcattttccatagcagatgtattcaattctataattttcattgtgctaaaattctcaagcatttgggatcccatacctggaatataaagcaattgttatcagtttgtctgaggaatcgtaacattggaaggttgcccagaaaccatctggcctgtagagatgctattcagtgagagtgttcaggggtcaccaggcaaaggtgaataacaatggcaatgtaggttatttttaaaacaaaggtatattttttaattttaaaaaataattttaaagtgactcattctgattatatatactgtttttgcatgacattttcttacttgtatgaaatgatgctatccttacttagcaatgaaagtgatgaatctcactttgattcccaagttgaaaaacaatattccagtctttgaaatccaaaagattgagagcctttttcatcacagtggtgcttgcaagcattctactgatttcatttgccactagtatcttagaagcaaataagtatttatttaatactgacagataccaggaagagcaatcccatgaccattataatctattattagcaatagaaccatttttaaaatgtaggtgtttatttatatgatgtattattttgataatatcttcaaattaattaatataaatttaaattatattatcatcaaaataacacattttacaaaacatatatataaatcatgcagacatgtaaatcaaatgtctccctacacagccaactttaagcatgttttaagcttttagtataactcctaatgctatgatgctagttccaaatattcttaatatatgcatgtttactataaaaaatattgcatactttgtctttaatctgcattttgctttcctttcagatcatgttgttcattttgttgttcccctcccatttgtttttttaaaccaaccttttttttaaccaaataatgttttttctaacctgcaatcaagcaagattagattaaagaaggtttcaagtttttgtgggtgctgtctccattcagttgttggaaattaggtgctgagacatttttgaattgtgaggactagtattcaaattgaatttcaaaagtgtgtttcaaagtcactcgaaaagataatctttgaatcctctactaatcacctaatactctttcatgttcatatttgtcttacctgcatatactcaacatattaccttctggccatagttacagcaaatgttttttaatttttcatttgcttttaggtattgtttatattgttttgaaatagggaatttttaaatttattttaaaagtattatttagtcaaatatatgtgtcctttatgaaatcttcaattatataggcatacctgatctttttgtacctcctagagaattttacatatgctgatgaagctatgtatgttttaccctaaatgagtccagatttacatgtggcaaggaatttcctgtaccttaggggaattcatggaccccagattaaaaagcctcaggctaggaagctctttcctatgtcaacatttattaattaatgactgacattttcatgtagtgttttctttattcttttttgagtttttaatttttaatatttttgcatgtacatagtatgtgtatatatttatggggtccatgaggtgctttgatacaggcatgaaatgtgtaatgatcacatcatggagaatgggatatccatgacacaagcatttatcctttaagttacaaataatccaatcactcttttagttatttttaaacgtacaattaagttattattgactatagtcaccctgctgtgccatcatttagtaggtcttattcattctttctaactattatttttgacctctcctaaccatttctacctccccccagcacttcccatcaccacccttcccagcctctggtaacctttcttctactttctatattcataaattcactggttttgatttttagataccataaatcagtgacaatatgcgatgctgttttcttgttttatttttcatcattaaagttgaaccaactagagtttattttgttgtccagtatgaggatgtaaattgagtttttatagggatccaatttgcccaatgtcatttgttaagtaatctatctcctccaaaagcagtttgttttgtattcttttaagttgttgcatttatgaggatctcctttagcattttctgttttatcttctaccaaatctttaaacattacagaatcacttcatattttaaacattttcttaagcattcttatttgttcatattcccagataaaatttagaaccagtcttttgtgttccaaaaacaatcccagtggcaatttataacaattgtgtaaatcttggcttctttacaagttttcccaatcaaaaaaatctttctacattgtttagatcttctttttattggcatattaatgtatcagacttgtccttagtttcatagtttttcagacttattttttggagtagcaaatatttgtttgttttgctattaccattatgtctttaactgattattgcttatctataacagagccattatttttatatgtttttcttatctctaggtcctttaactcacattacattatagctgattttcttgttttttttttccagaatatattcatagcatctgatgatagtaatacttgtctctttttaataatttttcatattcttattggatagtggtacagattagtcattataagttcagattttggagtcaagctaacttctgttccaatcctgcctctactattatttcctggatagccttgagcaagtggaagtcgtatttcttaaccttgtttaattggagttttttcatctgaaatttgggtcagtaactcggaatcccaggattgttgctaggattaagtgaacttaggtatatggaaagtactaaaataaggaagctgatatcatcacagtattatttctattacattaacccttcaaaaaatgttaaatattatgagatagtaagggttcacacttagatcctgattttctattgatttcttttttcttttttaccttctgtttcactttttgtcaatgtttgtgtttcttttagatgttcttcataatgcgtatgcagcgttttttgttttgtattatcattaggaatgagatttgggtgtttccgtatctgtttagatgaatatatagtttctcatactagatttgttgatatgatttattagaataatacattgttaatattattccctgcttatatttatgaatcagatttagttatttaatatgctattggtttcattttagcgtgttttatgtctttgagtttatttttctgagattttcttttactacctaatgtgtgtgtatatatgtgtgttctatgctattattacagcagctagctaacattagttgtgtacctacagcagataaatagcattttctaaagtatacttttggtatatttcatgtaattctcatctataaggtaacatgggtagtaaacggagagtcaagcttttaacccacgttggtttgaccttgaaactggcctgtctctgcaagtttttggtatcagatgatgttaaattcacaaaataaattatggaattttgcaatttgtattttctctccagagacccttgggatcagagttctcgcatgtttgaaggaaaccatctggcctcaaagccatttttagaagaaatcccagtattttctaatactataaacatctcttgtattggttttttttttttttttttttttttttgagacggagtctcgctctgtcgcccaggctggagtgcagtggcgggatctcggctcactgcaagctccgcctcccgggttcacgccattctcctgcctcagcctcccaagtagcagggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccttggtttttatgactgccttaatatttagaatttattagtgttttcttcttattttcttggttaaattttttattactgtttttcaaaggtccagttttgagatttatcagtaattttttttctgtttttctttctttctttttaaaatttctttcctgttttcctcttcattcttttatgactcttattggctgaatcatggttcatttatctttccttttatattaataaaactttttaaagatgtgaatttatctctgaacacacttttgatagactgttattttctaatgatattttcacttgctgtttgatagaatgacaattgagtaaagtactgttaagtgttaaacaaactttgtcgctattgagatttattattgacctttttttcactacattgtgtccagataatagggttagattatcagcaacattggtgtttggtgacgtattgtttttgcttagggcaattgttgaaatttccttttggcccaatgtagcttcaacttttcattacaaactcttaagttgatctgtgaagtcttaaaaaaaaatgactctttgtaggacatatatttcaatattattaaattttaactataatgtaaacgaatcctatgtttttctcctgacataaatggactaaattatctgaacactactgtgcttccatcagttacttattttttcttttttttttctcttttttttttttttaattgagacagaattttgctcttgttgcccaggatggagtgtagtggtgcgatcttggctcactgcaacctccaaccttcacctcccaggttcaagctattctcctgtctcagcctcccgagtagctgggattacaggcacccgccactatgcctggctatttttattattactattttttgtagagatggggtttcatcatgctggccaggctggttttgaactcctgacctcaagtgatccgcccaccatggcctctcaaagtgctgggattacagacgtgagccactgcgcccggcctacttttattttcttaaagtctttgattcatccattttgatgcacaaatgtcatgctgttacatctttattttagatagcactttgtcaacaaattcaactttttgtccttttaagtgtttttgaatctaaaacgttatattgtttgcaatgaatcctcccattcatgaatctttgtatatgttttgtgcaggggaaaaaatctatgtctattatttaatttttagttttcatattttatagatagttgtaaataaagccatattttaaaataaatgtgttttgtaatagaagagttatcacctttgactccttgctatataaacatggcttacatttactttaatgccctcatctacttatttccctatctttaataccataatttggatttctgcaacagaccatttttgttaattattttttattattttttatccccagaagaattcttttaaaacaattattaagtcttaattctgttcaatttattttggagtcatcattaggtcttttctaataacaactacatattttacagttttaaattttgagttattcataaatcaaaataaaactttaaattgtttattttattttgaccttcagagtctgtatttgttgatggtcagttttctcaatcctgcaaatatatcttctgtattcactcatgaaggacgacaagtctagtgtaaaattctcaggtttatttcttttaaatcagttcaactgttttattatcttctaaaattagctttgcagagaaagtctttaactagaagtcctgttttgcttagttttaggatttttttttcatttgtattgtaatgaaaacgtatatattttaggacaagtctaggggatgcaactcttttcattaatatgtcctggaaaacattaagtatttttagtccaccttgaacatttttaatcagatgtgactttgattagtggcgaagatcaccacagagcttcagagcctgggccctgaagtatatgagaaacctgccttcaaattcctgttctgcttcttactagttacacggctttgagaaaggaagtgaacctttctaagccttagtttccacacctgtaaaaggggaataataatgctgtttatttcatggggttgtgtgttcattaagtgaagttatatacataaagcacccagtaaagcatctggtaaataggaaagactcagtaatttttagtcctcagagcaaggtaaagctaatattctgaagccaggtttgtttcctgtcctccaaatccatcggcttgtcttccttgtcatctctttccttaaaaatatgcaagaagtggccgggtgcagtggctcacacctgtaatcccagcactttgggagaccgaggcaggcagatcaggaggtcaggagatcacgatcgtcccggccaacatggtgaaaccccatctctactaaaatacaaaaaattatccgggcatggtggtgtgggcctgtagaacccagctactcgggaggctgaggcaggggaatcacttgaacccgggaggcagaggttgcagtgagccaagattcataccactgcactccagcctggcgacagagcaagactccatctcaaaaaaaaaaaaaaaaaaaaatgcaagaagtcgtcacatttgtattccacatcaactcagctttctatgatatcgattccacctatccatgtcaatttactctttcctgtgcatcctttgcttttgctaataccacttcatactcctcataatcttccttactctcactcagtttgctttattgcttggttgattccttttccctgcactgtgttttccataagctccatattattgttattcttctagtctggactcttctcttttttctcaccaccactttttcctttccctatactctcctcttacatttctttttcctttctttgttcccattctttcctttgtttaaaaaaattattcattctcaatttaaaaaaaaaactggctacagaaaggctgtggctatgtccttgctctgcttagcctccaagcacagacttactcaaatctgccattgaaggatgggatgagggataaacctccctgtccgattctgagattctagcagagatccctctgaagtgagaagatcatttcctcccccttctgacaaaactagaggctgaacgtccagtccctacaaacaccattaacctgactctttccatcacgcacccctccagtccaagacattgcaggtggcgagggtcagagctgaggctctagaatcaggctgcctgggccattctcaactgtggctaattgtatgactttgaggaagatcgttaaactttccctgctttgatgttcttattttggaaatgaaagtaataacagtatttgtctcacaggactgtcatgaagaatagatgaaataatgaatatagaatacttttgatagtatgtatgcctggcacacagtaagccttcaatacatgccatctactactctgtacttttggaggtacatcttttaggaaatttcttctgtagtaagaaagagggttgtacaagaaaaaaatccacaagttagcagtcaagatgttgactcaaggctaccaagctcaagctaccaagtccaaagaagctcaaggcttccaaggccaaggtctatgtggggttttttgttgttcttttccgaatggttgctgcagctccaatcatcatatccacattccaaataaaaggagaaaggacaaaatgatgcaggactagcaatctttatagcaggaaagcaaagttttctcagaaatgcccagtagactttattagtcagaactctgtctcctgtgtacccctcattatcagggattctggaaagatagcattttggcatcccaagatatataatagagggagacaatgaaaaagaaagttaaaaattattttcctcatagtcacattagctcataagtttttttgaaatacatcaaaatttttgtaatagatttctgttagtctttgttgattttttcctgcgtgtgtgtgtatgtgtgtgtgtgtgtgtgtggtgtaatttttaaagtattttttgttcctatcgatgatgtctaacaattagaaagactgccaggaattgatacactaaaccaggagtttctaaaataggcataataattcagccataaaaaaatgaaatcagctgggcgaggtggctcacgcctacaatcccagcactttgggaggctgaggcatgtggatcacctgaggtcaggagttcgagaccagcctgaccaacgtggagaaatcccgtctctactaaaaatacaaaattagctaggcgtgatggcacatgcctataatcccagccactcaggaggctgaggcaggagaattgcttgaaaccagaaggcagaggttgcagtgagctgagatcgtgccattgtactccagcctgggcaacaagagtgaaactccatctcaaaaaaaaaaccgttttttacagcaatatggatggactagagactgttatcttaagtgaaacatgtcagacacggagacaaaatactgcatgttctcacttaaaagtgagagctaagtaatgtgtgcacatggatgtcgagtgtgggatgatggacaatggaggatgagaagtgggaggtggtgagaggggattagacgatgagagattacctaaggggtacagcatactttatttgggtgatcgattccctgaaagccttggtttcatgactatgcaatatatgcacataacaaaattacacttgtaccccataagtttatacaaatttttctttaaaaatgggcataataacatttacttcaaattctagaacccaaaatgcttattttcattaaagttgacagtgaaaactgatcattgaaaagcttcattttaaaatatacttcaataaacatctagagaagcatcattttagttcttttactcaacaggaaaaaaatgggagaaaacggctataaagtaatttagaatcataataataatggcgatgcagtcaatgatttctgttgcctctccaggggtttaactactggcttttgaggtgagaactctgcaaatctctgaactatgtagaaaagtatcaaaagcacttcagtctggcaatttggctaggcaaataagtatacttgtagtcctcattctaacattcgattctctaaagcactctgatatcaaaccaaagaacatctcactatcctccacaattacatcaatggctaactatcaagagagaagatctcccacatgtagagtagatttattaacaatcctagtgggtccaaaaatttcactccccagccaattaaattgccatctacactatggggttgtgaaaaccagatctttttgacaaatcttagtagcattgttgtttcactaagcagaaatataccaaggtgttaaaaatgctgttttgttcatctgttagtgaaactaaaaaacatattactaaagtttaggaacattgcagaaaacttagcctaattaaatacagattcatcaaatgctggtgtaaactcagcaaaagtagtccttctgagttataatggtacagtaggttcctaatctcaataaatcatcatgacgcttgtctttggtagcctatcatatgccaagctctttatttccattacctcaaattcttgcagccatcttgtggagtcagcgttattttctccacattgcggctgaggaaacagagacttcaagaggttcagtaaattgtccagtgttacagaactatcaggtaggagatcatgattcaccctaggtcttcctgactctgaagcgtaatttacaccattctcgtgtgattaagaggctgtagaatgcaaaacaaaatttattattattttgaatgagaaatagaaatgaggggggtaaccatgtcttcctgcaggacttagtctgtgggcctagaactgcataatttatacatgctaagtcctgggacagcccacaaaatgagcagaaaagggacagtgagcaagagtttctcacaggttgagggggatacatttaggaacactcacactgtcacattttgcctactctgaacggttttcaagcttggggtaaaaatgaaggccagaactagattctgggttatgggtttgaagaaaaagaggccttaaggattatattcagggcacaattgttggagggagttaagtgtacagggagacctggtggaaagcttcataattgcgatttgatttcaatgcatgtgatctcaaatgactgacccttcctcctcaagttctattttgtaagagcttatgtagcaaagtatttcaaggaagtgatgattgagcttgcaaacaaaatattatattttcataggggctgcaaaaaacataatttttgtcttttacatgcagtaagtatttgcagtgataagccaggatttctaaggaaaagacacctcagcttcaatgacaaaatttttctttataaattaggggctatcttttcttaagtgtgcttagaatccaaatttacctttggtttagagtaaatccaggggattagaatattttcacaataaaactttgtgtggtcctgcttttctttcattttttccactttggttcaggtgtggaggaatcataagtgggtatttgggtaataccaatacaactcacatttctaaatcttgaggtattattaactgtattttccaataccacaaaccaattttaggcctgaaacttttgaattattgtagaacacaaaacaaaacaaagcaaaacaaatgcacccccagtggcggatactcctgctcgcagtgggactgacaatctgatgatcctttcgggctcttcattacctaacaaaagaggattgtttttctttgttggacggtcggtattttattcttgaattaccactttcatacactagctgcaatcagagtaatgtttctacctatctcagcaggctttaaatactttctgcttcatctttgtgtctccagctcaccatgaatctgttcccataactgccgatttcttttagcattggtacagtgacattaattttctgactgcttgtttctatttctattttacataatctttaaaaaaaagtggttttattttggattgaaggagactagtttcatcttgaattggttttgaacgtttaggaagttggatatttgcgatgctgattgatcatgctatttttcccattgatctgggcctcatcatttcattagacagaattactcttttattttaggaaacagtttcattatctagactagctgttgctcctcttattgataaattctctttctgtaataagatgtgtatctgttgtcttttttatcagctgcccctaaattacaatgaggatgtatttgggtggtgggttgagcgggaggttggttatttttttctccttaataagtgcaggtgagtcagtcacccaagatttcaaattggtccttgtttttaaagaccaccagacacagatgtatttctagcactcacacatgaatttcccagaattatctgggaaaaccctttggtgaaggatttttttttcttttttaattgaagtgctagtggttgcacttagcccaacaagaagcactacacaaaatgtctctcttaggagatgtcctgcttcttctaaaccttgtgttgggcctgtgaaatactctgaactgctcagagtaaaaatgtaatgcaaatactgggtagtgatagtgtcattaattatgctgtttttgcagctgaaaactagaaaactagaagtgtttaaggtgaggttcagctgagattcactgaacggagaagagtcacgtagcctggctgcgaaccacatccaagtgtggccatggcaggggagatgacaagttcataacaataatggtatgcaataatacactgatgttacgacatacagtatacgtgtaaactattataaaaatcatatgattttcctggtgtgttatttttctgtttacctttgaaagaatgggtaaaaggcctttggaacctgcataacaaattaagactcaggaatcctctgaatgctatggtaaacaaaaatcaacagagtcaagaaagagagtgtgtgtacaaagtgtgtgtaaccatgaggacgcgacgtgccatacttggctttttgatccatttgtcaaagaacttcctgacaaatagatgtgtgtctctgcttcacctttgtggatccgtttggaaatagtgttatatggtgattgatagcataaggtatacagccaagtccagctggcttgaattctagttctacttactacctgtgtatttgagttactgtgtgtaactcaaagcctcagttttgtcgtctgtgaaacaggaataagaatgttacccacgtcatatgattttcaatatcatgcaacaatcatgcacataaaagatacactgcctggccctggccaagtgctcactagatgttggttattactatgagttcagcaaaggatgcaaaactataaatgattacatatacagaactcccgagaaagtcatgttcatttccttggtttgaaaggtcatagatggctacccatatcttgtaggtgtttataaatgtgactctcttcatatatatttttgtttaagggcatttgttaattccaggaagaaatttgaggggtgtgtagcataactacatgtgatttattatagggcggtggtcacgagactcaggattgggagatgttgttcttttctccaggtgggttagacttttgatctctcaatagttgcttgcttcaaagctcttgttgcacaagtttgtctattcttggagatcagagaggtctcagttttcagaggccactggagtgtgggtccaagatacttggcagagagaaataggtattagggagtcctaaattatggttgtggactgtggagttccctgcagagagcactcagccttctctctctgcgtttgttttataaatggtttatgagatctctcatagtttgacttagtcttcacgtctgcatcatccctgtgagtataaatacaaatgaaaagtaagatgtgaatcagacgtatccataaacaagagtcgtctctggattctagcaataaataaaccataatgtccagcaaaattaacctatggctatttcctgagctaattatcttcccacagatagaaacactactgattccaggtccactggtttttcaatttatcttctttactttattttggtgaaattcaggaaattttcaaattagatcatttctgaagttgtgcattaccaaatatcagagtaaaaccatccaaacaccttctttttccatgtgtaggtccaatttcctgaagctaatttcttccttctaattacaagcactccaagaactaggttttgctactcagcatgaaaacaagtaactcttatttcttcagtctgagtttgaatgcaggaggcttcctgaatctgccagaatacaggtgcttaaggtataagatcaatgtaaatgttccctgttctgctttgaaaattaaatttttagtgctaaggttcactagggaaaatgtggatctcccaatgatcagaatttcttgcttaatatttctgaagaaatcttgccctggtgacaggtaacatgagacattgacttcttttctttttttctcctccctaaaggagagttaaatttaaggagttaaaacgtggaagttctgtgtgtcaaatgttatttttaaattactaggttgatttagatattttcgtcaaatctaagtgtattctttggtatctcactgtttactcatgacaaaataaaaacattcatgttcatttgggaggattctgctttaccataaataagtggctagagtgtctttctggaccaagctttcttgtcatttttgtcattcactctaataactaggacataccatcttaggcagagctagaacatcttatgttgagactggcattcaggattatcccttgacttactttctaatttccgtgacagtagtgcattgagtctactgaatgatcatgtgaatgaatttagtgtttgtcagcaaaggctcaaatcatgctatttgttttagaagcaaaacatcctgctcctggattccaccaaacagcctgcctccctttcttgaaagttttttgctttatcaggttctataattgattcctaacaagtgctgtatcctaagaaaacaagaataattctgttttcatcgttctcatatttttaaagtttatgtagttggggtttaatttccacaattcaagttcttttgttgatataactttaccaagtagtctagatccagtcttaacccgctctggaaactttaaaaaatggcaggactcagtctccttttatttttaatctgagaccataacagaaaaagtgtcagaactcaatagtacttttctttccccatttctttcatactgaagccaccaaataagagctgtggatgcaaattttagcaaaatgctttgctatctaccacttcttaatagcttcttatgcaccaggcacaaggttaagtacttggcattattttaactgattcaatcagtacaacgacataaagcagatactagcatccatgttctaagtaggaatactaagactttgagaggttaatttcacatggaaaatgaaggagccagaatctgatcactagaccccttcttactagaaggccgccctgaccaccctaaaaaacatagatgtggtgagtatgattgggaaaaaaatgtagtataaagtgaagaaacatacaggccctatcatgaaaaattaggtacaattaagataccaagttctccctctgcctgaaagacctcagtgtccatacacctacaaaagagagtgcagaaagactaccccaagccccatcacacctcaaggcaggtagtgagtaattttctcctcttccctaaatcttctctcccatcctttgcaaatattgttgctgaagtgaaggtagctggtgagaaacaaataaaatggctgcacatgctgcatgaaaattgtcatatttcttagttaagtaaaagatcagcacaactcagaattcaagactgaatgaaataagtatcctgattagaattgcatgcatgcgctgagtcaaatggcttcgagtatatacatagtctatgaaagggaataaaagtctgtttgtatgtgcttggatttgtttctgtgtgattatgattagcattgcagttctccaatgaaagtatctcctgctcagtagtctcttttgtgttcttcagtgctagtagccataagaactaggtgtctaataacacactataataactacccattgcaaattaagaatactcttactgctgtctgtgccttggagcccagctttgggttctgtaccatgttctcttccttaaaaatgctgaaaattgggatgctgtttcgttgagatttttccatatcccacatatatatgcatagaaggttaaacattgctacgttcttctggtaaattgcagctcacttaccaaactattcaatgattaaagaagaaacgtttcagaggccttctgttttgattttagcttatcgtaatctgatgatgatgatccaagcttttatacaaaggatgacagcaccatagtaggcaaccattttgttgaggaaaccggaaacgctcacccttttaaaaaactaagttaccctgactacagtcttattatttcttcagtttaaggttacattttctgcctcccacagactaatgtcacttctccatgttgagaacaagagcggcatttggcatttggttatcccaaacccaaatctctgaccctttgtttttagtactttgccattttgattttgcttttttaatttgcttgtgactctctgcttcccccatcttttttttttttggtacaatgattcttaccttgtctttccccagtccgtttctgacctggagagacgtacagcatgttattgtcaggacttcccgtgcgggacatttgaacgctaatgactggaaaaccaatgctgctggttttaagggtgagaacttctttcatattctgtcacaggcaaaatatttttatttttcccccattttaaatggagagcaggaaacagaacccctcaaacgaaactttaaactttgtgctgacaaacaaagagcttgatcttttagtaaataaaaggcaggttgatttttttaagttaaaactacacagataagggagatttctttggcttcccacatcataggtcaatttttttaaaagatcgaccaacccccatgtatagtcggcctatgggacccctgattagtttactatttgctgtcactgaatatctaagtaatatttataataatgtattttaaaattcctcaccttctataggactacttccacttcaataataactgatatatattgttcactttagtgtagcactgttagttgctaaggccatgcattctacaaattttgtttttgtttgttataaatcttccacaaagaaaagcaggtaataattctaagaaatgttactttatataaactaaaaattttaatgaagctttataatgtccagtccttatgcaattgtgcacaatatgtaacaagtactgaatattttcccatggctaatacagatcatagttcccaaaatagctattctatttgttgtcataggtaatatatgttataataaaaataaaattagctatataaaacatatatcctaaagtttagtatatctactcaagttgtaagtgacctaagttataataaggttttaattcattaatctaacttgtaacaaacattaatttgtttatatctacagacttaaaacatattcccaaataatcttagtatcatcatatatctgtatggatgaaatacagtgttccatagcacagggcacatctccttaaaaattgaggttctgatggtcagaccgttggtaacatggtcctgggcaagtcatttaatttttaagggccctaataatttaagcattttggatgctaagtaatattatctacgtatcatatcttacatatgatctttatatatccttatatgagcaatatatgcaaatatttctgccagaatgtatatttttaaaattacttgtaaataatttattatagactcatgctgaaacaaaacctataaatatcctagataaccagtgccacattaataattatttgattaatatcttcacagaaagcttcactctatttttaggaaaagaatatttctctgctttgaagtattatcaaacacctttccatgcatgtaaactatataatgcagcagtgttcaatgaacttttaatctagagttgtaaatacccgttggcattgcattctctgaagcccaaatcaggagatttgatcccaaaattgtaattgtatgggagacatcaaaattatttgaaatttcggttgttccggaaaatccaggatgtaatttgccatatgtatgtttcattttgattagcttccacatgctcccaactcgtacaatataaatccatgaggctgcaggggagagaaggagctgacacataaccttagctagttgaaagctggaatgaacttcttagtagaaggatcacagactaaggacattaacctccatgaagctgaagaaactttaacccgaataaatatcttagttttacttattcctttttggcaatttaaaaagagcaaatggttctaacaaaaatgcagctcttctgaaaacctctgttggtttaggagagggggagacagagggtttagactaagtcaccagacccaaacctgaatctaaaggggtttgtgcactgctttaaggaggaaacggtattttactattgcacgtggcaatatttagtataatatttcactcttctcttagatggctgccaagagtaacaattaaagtttgctttttcacagatgaattattctgaatgggctgggctcccagtgggattgttttgtaattttgttgatggcgagtcccgtatttcatctaaacaggatcataataagatgacttaagaaaaaaaaaaagttattctctactctaaacgttaccatcccctccctagagtcccacagataaatgtgattaaggcagaggctagcaggagaagcaacatgctttggggaagtggagaatgcagggtactaggactgcagaaagatgctatgactttttatgaaataacatctgaaagaacaataaagagctaatggttagaaaaggttcctacaacaagagctcaacaagggcttgtatttaaatgaggtcagccggcttttgcaggtcttgcttagcaggaatccatagtcacgtatttctccttagactgggaaaacggaagttgcctgcctacagaagtgtgtggtcctgggtgcccttctttgtcccacccaactcagccctaacactgagtaaaatatatgtatgaaatgaatctgaaaactcctgttcttccttgggcttacttttgttttcccagtgttgagtaatttattaataacttgttggaaaagtagtttaaaaaaaaataggagaacaatttcacaaattgctcaataggtacctgccagtaatagggacatcagcgtcacccatcagaatttctttctcatcacgtaaagcagaagccacttagagtagcaaacaactcagttttggagttcagacatcactagacttgatagtctttgttatcactgataacttcagtaaagccaacaccccaatgaatagtctctaccaaaaccctaccaaatccattttatccaacctccttacatttcttcagacatacccccatgtcctacatcctaggcagacagcagggctggatgatgtgtgagctagacttgtgtgcagccctcctgaaggcagacttgatccattcttacccacatgtgttatggactggaacagggaagggtttctcgtcctgaagcagctactggcttggacagattctcattcaggccaggaagttggccttgaacaactaaagaatgtggctttctgatgactcatctctgtttctctgagagtgggattaccctggaggtgctcactgatgagctagggacagagaactttcttctcctttttctgtgccctccttataaaagcactctgtaaatgaccctgtaatgagatgacctcacagagagggaagacacatgtaaacattcttatgttaatggcaccttaattttcaacaattttaatcaaactaagattattctatcctgctgtttcttaaataataataacaatctcatagtataattaaaatatcttttctggtagattagtttttcagaataaacataatctgatgaatacatacctatggaaactgactaaacattgtttggccttgttcatcttgtgaataatcctagctaagtttcagacaacagcttttgactttaaacctcctccagagatagtttttttaattaaatggtataaatatcatgtacctatcagagaatctactttagattgcccatgagaatagggaattatttgccttagaccagatgaacagatgtgatattctgctaccagagaactgaaatccaaattccagtattttgcttctgaccaatatttgcaatgccagaaggtgactttggcattcagctgtttggggttttgttagtattatttctttcctccccttgatcccttccctttctgcttaggaaaagtcttttctgttttgttttgttttctattctttttaattctcccttgtgttccctaaagcatatgaattagccataaaagtgaaggcttttgccattccagctggttttccttcctggaatttaatggatgttatctcttcatttatttatttaccaatatttcctgagcactttcagcatgccaacccaacacatgttgaagtgagcgcagaaagtgggaggggaagaaacgtcagggacaccatggcgttgactaatctgacctgccctggtgtaacttacatacagaaacagaaatttacactccatctctttttttctttagtcaagccccgacaatctgccaggtcatgttagataagtgttgatgatccttctctcatcatctaaaattcaggttaatgtcggcagcagaaggcatctgctatagagaatatcttctgtggtgtctgatgtgtattttgaccagctccatttgggcatatagtatatgcagatccatagagccatgcggaagacttttaattcaggcatttttcataacctacggcttgtatcatttcaggaagaagttagctctttcttgtgatctcctcccttttagtgctataatctgaggaaactgtaaatccactgacctctcccaccagtgcctgggctgtgcaggctgattcttggcccgagtccttatctttggtttgggtgtgaagttataattataattgaatgcatgcaacatcagtgatctagttttctttttttcaaagtgtttatattggattatatgactgtatacagttaaactctcttaaatctaggaacaggaatagacgtcagataataaattaggaccttctgtcatctttactaggcgaaagaatgaaaaaaatgtcattgaaaatcaaaaaatgacaactaagtgagagaggttaccacgccttccatttcactgccctcccagactatgtaagtctctttttttctaccagcatgttgctgaaacctcccccatccccactgactctttctttgaccacaactaaactactagattttttttttttaatttctaactgattaccaaccgtggggaaaacaattgacagtctaacatgacttcttagcctccgaggccttaacttttaataacctgtattacttttaattgccatcattttatttccactggtagggttgataattttaagatgtccaatatatttttaatacctacctgtcttgctttcagtttgtaacacttattaaaaagaattcaaagtgctgaaaccattaagcatgctgtgtgttcaatcaaaatgaaaggttttgaaatgtgcttttgagttgtgttttgagtataaagtgatttctgatgtgttaccatttgaaagggtaaagtttcattttcctttattatttcactgtacaaataatattccatcttcgccacctactatgctgatacactgttggtagctatgattaaagctacataaggcactttaattggtaatgtgtacattgtggttttaaagaaaggttgaagtgaagtggtactcatctggtcagtgtctgaggtggtattatcagaaaaattagtcccttgactccagtcttgatcccacttgcagaaatgaggcccttcctacttgaaaagacagagggaagtaaatacatttgattccacctaataaaatgtgccccctggaaatgccgcctaacatatttttttaagattctatgttttctaccattgtgctctgcaaactcatacccatttcatattgactgaaaccctttcatttttgtatttattgaccattgtgtagatgagcttatcttctagctcatttacaaaaacaaaaaaacaaaaactaaacaaacaaacaaaaaaacaatgtgaatcacacagaattcaggaattttacccttattgttttgcctggtagatgatttacccaaacatctccatgggaatatagaagccctgatagcaaactctgcttggtcatggcttaatccagagtctttcatccaaaatgcccacttgtctcatcagaatgttcaactcatgcctaccaaatatgtgacgctcaaaaatattttctacaaatgaaaagtggtgttttctctgtgcctgtccttgactgaatggtggtattaggtttgttaggcttttgggggtttcattttgttttgccctttcatccctgtaagttttaaatgcatgcggtttcacacttaaaacccattctcaaaatagaattaaaatgatggttgcactatttacctgttatctctatacaagatgtaattagttaatgaagagaactatgtttggagtggttttgtgattttgccaaaatcttaagagcctttaaattctagaagaaagtctattaatgatattttctgtggcctttgaggaagccaattagagtttttgtaccttggtttttgaggaatgtggatagctaatactaaacataatgagaagaatgaattgaatgaaaagtgctttgaaaatggaaaataccaaacaaaaagagtcttaaaagtatatcttcatacatgaagctttctactccctgaaatgagaataaagatgcggaactgtgatgtgaattagaattttttgggggttgaaaattagttcagttacctggagtgggctagagaaaatatatcaaggactttataataaaattattactaatatggcatcaaagtttttaaatcattaatcgtgtatcaatgataatgcaactatacttaaattctgttttgcaaattaatttaaatgtttaaatgtcaccttaagtccaacctactaaatctttaaagctgtaattaattgcttcaacttaggaactaatgatagaaatctgaactgattgtagcctatcaacagcctatcaactctagtaattgatatacagtgtaaatctgtgagtttaaaatatgatttttagcaatgtgtaaaagcatctacatttaagagaaaatagacgtctcttttgtgtaatcacctgaagaaattcaaatctaattctaatgaggctggactttacctagatatttgtaaaactcttctttcagcacatgactttgactattcttaataacaacaactcttaatattttgtggttatggttgatattttaggcaaagatatatgtcgtcaagctctaagcttgtgattatagaggatgtcagtccaaaagtgtattttgactatcaagtaatgaaattgaaccacttataactggattctgaatccagttccaaaataagatgcccaaaaatgatttaagtcaagagagtcttagcaaagtacacacacacacacaaccctctacattctttttacagcctattttaaaattcaacaatcattttcttatttgaggttttgtatttatttaaaacaaaaaaattcactcagctctgaactcagtggttcagtggttgggctccagagtccaacaacctggaagtgaatcccagctttatacagtatctctggtaatcttcatacattcttaatcagctttattgaggtaaatttacatacaataaaaaagcacattattttatgtgtacagttcagtgaattttgacacaggtatacatccatgtgaccatcaccacagtcgagttatagaaacctctgtcaccctaacgagttattctctgctcctttttcatcctctagcctcctcctgctgtggcaaccactgatctactttctgtccctatagatgagattgtcttttgtaggctttcgtataaattaaattatttgaaactggcttctttctagccatataagagttttgaggttcatctgtgtcattaagtaagtcaggcattcccaccataaaacagaatgagatcatgtctttgagggaacgtggatggagctggaggccattatccttagcaaactaactcaggaacagaaaaccaaatactacatgttctcacttgtaagtgggagctaaatgatgagaactcgtgaacacaaagaaggaacaacacacactggggcctacttgagcggggagcgtgggaggagaaagaggagcaggaaaaataactattggatactgggcttaatacctgggggatgaaataatctgtacaacacagccccatgacatgagtttacctatataacaaacctgcatatgtactcctaaacctaaaataaaagttaaaaaaagtaatgttttaaatttttaaaagtatatcaggcattcattctcttttattgctatctagtattccactgtatgaatataccacaatttccatactcattcacttttccatggaacattttattgtttctggttccgagttagtatgagtacaactgctccaaatagttatgtaaaaatctttatgtggacaaattataattttaaaatattagtcagaaaagtcctctttaatttgaacagaaaccctgaagaataagggagcattctaagtggctaactaggtatagagcatttcaggcaagatgaatagcatgtacaaaacctgttcaaagaaaagcaaggaggccatcctagctggggtggagcgagcaaagaaaagaatgaggaaaattgtatcatataaagaatttaatgcccctcttcattcatagtatgtgcttaagtaaaattatttatgagctatatgtcatgcattctaataaaacatattcagttaataattctgttcagagttttgtaagataagaatccagtatattttatatagagatacagatgtagatgtatatagagctatatccattaacatggaatttgtattttagaaatgaaatttggtctctaacactttcaaatattaaactcactacatgatagtcacatatctcttgtgacacttcttttctcttctttgtagtctgttttctctaatttgggctattgttttcatttcatattgtcagtgattttagttgatggttctggataaattattaacctccttattttctctttttcataagattacttggatttcaataaacaataaatggcctcaaaagtgttggaaaaagcataatctgccaatgattatgaattatattaatgtcatacacctaacctaaataaagcacaaataagtacagtgagagggtgaaagatgtttgagaacttgagggttaccaaaagttggggaaccaagcttatctggaataccgtagtttcttttagtttaaacaaatgccttcttttgtttgtgtttctcggggactggaaattataactggaggagacagccatggtgaaggcaacaggtcaggggaaggggcaaaagagagggctcagtgtacaaaaaggacaggtatggtgtgatgaggaaagtaatctaaaagaaatcaaaagcaaagctacttgaatcctgcagttaggagttctcatttcatttgaaaaacattttggagccgctgcggtgattgagaaagtgagctagatgatagtaatgactttcaaacaagttgattcaagttgctagtctgatgtcaaaaagaatattatttcttacactgatggtgcgaatccattgttcctatgatatgtcttacaaaatggcatgtgtgtaacaaactgactggttgaaatgaaattgtcttgcagtgatcattttgtattatcttagtatgcaattatgtatttgtgaccttaagactgagacattcagcgacattttttatcatctcttggccttcttctaaatgaggaaagttgtagatttgggatatataatcatctttgctacatcccactttttttttttttttaagagaaagaagtgctttttgaaatgactctttaataaaccccgggcaaagggtgtggtgagaagattgcttcttgaaaaatgtcaggtcagaaattgtgctttgagaagccttcacatatttcctttgtttgaccaaagtcttttcgttggttgttattgctcaccatgacttccgaaaagccatctaacttcccatatttgaatttctttttagcatacaattgcagtctttgtatttgccatataactccacaaacatttaaagagagcaagtatacataattgtggttagcatcttgagttgctgtacacctattatgcaagcagaatgacagaagcacttagggtttataaatgacttttcctccttccgaagtattgtattcatattctttttctcggccctgaagccaacttagaatttttagtagtcttaagaagctgtattgtttttctgaacccaccggaggttacaatgtatatgctttcttaatatactgtatgggatggttttgtcaggaaatcatccgcttcttttcatgttttaccttcagaagtatatttacagccaaagtagaagatatgtatccagcttggttccaaagtgcaattctatgcatcttagaggcctaaaactcccactgaattgcagtcacatatcatgaaagaatcagagaagatagctaaaaacatgagaaatgtctgattgtttgacagagctgccacacctggttgcataggttgttaactgcacaagggagccaaactaaagggttgagtgggtggggacagaaatctggccttggatccagtcaccaaggaatgtgccctgcagtgggatgatgtccaccttaaggaaagaggtacctttctctaatcgacagaagtcccacatgggcatccctgttgcatggaattctgttgtgatttcttccagagctaacaaaggcacaggtatcttttaagaagtatgcatccagagatggttctgttcattttaatctgcagccattgcttcagtcttgatacccacagaacctgttacttcattggcaaaataactcagtgttactagagtcaaataaaattttgcaatagctggccaggagtggtggcttatgcctctaatcccagcactttgggaggccgaagtgggcggatcacgaggtcagaagttcaagaccagcctggccaacatggtgaaaccccatctctactaaaaataaaaaattagctgggtgtggtggtgggtgcctgtaatcccagctactcaggaagctgaggcaggagaatcgcttgaacctgggaggcagaggttgcagtgagccaagattgtgccgctgcactccagtctgagcgacagagcaagactccatcttaaaaaaaataagattgcaatatctgtggctatttcatcactatctttatcaccagctctctaaacaaagtttgaagtaaaatctcagactcttaagtgatcataagtgccaagcacaaatctataattcttttcaggtacttttttttacattcaacaaaaatgatggaagcttcatgaattcaaatgtatgattctttcatttgagttccagtagaagtttcatatttggggtggagtgcttgtaaacattggcatatgttggatacgtgagcccagagcagcggtgaaaaggcttcatttgaagtcttccatgattatcgtcaacctgtcttgtgaaaataccacctcccccccagctcattttttctaccaaggcatagagctttaaatgtgaaaggaataaactgtgattgaggtaaacaggagaaactctcttattgaaattaatacatgcatatcagtttggattctggcatcagatattcctagcacagactgcagcaccagtttcatatcccacatcagggacagagggctctaacttgctgtgaccacactgagaccatggtaagtgggcactgtggaaactagttgaggatcaataagagggcccaaataaacaagatgaaagggggcttatgattacatcttttccaaatttaattttactaaagatggcttagcctatcctattttgttatctagagagatctttgtattggtgccaatgtctgtaatataaaccaaatccaaaggctcaaaaagaaatgctgaaaattaatccttccctggttctatgcatgacttccaaggccagtgcacctagcactataaagtgagactccaggcagttgctttgcagaatccatctggatacatcttctgggaaataaatagatccagactctttttttttttcttagaatctcaattcagtctctttacacatgctcacatcttgctagcctttggcatttcaaagcaattaaacttctatcacatgtcccagtaatggcttcaacaggcttcattttatggtattataccagaagacacagttccccctgaaatttccaaagtcatccttgaaagagccaaaaagaaagctattgtgatcactgctggatgttaacaaatgggaagttgctctttgatactcaatgtcattcttccatctataagtgcctggttagctctaataaaaaaaaatagccaaagcgtgaatataaaataaagtatcttttccatattaatatcttcacactcacagaaaatccctgatagaaatgactgaagaaggtcatttctcagcaagaatatgggaaagtgttagggaccagatgttaaactttccttccaagtccaacatataaataaataaatatgtatatatacatgtatgtatatatatatatgtgtatatatatattgcacatgatgttttaatgagttctgaagttttgaagatgagagcagtactttgtgtggttgacttggaaaagataagttatgtagatgatttcctcatatgttttccccctttattaccttgcaggattattctgaggattatgattgatttgagtaccttagtggaaagaaatactgtatgtcttgtagaccacagtaatcaatggataaatatatagtagaaagaaattctgaagacttgagcttgagtttctatgactttgcacaacttcttttcatgttcatgagacctagtttcttcagctagaaaatgtgaataataccatcttgctaataagatcattgtgaagattttattagctactgtgtaataaaatacatatgtaagatatgaattttgcctcccctataaaatttcccctcagcctctcattttgtgaagcatgctcaatgcattaaatgtgcttcagttgtaggggcagtaggattcagaaatagacaagtcagtgcattttctgttttcacctttgtacactgagcatgatttttcatctcaactcagtcaaaccctgattctttcctaacaatgccatatgtacttaacgccttaagtaatgtgcattcaaagaaggaagtatctagactaatctgtccctgaagtgtgagtgataatgcaagtctaggttaattaagggaacttttatcttctcaaaatgtttctgtaagagaagcagaaatatttgggataaccatataaaaagatactgacatcatatactgtgcagtcaactctcatttcttttgctcctggcatgagggaaagggtatttgagaatcatgcctatagagtctcaggacctatgctggagaggttagcctaattaatcagactttgccaggagatgccatccctaataacctaagtgttctcaaagtgtggtccccggaccaacaatataccagcatcacctgaaagcatgttagaaattcacattctgggccttacctcaaaactcctgaatcactgggactgagaaatgtgtgctttagcaagtcctgggtgattccgatacacatgcaagtttgaggactactgtcccaagtcgccccccatatgtaatgaattatcttctctcctgtgcatctggaagtgccatccttagaagaataaagtgccatccctggaagaaacaaaaaaatagtctctcaaattgtgtttttcctgctgtttcaataaggaagttgtgaaaggttttccccaaacatctcttgtcagttgctgagccatttgctcccagccacatctgttcttttttctgtcagttggaccatgaccctatgttttcaaactttgtatcactcgtaaagggggagaaaagaaaaagaaaaccttttccattctactgcctttgttccctccctcctttcacagctaaaaattccctgcaagtagtctgaattagctgcgtccatttccttagttcattcagtccttctgtaattctttgcaatcttgtttctacttttattgtttctacttccacctttgaagggaaattattctacaactttgacccatctcctgcttgccaaatcggaagacctattgtcttcctctaggattcatgctctagatcaacccggtctagatctctctttgtttttaatgatgcaaagatacagccctggttctttggctctttacttattcttttctccctttctttaaccttagccattccctgaagtctgttgcttagagagggagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgagggccaaaaaccactctgagggaagctagtaccccttcttttcagttacaaggatcatgtcttcaccaaagattttcaattctacgtcttcaacattgacttcatccactaccgatctagaatctctgcacaaggccctctctatgtcatttacagctaagaacttctaaaacagaagccatcagtcatctttcacaaaacaacttctccccaaagctggcctctgttgacaggggatacccttctgtccatcaccctgttcctgactccttggtcacctccagttttaattgcaaaactccattgcttcttccttacctgatctctcatttctttcaccatttccataacctggtttatgatctcacatgcctgcaccattgcaataggttccctgccttagtccttctgcctctgatatcccgtataacaaatcccagattaatctttccagaatatcaattcaattatgtcatttccttgatcgttggccctcattgcctccagagtaaatccagccgtgcattccaggaccacacagcttccttgaaaatgtcaccattccaaatattctggtctcattaccttctctccatgaatccaaatcttactgaaggatttaagagccatctcaagtcttatttcttctaaaagaacatccagttctcagtaatggcttacttttcataaattttacagaaatttccctactgacatccattaagcttaaaaatcatttgagttttatgaaaataaaagggaatgctcctgagaagcctacatagtggcagaaactgagaaggatatgtggtagctttcttcccagtgaaatagtgacattcccagtgacaaggaataatttttctttgtttgccatcatcacctccaacagtgggtgaagaaggctccttgtgaggtcagctgatggatgtgtagctggatgaaataaccaaatctttgtaattactattaaccactgagtaaacaggcactcacttgaaataaatgtcaactaaattctctattcccttatcttaggagaacttaagggaaaagcaaagcaaaactaaaggaaaattaaataaagaattatctaaaagtaatatgtaaataatccacaaataggaattttggctgccggctaaccaaaatcccatttcattcattgtttgctcaagttttacatcaagaagatctaggctggggaactgacatatggtcaatctaatcttcaactagcctttacccaaaggcccttgtagtacattttttatcttgttctcatctttgtccagacagtcattcctaaaaacaagcaaaaatgggatctggatatgatgtgggttacatggctgggtctccccaagctggtatagtagttttcctactcctgttcaggaaatacccatcaattatcttaagcaaattacttgcctattgtaaccatgctgggagcaaataaatgaagactggtcagaagaaaataagaaaataatctgacacttttttcttttcttaaaatggatagaggcccttgacagaaagcagacatatctccttcttgttttaactctgcaaatgaaacaaatagtaataaatatgtttctgtatgttcatacagaatataataaattgtgtgtgtatatataaacattatattcctatatgtgtataatgaagtacatagtgcgtggagaagaggagctcagcagtattttcctgaactccatttccttagtctgtactaaagagcctgtctgactatgtacagctgctgaccaaacccatccccaagagtagctttgaagtgcaggcccaggagacagtatctggaaactttccatgtgcaagttctcagtagcactggtgacggctggcatgtttggatctggctggagttgttatgagagcctgagattttaggaagagcaaaggaaaaataaaaacaaaccaggcagccgggcgcagtggctcacacctgtaatcccaaaagtttgggaggctgacacgggcggatcacctgaggtcaggagttcgagaccagcctggccaacatggtgaaaccccatctctactaaaaatacaaaattagccaggcgtggtggcacatgcttgtaatcccagctactggggaggctgaggcaagagaattgcttgaacctgggaggcagaggttgcagtgagccgagatcacaccattgcactccagcctgggcaacaagagtgaaactccatctctaaataaataaataataaataaataccaggcagcagaacacaggtgccagctgctacgttttactaccccaagggagtctgcatttttgcactgagcagcagaagaaaacattgcaactatagttctgaatctctctctaagaagctcatgctcctttcgcactgaaatataagagtacgcgaagaagaggtagcggaggaagggaataagacagaggaagaagtaagtgtttctgggagcgttctggctttccactatcagatatttaggtgtgaaactgccgacatgagactgaaaagtatcacttcccactttttctttcttccgtaggaagtttcattttgttttcatatttagctgtttctttttacattaaaaaaaaaaaaaaactatacttaggtgtttacattatgcgtgtgggacgtggcaacttgggaaagcgtcccaggtcctctcagtttcatgctctcctcctgtcctgcacatttggcctggtttgattagtaggtgagggaggcacagggtccctggtgggagcagttatttcagagcaggtggttcagcacattgaggatcaaagaatccaaaggtgctaggactgcaacagctgcaggcagctctttgatctctggttcggaatttctacccagcccacagatcaagcagccctcctcaagaagggaatttgggtaactaccttttattctggtggtttacttataggtagatgagaatagcaacaacttgattgatggcagctgacacccagcaatcatggttgtctttgagttctcctgcagtctggtctcaccctctattccctgcacacttaccactctccccttcccctgctgaccattcacccgactgcaggaatgctggtttcctctgtgcctcaacgaaccacagaaagacttaattatctaaccaggatgctcagtcctggcccctgcgatgtgctaccttcgtcctccacctaactaaatcctacacatgcatgaaagcacaatccaaatatggatcactttcccctcaggttaccttaactgcagatcttggctcacatggattgagtacttactatacacctggttgcttgatagcccttgtatttgactgatttcttactctttggatgtccttttatacttacagtaattatgcagtttggtgcttttaattgtttctcaaattataaagttattcttgtctcaccttctacttgagtgagaacacaaattattttctgttgcatttggatctcactgttgagtatggtgttgaatacagagtaggtgctttacaacctgagtgatataataattaattggatcaattattagcttatattggtgaagtatattgaaactgatgctttcgaataatcaaataattgaatctaatttatcggccacgtttcatattttgatggttatgtgcatccgaacaaatagaaatgtaggtgcaggatgcctgactgccctctaggaactagattattgatattaacagctgggagagtactctctctctctccatagtactgtcacattctgatttcagttgcacgtacggtgaccagtctcctggtttgcccaggaatgagggaattcccagggcacaagcatttcagtgctaacatcagacagtcctgtgcaaatctggacatttactctccctggtcataaggaataggagatattttagctgggcttttacattaaatactcagtaatggatagtggttactaagttgcattttttcaggtataggcaaaatttaaagtttctcctaggctccttggagagagtttttgttgctgcttgtttgccttattttatttgtttgccctattttatttatttgtttgcgggatgctgcataacactgtgttttagcagaaaggtcctctttcactttaggaagctcaaactgttttcaaccagtcaattccttatagagtgatttactaataatcgtgttagtgtcatcatgaaatatccattcagtgtaatttttaaaaaatgttaaatagctggctccagtaaggacagtccactaaaagagatgaacatatacccaattttcctgcttacagcttcttatgcccagaaacttctattttttttcctgctgagctttctagcttatctttagaatagagtcttttaggcctcttagccaaagctgttacgtatattaactgaatctgctttcaaactatgcaattacctacttgtgcgcctaacaattatcttctctcagcacttccggtctcatcagaaaataagaatatacctgccagagaatattaactgttttcctgtgttctcttgtccatctgactattccaagcagggaagcctttggatagctttgaataaaaactagctgtacttctggtgcaagatgaaacggctttcctgagcttatgtgcataaatgagcctatttgtgagacctcaactgatatcttatacctatcaaaatgtaagcagccctgaactctaaaggaacagatataacagtaggcaagttttgcaaacctcctttattgaaacagagcctgtcctacctcactccactaaaaaataaatttactttctgaaatgtactccagtaactctgcttcaagatctttaattattctgtatacataacttgttccctcaatatgtttttaatatttgatttttgaattttaactaagattaaaactgaattgaatgtttctgcccccactcttaggaatgaaaaattctatttgaactggtcgggattcctgttcacaccaatgttaatagtgctctgatttcatggaattttgcattttacacagtgcttgcacagagtggcttccacttgatcgtcataaaattatattcaggctcagcttttgctctgaactgggtgtgagaaatgtgcataaataagattactttcgttatggaatggccgtatcgtaaccaactgtttgcatggtatatttgctataattgtacattgtaaaatgtgaatattggctctatccttgagtaaatttcaaacgttaagggtgcctttacagaaatcagtaataaaaagaacaggcctcttaatttccccttacaattccctggtaaacgctttatgacacttggtgaattaaataacatttctcttctaggcaccattcattcatttcacaaatatttatgaaagccctgctccaagccaggcatttcacagcccctggagagaatcatattctgaacccttgggagcccctcagggtaacagtagatgtgcaagacagacttgactcaaatggtcaccaaaaacgtcaatgtttctctctttacaggtcattttgagtatgaaaattgtatataaaaaattgttagtgcttccaaactgcataatggctctttcccgtattcacaccagattttgagggagttcctctgcccaacacatttattatgcaatttcccttattgacttagtgaccttcattgatctactcagcaaccagttttcttgttcattaatattatattagtatgaagtttttttcggttgaccagtctgcagtttaactgtagctagtcagcctctcttccgagcatctactttgagtgtttcatgaacagacattgtctctggagggtagaaattgaattggaaaaggaaacaaatttatggccttcataaagtctcaaggtgcttttctacttaagtggttaacaggcatgaagtgtttgctgtatctgattgttcatgttaatttatgtcctcatggttgttaggtggacagttctggaggaggggagagtgaaaacaggagccagagcagctgagtgcaagcatgggcgctcaggtggggcacgtacctggtattgcagtgacagctcaaagccctggccctgtccaagtccccacctcccttctccacgcccccaacatgccaatcgaatctttcatcttatttccctaaactgaaataaaatgatgagttgtgctagtttaaaaccacttgacactagcatggggtatatttaaggactgatcggaggtagagctcctgacataacatctttggtaaaaatttcaatttccccagggtaggggaaaaataccatcaactgtccatgatgacctggtatataggctatggttaaatgatgagtaagaacataatgattctcatgaacttttacaaaagatctccacagtttagttccttaagcccaaatttgacatttcttctgtatcatgtgagtacctctgtccctttttaattacccctcatgatgttacggaactaaaactaaatattcagaattgttcataaaacttatcaacttgtgatcaggtttttgataattttcattttgtttattttctggataagatgttttaaaatgaatatgcttactttttaatttaaaaaaataataaaaattgcagaagtacctgtataaaactcccacatttatccgtgccatagcaaagtaggtttactttttttatttaatatgtcctatctggctaagtacctgatattaaagtaaggagaccttacattcatatgtttctttacacagattttctcacatagagctcagtgaacttaataatgtagatgagatagatcataacatccccaaacaaggaaattgtgtattattttctggtttgctaagaattatgtgattagcaaatcgcataattaaggcagtaattttttcaacctagcacagtgttcgtttttatatactatagtttatttgtcctctatgtgcatcaagttctgttaacatagaacatataaagaaacaagacccagttgctgtcatcaagcagtttataatgcagctggagtaaaaagacatatgctgacagagagagttaattggcaatgcaattgatggcacagataaaagtgcagtgcctgataacagtgtgtggtacatcaaaggcattcaggaaatgatggatggatggagggatggatgatgaatggatgaatggatggatggatggacagaagggcagatggattgacaaattaattagttaccagagtagaaaggagaaaagttcactggtcacagatagtcaaatttcagtaaatgtcttttgactatttcattggtcagagagtacttcaagaaggaaaagatagactagccaggccttcaggaacttataagagtagggcttaactctgcagagagaaagaaagaggggttgtcaggccaagttctcagcctggacaaaggcagtggggcagaaagagcagcctctgactggggtctctaagaggggccttcctaaagcaaaggtttggtgatgaggttgttttgcaagtagaatggaactacatctgagcacatcgcgacaatcaagctgatgtatttaagtaatccataagtatgggcagctacataaatgtttgcataaagtcattcatgtgatgataataaaaaatgttttagacaaaaactggaaatatgacatagtgttgaatgtaaagttataagagacagttcaataagaagtggagattttaagtgccaactggaattttaaagtatttttagaaagatctgccatgtatatattactgtatcagtcaagtattcctatatctaattgaagtttctgagacagttatgtcaaattcagctttagatcaataggtttgctaactgagaaccaaaagattcaaagacctgaagctggcataaaagtctagaggcctccaaatatttcctggataaagtttaataaattttgtatatgctagaagaaaggtaataatttatgtcttctaaggtagtcaacctaattactagatatgtcagaacgttagcatctcttgtatgtaagttcttcttgcactatgagaagtcatatacattgttacttctctttaaacctattaattattttatcttatgaaagcagtgatgtcatcacttaaatgcaagtgattaaacagtggggccctggagaaaaactacgtgcattaaaatctagttcgaccagtgacttgctagtcaatcttggccaagtttttctgttcttcagctttctcattaatgaatgatgatataataatggcactaacatctgaagattgttgggagaactaaatgtaaaactgtagactagtgcctggcatggagtaacaattcataaatgataggcatattactggtagtgatagatagtcaatgaaaactgtacatatgtcttattttcttgacatgactatgtatttgttttgctggatttatttctcaaatcattgctggaaagatagctaggatcccatagggtggtgtctggggtctctactgagtgacgttataatttgacctatgtagcttagtgaagctgaccagtctctcgctttccacagtgagccatctttatggatttggactgatggacgcagaagccatggtgatggaggcagagaagtggaccaccgttccccggcagcacgtgtgtgtggagagcacagaccgacaaatcaagtaatgcttgctgccggcaaacagcatgacaatgccccaaaatagagcaagccagtcaattgctcaagacagcctcttgttgcacacagaagctaaaagcttctgtagtttctctctaatgtgactatgaaatggtaatagaacggctaggattctgagcggttaaattcgtactagtatagcccaagaatccttcaaagaaaagcatctttaaaaaagggattgggggatatgcttacccctgggctcttgaaagttttctactgtcgatatttctatttgatggtgcaagtattctccagaagtcagtgtacttttaaaaactgtaacaactctatactgcgtagttatccaaagagtggtacaaaatgtacggtaaatgagattgcagtttactcacagctttcagggcctattccccagttttagtggcacaaacttggaggctgtgctgacagggtttgccaacaggattctatcttagtaggcttattagtgttttgctcttggctttctgttcagagacttttctctctgaaaaatatttttgaactttggttgatgatgaaactagagacattgtcattcttgagaaaatttgtttggaagcagaagtaaatcaactaaagttgtttgagtttattttcattctactcttgtggcaaagaatgagagagaaaaaacaaaagggtggaaagttaaccagtgtttattgagcacttactatgggccatgccaagggctagacacttcatgtatgttttcctcttgaagctgtgtaacaacttgggtattattctcatttgaaaaatgtggaaatggaatcaaaggaattatctatttattcattcacaaactcattcactaagtaactatttttctcgcacttactgaatatcaagcactgagcaaaacattaggaataaaaaggagaataagtaatacttcctacccttgtggaggttacagtctaatggaggtatcacaccaaaaaaaataataagtatataattacaaattctaataaacaaatgttggaaatttaaaaaatgtaaaaaataagagataggggacatattttcacctgtggctcgatgaaggtctcagggaggggaaatttaagctttgaccttgaaggaagaagcgttagccgtagggacatcagcaacaacaacaaaagtacttcaggcagagtagtgtgtgcaaagtccccaaggtgggaaacttgaattatcccagaggttgaacctgatgccattgtggctgcagcctagtgttcaaggggaactgtggcacaggaggaagctagagaggaagatgagaacctatagacaagagggaagaatgtgctggagggttatagagcaagggatgtgaaccccctttatgctaatccccaagcctccactgtaccacagtaagtggttctcacagtgtattccatagatcagctacgtcactatcacctgggaacttgttagaaatgcaaattcttgagatccatcccagacctactcaatcatacactctggggccagcaatctgtgttttaacaagctgacatcaatgcatactcagtttgagatctattaccttcatgaagatgaaagaaccttgttcctttttcacctctcccttgcatctttcccactaactggtaatcctttcagtgacccagttattttggtgatagcactgttgtttagtatccagctatcagctgcttatcttacattgtgtatttattccatgcctccaggttcactcacctgagctctgtgatgtcatttgctcaaactctccatctctctctgttacaggacaatccgccctaacagtgcagtgcgctccatctacaaagcttcaggctgctcggataaccccaaccgccatgtcaactacctggagcacgtcgttgtgcgcatcaccatcacccaccccaggagaggagacctggccatctacctgacctcgccctctggaactaggtctcagcttttggccaacaggtacagcagtggtctctgcccaccagtgtagtagtcacagcgacactcggctattccttaggtagaagggaacagctgctgctttcacctaacctgggaaccagcagagggggtgcttagatgtcaggatctcactgctcataagtagagagtgtgaagctgcctataatctgtagatgtggaaaagtggggcatttaatagttggctaagaaaaggatgcagtagaaaaattgaaggccacttgttcttgatcctacaaaagaattgcagagcactaactcgtaaggcctctgatatcccctcccccaccattaagtatctgttgtcattcgttacagattaaccgaattctcttgcccaagcacttactttcaaaacttaaaggaaattctaattttttaaagcaggtgttaacagattttttctgcacagagccagacaataaatgtgttgagctgtgtaagccaggtctttatcccaactactcaactctgccattcgagtacagaagccacctagacaatataaatgaatacgggtgcctgtgtgccaaatcaaacttcacttactgagaggcgcaggctagatttggcctgaggattatggtttgctcacccctgtttttaaggttgcctcttcagtcctttttttttttttttttttttttttgagagacggagtctcactctgtctccaggctggagtgcggtggtgtgatctcggctcactgcagtcatcgcctcccaggttcaagcgattcccctacctcagcctcctgagtagctgtgagtacagccgtgccccaccatgcctggctagttttttgtatttcagtagagacggggtttcaccacgttgaccaggatggtctcgatctcctgacctcgtgatccatccgcctcggcctcccaaagtgctgggattacaggcatgagccaccgcgcccagctgactcttcagtctttattgccctagagggtattcagtttcgcttgttagcctctcctccctgcttcctccaaaacacttccccagcatataagtaactgtattttgtacaggccaagatcctgctgagacaatgtggccagaatgttctatcactcattttcttttgctcccttggctttttgagtggttgggagcatgggagaaagttgttagcaagtgggaccggagaggggagatgtcagcttttcttgtgatcctcgttctcatggtggttctaaatgacaaaccacagcccaaagcctaaagcttctttgatttttttttctctcagaagaacatttaatgggagcaaaaactttcttatcagtggcatatatagttcaaatgaaagtcaaccttttatatagacatagccacttgtccacacaccaggtgaccatggcagaggtgatctttgttagaacactaacaacaggccagaggtgttgagaggcaagaggcccatgaaagtctgcacggccaacagtgagaccgaacttgccagttgcttttaaaaatccctaacttcatctactataggacagtgagaaaaggagagaacaataacttttctggcttatagcaactaggagtacagaatctgatatcttttttttttttcttttttgagatggagtcttgctctgttgcccaggctggagtgcagtgttggcacaatctcggctcactgcatcctccacctcctgggttcaagcaattctcctgcctgagcctctccagtagttgggattacaggcacacgccaccacagccagctaatttttgtatttttagtagagacggggtttcaccatgttggccaggctggtcttgaactcccaacctcaagtgatcctcttgccttggcctcccaaagtgctgggattacaggcatgagccactgcgtgcagcccggaatctgaaatcttcatgtgcattttatttctgtgcttagacttgctgtgttctttcaaatctgacgtcttccattagtgtatgggaaacctgggtttagtactttaaatgtgatgtgcagctttgccacaataagtgtatgcaggtgcaaggaacataaggattcctcagcataggatcgctgggcacttcctcatgtcctcctcccactgcagacaaagagccctcagcaggccgcctgcagggtaattgcaggtacctgcctgaggtttctttccagcaagcaaaacttcagatacacaattacgtgattaatgaaagtctctccagctgtggttaccgaagctagggaaggcctttatttcttgctttttttttttttctttaccattattcatctgggtttaacttgaaaatgtatcctggtgaaatactgtgaagtgcaaaggtttgcttcacatgtgtggatcgtgttcccccgagcccccttccttgtagagaaacagtccctccgctgttgctgtttgcttgaaaaactcaacctcttcagcctgtctgggctcttcctgcatattccgctatttatttttggcttcccctgaaatgacgtcagtgaggaaacttgtgagcagaggagctatggattccatcacaggcatttggtggattgcagtgttgctggcttcaggctcgcatgcattcttcaacagccaacatctgctttgctctttgcaaagtgctgaacacaagagtgctgcgtgacttgtgtcggagaaaagaaacaggcatttccgacgtgcggtgaccggcactcctatagcgcacctcagtctccctcatcaagaccacctgggaataaagtttgctcccagaatgtgtcttcttggtctggagcagtttcttcaagtgtggctctcgtttatcctccatctcagtcctgaaaataagtagccactgaagggaggtagagagcctggagattggagggggctggagaccccaagagatgtaaaggatattgtgaattcatttgtctacaagctctgcagaattattgctctgagcagctgaccctttccatgtgaaacagctgcacccagtcccaaaaccatgaatggccaccttccaaggcctggctcccccgttcctgctgtgcttgacactggtagcgtccctcctaccgaggcagctaaagaaagacagtttcttttggcactctatccatctggagtattctgaagctttcatttcattagaggaaacttctcctcaaaacctctcagtctctgacctagtggcaaggaggcctcatgccctctcaccttggccccatttcaaaacacattcccagaatggagagctgggaacaagggcatagaaaggggtggagaggaggtgaagcaaaggcctgctttggtcctggtgtccttcatgttggtatgcaaggcagtccgtctctgtggtggggaaaaaaaatgaagaggtcaggttttagaaggaatttgccagagatgattggtaagagcaataaatatttcccctgccagacccttgtctttttttcagagaagtcaagatttctcaggaggaccatgtaaagcaaagaacaaagattttttttttaaataagaattctgaaaagtttaaaacaatgtttccctagcagaggtggtttgagatgcagatgttggcttcttgtggcagacttttcctcattttatctgtcctacccctctgggggtaggggtgattcttttcatcccgaattagaatttccaacactgcacacttaactagcctggcagccaacgtggaaaactccccaaggcctttgaagcagctcctctgctccatggcttactcacagcaggctgcgtgttggctcctgggagaaggaaccagaatctggaggctcacttggcatcacctctcctttgcaatgaaaaaaccagagaccagacaatgaggatgaagcagagggggagagtccagaggacagtgctctccttttcagtattgacaaaatatacgtcctatctggggacctgaaactatggtcactatttatggttggctttccagaagtcctcatttacttagacatttcagtgaggaatttcttcagaattgtttatctcctcaccacaggaattccttgaaagtctgttttctgagaagtgctgaacacgttgatgtagtctgtgtgggccgtctggagcccctcagtggctccctgtcctggctgacgggcacttgcctgaactcctgtgaagaacagctgttggaggaggaacagtttccccaagcatctgcaggtgctaagcgctggaaggcactcagcagcattcagaactccagtccagcttgagctctgtgccccattagcccggcgtgcatgctcccctggcaagccccgtggatcattcagtgggtgtgtgccgtgggtcaatggagaagtcctagaatggactttcctttgctcttcccctgccctcccaccctcttggttctccccttggcctgtataccctgcctaacaaaaaggcaaattgaatattcacagcaagtgatttacttccataaagagcatggaggtcgagtgtgtagggagaagccaggtgggcttgggtcctttgaaaatgtttttagatgagagcaactttagatataagcctatatactatgacacattcaaagtctgcctgtgtcaaaatttttcaaacaaaagcttatcccagcagattctttcttcagctgcatctgttagaattataaaaagctgtctttttttttttttttttttttctgaatctcccttattgagttttagatttagcttagatgtactggccctctgttccaaattttggcctcgattgaaaggtgaaactttgcctccctttctaaatttaattacagatgaatatctctgcttctaattatggccttaaatggagagaaggtatactttctaatctgcaaaacctatggagtcctataattaaatatattttaaatgtagtgtttatgcttcagtcatttctgtcacttccctacccaaatgttcaatgacagactattgacatttgtaaggcatcatggtatataaatgcatctgtgggttgcagtaaaaattacacttttgcagtgaatgttttacattccagtaacacccaaccacgtgaaccttcttccttcattcaaaagaaggtacagcctttggagttagacagagctgggtttttcttgacttcactgatatctgtgtttcaatttagaaagcctaatttcctcatttataaaatagatgtaatagtatatacctcacagggttggttggtacacgtattaagatcacgtacagttacatacttagcacagtgcctagcatagtaagcacttaataagtggtaactcttatttacacagtgcttctccaagcacctggtacatgactctatcaaatgcagttggctgggtccctctcccaaaaagtctaattctatcagtctgcggtgaggtccaaggatgtgcatttctaataagctcccaggtgatcctgaagctgcctgtccacagaccacactttaaatagcaaggatttaaaagatcatccagctttttcatacacattcttattacttttgtgtcatcaaaagacttgggagcagtatgctgctggatgctgtgcaaggaaattacaaaggggcttataatataaaacagatatttcaataaaagccatctactctaaaatgaattaaatcttgaggaagattaagtacttatgtacccacaagaaggaatgcattttggggttggtgaatgaattgataatagtttgcatattggaaggttttttaccaaaaaaaaaaaaacttatcattttaggtattacagacctctagaaccagttcctttctccttctcaatctttcttaaagaagtaattgagattaggaaagagagaaaaagcaaatagtatgttttaaataccctgtatcagaagaaattatttaaaacttacaaaaaccaaacatctaaagaaaaccaaaaactcaactacagtggagccaaatgagttcttcaagctctaccttaaattgtaatgaatcactttaaaaaaataaaaaatagaagagagaaaagagaaaatttccaggaatattagcctgatgtctagttctgtagtggacataaataccatttgaatagtagtggatgattctgaaattaagatccatttacaattttagaaataattatatgataacacatagctgtcagtatttataaaacatcttgttatttagttgccataacatcacagaagaatgctgtggccttgatacattcactagactctttaagaggaagggaaataaagcttacagtaattatgtaagttatttcctgagttaattcctcaaaaggatatactacacttgatggtcatcttttctaccaggcttcatccaaagtaatttatttggaaaccacttgcagggatagggctgtggggcaccattttaataactggatgcataatttgtgccatcgcatgcatatatcatttcatcgagcacgtgattatgaagtcaactttgacaggacagaatttcactgcaagagaagtggataaaggcatggagttaatgtacttaggctttcagcacactggctctgctttattgacattttacccacactaataatgttggcatgtgtctgatctcttcactgttggcacagcgtggatgttcacgctgggcattaagctttttagttgataaaagaagatcccacaattggaatctccgtagcaggtgtccatggttcgacacttgattgtcttaagcaagtatgttctttgcaatgcaaagcaaacctacaagctatattaccttttgttttatgcagagatgcagtttcctttaatgttacaatggtagaaaataagaagtagctgaagtattgaatccaagttaaaacacacaacaatgtgtacttataaaggacggaatgaaactagcaatgtaaagcccagttaggtgatacaacaaccattggtgcctgtttttttttccccatcaactctttcagcaaaatgtgatggttgtgtttggctgcattttcattcctctcctcaactcttatattcacatgaaattaatgaacattccaactctgaataatgtgaagagaccagggggtggaaaactgcttagccacatagacagagctcatttatgtttgggctttgaaacatttacttgaattctgatttgtggatatttcttcttggcagtcagtttatatttaatttttgtgcccggtgtgatttgaaagtgattggtagcaatgaaatgactttcaaaggtggacaggaaagggtggaagggaagaaacgtagggtctgctaatccagcagtcaaatcattgacccatgagtgattaaaagttggctgaggttgtggaaacaagactgcccctcatgtgatggcagcttcaagtctcctttgtagtttttggatgtgaggcaatgagccaagtgttctgtctaaactgtttgggaactgcttttaagttcggcactcttggagaggtattatgtgacaagttattgcttcagtgccctcaaatggcaccatggcctcaacgaattagagcttaagctggagctgtgggacttaaggaaggaagtggttctaaactgcttttctgcctctagccatttctatatcaacatattccctttaacaacatctctctgttagaaagggcagtttgaaaaagctcctcttccccttctctgttgtcttcttgcccaacatacacatgttgtgggtttttagtgagggattcaatggatgtaagttaagtatataatgacacagccatttcttcttgtccaagtctagtcttaagccataaacttgtgaaatgagctgattgtggttgttcagtggattgtagaatctccataaagtgcaccatcctttctctattgaggacccattccagtgggaaaatattcatgtaaaaagctaccatcttcatccttgtcactgtgagccaaagttgccagatccaacctggttcctcattgaagtgccacgctcctctatttcgagagggaacctttatagatcatatacagatgttctaaaaagagagagagaataggcttcatgtccaggtaaactttgaaaatcactgcctcccagttaaccccattatggaaattgataaaacacatttgcatattctgaagatctgagatgtcctctattaaagagttctactcatctgtgtttgattcagcctttcccaaattttttgaccatgggagacctgagaatgctgcctaataattttcatttttctgtctttcaagggttcaggaacatatagcaggtgattttcctgtttattgcttttctctagggaatattgcaaagtgttagccatttacctatcacaatccaaaattgtgtttctgaaccctttagctttagaatcctgctggcattttagaaagagcctcagacacactgataaaatacgtttttaaaaaatcagagttctaatatattgttataagaagactgaactagttacttttatgtttagaagggcacattttctctcaatgggaagaggtacagagaaggtcaaattataaccaccagtttgtctggtaaacatgagattaaagcaaagagagttgatttgtgtgttctgaatagccatcaaactttagttaccataacgtttgttaccatttgtccccattgaaggagagaaatatcccagtaactggacatgattgcccctaagaaaattttagagatatttttcctctctgtttgcctcgctcacttgcaatattttactctttttttatttttttcagtgaaataatagatgaacatcattttttaaagttctatacaaaaaggacttgccccgtctttcactttccactatgtaggtttcatctttacagaaaatgtcttctgtatctttgggatatttatttgggtagtcaagtctatgctatatacctgcataagtgatgtgtttatttatttgagacagagtctcgctctgtcatccaggctggagtgcagtggcatgatctaggctcactgcaacctctgcttcctgggttcaagggattctcctgcctcagccccctgagtagtgggactacaggtacaccaccatacccggctaatttttgtatttttagtagagacggggtttcaccatgttggccagactggtctgaactcctgacctcaggtgatctgcccacctcagcctctcaaagtgctgggattacaggcatgaaccgctgcacccacttatttcttaatatgttaattttatacattattaatgtctctttattcttgaaagggaatctgtttgttttctttcccttcatacttcatatctttcaggattccattgcaggaaacagaataattctagctatttcaagcaggaagagattttaaactgcaaattcggagctttggaaatccctggaaggactgaaagagcaggatctaggctgggatttcaggcataactccctgaactggataagattagtgggcagtctttttattgaagcataatttacctacaatgtaaattcagttttttatgtgaataattcagtgagttttgacaaatctgtgttgctgtatagccacacgccattactttcaacatataaaacaattctatcaccctcaaaaattccccatgcctcttttcctctctcctccccagcccctggcaaccactgatctgtttctttacgtataattttgccttttctagaatattgtataaattgaatcatgcagtatgtagtcttttgtatctggcttctttcacttagcataatgttttttaaattcatttatatcatggtatgtattagtagttattactgggtagtttgttgtatggatatacagtcatccattttcaatctgtgattgaattcacacatgcagaatccacagatacagagggccgactgtaccataatttgtttacacatttaccagttgatggacacttgagttgtttacagttttggggaattatgaacattcatatgaagtttttcgtgtgaacatatgtcttcatttatcttgtttaaataggtaggaggaggattgttgagttttatggtgagtgtgtgtgtaactttataggaactgtcaaactgttttccagagcctcgtatcattttgcactcctatcagcagtataagagagccctagctcctccacgtcttcaatactctgctgtcagtcttgtaggtagagtcttaacctggttttcctgatccccagtgggttctcccttccagatttgctattacatagccagccccaattctgtttctctgtggtaaaacaatgatttatatatatatgtatatatatatatctgcaaattggtgacatccaggatgcagaccagctctagtgcccagctgaacttgctaatggatacaaaaaacagtgtcgattgtggtattaactagaccctcattggatttgaaatatcgcacataacaatgttttgttcactttcaggctatttgatcactccatggaaggattcaaaaactgggagttcatgaccattcattgctggggagaaagagctgctggtgactgggtccttgaagtttatgatactccctctcagctaaggaactttaagactccaggtgagaactccctttctatacattgttctactgtgtagaagaaaatgatggagtatattttggccagagtgtttcacactcacatattagcatcttttctcatgtggttcatttcatgtgtgctttgaattacctgcatgtatttcagttctcaagattaccatttgagagatagtaatttaaggataggaaataaagaatacatatagtatagaacaaaacatgacagcttttgattgatgtttcagaatacatgatccacatctctaaccagcttcccagactttctatgtctgtaaacaagccagcctgtccaccggcactgagttcaattgcatgatctcacaagaagagacaggcttccttagttatctatttctttttagttttccctaaatttacttttcagtttaggcaagacattgagctcggcccatgccagctaatctgggtaccaccaaagaaaatgatgatgatattcttccctgcatgagcccaagagccaaggaaaaagaaacccttcttgacatgtaaaacagaaattatgatgttaacaaaggtcttttcaggtaggctcagtctgtttctgcacacagcctattcccgtcttcatgctaacctgtaaagcttgtttataatataaaataagggaaagtacaaggcaacatggggtgagagactgtgttgcccattacagagccctacagagtggctcagcagtgaatgatctgtttgataactaattagcttcccacccatccatgaacacatctttagccatcagataaagtcctccttctcagtgctctgtccagtcctctttagaagaaccaggcttgggggaagttttaggactgacatccagttctagccctctccagattacagaataaagtaacctagacattctgtaattgtgggagtgtgtagcattcagatacagctagctgcacagggcaaaggaggcacacagcagaacacagggataaagggcacgtttgccagacttttgcctgccaatctgagaaagttactcattctgagagatccattgttgactgtacattttggttatcccttccctagttctgtaatgaggttcatctttgtttgccacagtggtcccataatcagggaggtcaaagccagaatggtggccaggtcacaatgaatcaggataaacgttttgttaaagagtatctgtgcccagctcacctccagaatgcagcctgaatatagtggtaaccaagtttttatcaagaaagcaaatgtttgtcaataaggcaggattgatagagaaaacatgcagattatagcccagagtttctagaccctttcacctcttcataatctacattagttcccaggatcttcctctctcctttcttcctctttgcagcgcatgcttattgccctgccatgaggttgcacagggtcatggcacataggtgaaacggaagcatggtgactgggctgtgatccattagcaggcatcactgctggactcttacaggacaagagaccccggagaaataaacactgtcaaatgtggcagttgtgtaccaaggaaggtgcagacataaagagtatgtttttgagcattttaaagttataaaactaactaaacgtgactctgttctttattaccaccagacaccagaaattctactctccatgataagcccaggctgctcctaagggctactggttaaccatgcattgcatctaagggtcaggggtcacgaatataaatccctctgccctcaagaagttctgagtctatacagagcttactatgattatgtgcacttaaaactctacagtagctcagataatctagagttacctatttcatagcagaggcatctccttatactatttaaatgttcacatttaaccctagtcacctccagtcattttagaggtgttgaggtgttctttttacgccagacgagagataccctaatgctattactggcctggagactttaatagaaacatatagtctttgtgtatctttacttcaaccaacctttcatttcaggattagttacacctttagtaagggactttgagtgtcctgtttatgggtgggggggtgtgtgtgtgtatgtgcatgtgtctatatcattgtttctgtggtgtacagtcctatgataggtttcttcctctctgattaataagggttacatcagtaagcgaatagaaattcagttggatctgtagaattttctagcccaattaaatggtagactcatcccctaatatagaacttcctggctccaaactgaatttatatttatttattgtctcttgtcatttatttattattacaatacatattaagagcatttgagggtgttgttttgatttttggcacattgaacctatatacgcagattgcatttatgtgttagcaaggaagatggatttttctccttctgtatttacacagctatttcataataacaggtttcaatattaattgcaaaatcatctataaaatttagcaaacagaaaaaggggtagaggagaaaaaaaaatgatggcccaaatatggcagttatttgaagtgaatcatagtagaggttctaaggaaataaaattacataataagtgaaatataaagagatgaattacacaggaaggatatccctagtgggcttatgatgtccttcagaaatggcacaaagggaaataatcaattttgagacagcactcttcaaagcacttagagggtaaacttttgcatccaaaatgatcttaaataaaatgaactaaattttaaggtgactaatgattaggatgacctatagtgtccttgtattatatgcttcatttgtacacttgagagatgccataaggaaaatgcgttctcttttgcactgctacctaaaggcaatcagataggtcatcaatttccagcagtcattcacttcttatcactccctaatgcgtgttacttagaattctgggcctgaataataccctgattgtgaaaagcctggtcattaacaaatgagtccaaagaaaagctggcagagggcaaaccatacataaaccgattgtactggtccaatgtaaaagtcagaaaaaaatgcatgcatcacagaatgtgttcatttttaaatgtcaggctcctaaactcctagaaatgaataggagataattttgtatatggtttaaaaacacaggatttggaattggagtatgttttaataccaatctgtcctcttattgcctttgaggaagttaccaacctctgtagctctgtttcctcctctatatattgggactgttagtacccaccttagagttgttttgaacagtgaatgaaataaaacttacaaatcacttagactggtgcttagcatatagaaagcacttaaaaacatcaaacatcgatttgttggtgatggtaggtgctcatagatgaaggaagctgacaagctgaaatccgtcactttctgagctagcccctgaccttgtctggattctatgcattcagccaaggtgagaggggttctgaggggcattctaccttcctaccagcatatgcctatgtttgtaatggttttgtcttaatcacttctgcttacggttgattccttttgagatcagttttactaactttaatgaaatggaggcacgtttcctttttttttttttttttttttttttttttttttactttttgcattgaacacaattttgtgaagctaagaaataagttaacaaataagaactaaactaaagcaaaatgttccttgtaagtgatccagactcatagaaggtgaaacacttgcctcaggtctcaaggcgttcctgcccagaaaatgctgttttgggccaagtgtggtggctcacgtctgtaatcccagcacttagggaggctaaggcgggtggatcacctgaggtcaggagttcaagaccagcctgaccaacatggtgaaaccctgtctctactaaaaaatacaaaaattagctgagtgtggtgggggccacctgtaatcccagctacttgggaggataaggcaggagaattgcttgaaccagggagtcaggggttgcagtgagcctagatcatgccattgcactccagcctgggtgacagaacgaaatcaaaaaaaaagaaagaaaatgctgttttgcacatagacccatagaacattctgcaatgatggaaatgctgtccagtaggatggccactagccacatatggctcttgagcactggaaatatggttagtgtgatggagaagctgaatctcaaaatttttgttaattttagttcatttaagtttaaataatcaaatgtttaatggctatcacattggacagcacaggtctataggacagtataattagtgatgttttcttaatattgaatgaccgataccaggaattagggagaacaaagagttgttctgtctacttattaacaagtcagataatgccaaaaaaaaatttttttttttttttgagatggagtgttgccctgttgcccaggctggagtgcagtggcgtgatctccgctcactgcaacctccgcctcccaggttcaagggattcttctgcctcagccccccaagtagctgggactacaggcacgtgccactgcgcccagctaattttttttttgtatttttagtagagacggagtttcaccgtgttagccagggtggtctcaatctcctgacctcgtgatccaccagtctcagcctcccaaggtgctgggattacaggcatgagccaccggcaccgggccatataagactttttatacctagaaaaacaaagccttctattaagtcctgggattctcttaaatatttctaatttgaaattcagcccttgatccagcaatctgaagtgtgtttgtttctcagtcttcctataaatgctgattaaatcaaggcctctctggtagtacatgctcagtcaatatgtggtatgtgaattattaaataattctgcagatgacgagaaatacgcatttctagctctgcgtttgatgtagtgattgatatccatctgcctcccacagttctgttgctttttcttgagtgagaaggacttaaagatgttacagagctaaagagggaaaatttggtcatgctgtgatttcattattatttctcaaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtgagctggcttccagtgggacacaggctaaaaagaggcagctcatgcatcatcccaccacatgggagaacagaatggaatggaatggaatgaaatggaatggaatggaatggaatggaatggaatggaatggaatggaatggaatcgaatcgaatcgaatcgaatagaatagaatagaatagaacagaacagaatagaatagaacagaacaatctactacccatattctgacatattttcttccccttaaatatttgtgtgtgtatatcagtgcactcatatattcaaatatccatatgtgttatctgcaaagctaatagtccatattgcgattgtaccataatatagttaatctgtaatctgggacatattgttcgcttacagaattttacactattttaaacacggtttggataaacatcattatttatcaatctttgtctatatcttcattatttctttagaatagagttctgttttgagacttactgcatcaaagaggataatcagctttagggcttggaaacattttgtcacttgctatccagacaagatgtaccagtcttcactgtgaccagctatgtgattgtttattacactcattcctgccaacagaaaaaaataaagagaaaaaaaagtaaaaaaaagaaagaggtgaacgttttaaaagtgttatagctttgattgcctgtaaatctaaacatttcttcctctgtagttctctgaattaaatacaactgtcttatccatttttctattcgaagtacagtaatcctcttatctccttgtgaacactctgtatgttattgtctctcacattgtttcgtctttgctgaaaacatattctcacttatcactgttaagttttgttttggtttgtgttgttttgacaaaaaaaaaaactattagaggctggggtttatggtctcagatataacactgatattttgcagaagttttatcctttaatgtctactgaatattcacatgctttgcttggtaatctcttattttttacatttggccattaattcatctggaactcattttggtttatgatatacagtgtcaattgaagctctgtctttagttattttccaaacagactaacatcattggccaagtaactatcccttctttttttattagtttaggatgcttcctttgtaacaatatagtaagttcttataccagcatcttttctggttccgccttttctgattcatcaatctaataattctcaaaccaataccacccacactgttttgttttcatttcatgatgttatttttatatttgtagaacatctgcttcccatttccatagcaattattgccttattattcttccagatgaattttagaatgatttttaagtctccctttaaaagtctcattggaatttaatttgaatttatatgcagtcttatgggaagaattgtttttgcaacatacaatctttccatttaaaacatagatcatgtcccactttactgcaatcttttaattttatgtagttttcttcttgttagcgttacacctaagtatttttgggccttggtgctcttatagtggaaaatattccatgctttctaactagtgtatgctggtgtgtaggaaatctattggttgtatttattttatatggccactttgcttaactctctcattaatttatatagtttagagttgattttctgggatggtttaggtattacagccttatcgtctacaaattggttttgttgtccttcttgtcattatttctgactactgtcttgttgcattggctagcactcctaggagcattcaatccttctaagatatgacatgtaacgcataatggacaaagcttctcctaatgaagaactgtttataggccaggtgcggtggcccacgcctgtaatcccagcactttgggaggccgaggagggtggattgcctgagctcaggagtttgagactagcctgggcaacatggtgaaaccccatctctactaaaaatacaaaaagaaattagccgggtgtggtggcacgcacctgtaatcccagctactggagaggctgaggcacaagaatcacttgaactcaggaggcggaggttgtagtgagccgggatcgtgccacttcactccagcctgggaacagagtgagactcagtctcaaaaaaaaagaaaagaaaagaaaaaaaagaactataaatacaagtttaatgtatctttagatgagaaatattttttcttgcagttctgaggttttcctctaaatactaaaaataaaagtacttcattaaccacctgaacagagtatcttaaatacacatgtagttacttttattctaaacagatagcatcctagaatcaataaacatgcttgaaattaagaccaattgagcttatcagagctggattgtattagattttgtgatgttttgctttgagcctatagcattgctatttatattttaactagcaaactattttgtcttctcggataggagaaagtagatccaaaaaacataaatagagtataatagtaagctgttactctttattcatattttggtaatgtttcccattcaaattttggaatgttgagattcagaacagttatatatctttgtggtttttctgattatatctctaaaacatcaatattggcacttgtgagagaaccaagactattattgcattattatcctgcaacctacaatgctaaacttcatctgggacagtttaagatgataaaagaaacagcatagtatgtgaatttgccatacagtgagagcccttttggcaaatatcaagaataaatgtttgggatttttttttttttaattctagaagtcatctggtgaaaatttagggccacccatgactcctttcctttggagctgcaattttcaccttcatttagaagtcagccagattagagacacagatggcgttatcataaccagattcccgtactgtgtcattggatccaagggactgtgagatcacagctggctgaacttcagtccatagacagcagagacaccactcccctggtgtacgatggcagatggctaaaatgtcccaagttgcagtagctatggaatttggagatcgatttgaagctttggggaaaatagaaataagcagtgctgtcaaatgactcttgcagttaatcagaagtatattcgagtctgcagcattttgaaatgacttatttccattcagatggagaaatcatccctagtacgtgatttgctacatctaagcaggaatttttacctaagtatcagggcctatgttgatcccctctcctcaccatgtgatactgggcaagccactgaaattcttggaaaatcagtttcttcatcagtaaaatgagggtatttgactaccagatttttctctaagtcattccacccgagttctaacatttttttatgtttctgtgattcagttaattatgaaacatagtcccataatgactcaaagaaaccaaggtgtaacagtaagtcctttgggttacaataagtagattttctactacccttgacttactatttgtacatttcattcaatatatttattgctagttaaaatcatatgaattttcagtgggaaagagtttgcagattatgagaccaaatgttccagaatatggagaacaaagaagagaattaaaaacttctataactagcccatgtcattagaaagtttttcatcaatcacaaaatagctccatctttctggcatttttttttcttactgttcattatcttcagttctataccaaagaatatgtagtaagagagattgggaactttcatcccaggtctggaatcctttaagcttgcttgcgttttttttaaatttatatgtcattttcttttgttgaattgcccattggcctttgtgtaggatgcaattttaaatctattatctgtgtctgagactggatgctgataagcttgtgccaggtgctgtaatggtgtttcttcctggccacagtatttcagaggtattcagtagctttaatgagacaggtcatttggtccaggcgttaaataataatgcttttttcttttttgtcaacaacttctctcttttctacaaatccaatctttttactattacacatacttaattgcagttggtttttttccagttgctacagttcatttgaattctcaaatatttatctaccacaaggcagccatatatgctttgaagaccaggccatgactagaatttacattctttatacctaggtaattgaggttgcctaggaatcaaaagtcaaaaaaagtcaagagctcatctctggacctaaagccacattgacaattattcctctgtcttaaagaaactctctgcataagaaaaaaaaaagtcttatttttataccaaattcaaggtaaagctgacctgctctaaaatcatttttccaagtattgttctaatgtcttttggaaaggtccctgcgaccctgagtgcagtgaggttggctgtgacgggccaggaccagaccactgcaatgactgtttgcactactactacaagctgaaaaacaataccaggtaagagaggtgccaagtcacatccccacagcatgtgccaggcatcttaggagttcctgcaaggctaataccatggggtgtgtgcaggccactggcatcttccactattctcccaccagggaccgaaacatagaaaagaggctgctgtgcaggccgactgcctccctgtgttattcaggaatggtgaaaactatattgagttacaaaacgcaaaatgtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatacatacgtacacacattttggaacaactaaatccagctatttaacatatgcattagctcacatacttatctttttttgtggccagaacacttaaacactactctcgtcacaattttcaagtacacaataaattgttattaactctagtcatcatgaggtacaatagatttcttgaacttattcctcccatctcacacaagtttcatgtcctttccaccccactgatgtttgatttcatggcttcacaaagatgccaatgcacaggccaaactgatgcttttccacattttccagcacataggccatcagtgtggcaaaggggttggtcctgcttgatctcactcttctgccctgggcactaaggtggaccctgtgcctctgagcccctggtgtctgcttgagctgtgcagatatgtttcctgggcagagccaaggaatggtgactgcccccatcagagttcatcctgacctccccttgtctcccacagccccacccaccttctccctcctccttcaggcgaaaactcactaagcatagctgccacacggttcctccatactccagtcccccagacagacccagacgtgttaagaattcctgctgtaagtctgctggaatttaaattccttaagagaaaggaggactttggctatctcccagcctctgttatctcctgcacttagcaacatgcctgatatttaattggtgctcagtaaatatttgttgaatggataaataaagctctgtgcttccattatgggcaaacaaggaagtttttttttttttttaagtgttctcatatacaacataaatttaaatatatttatattaatttagacaacagcatacaaccaccaccaccactcacacatgcacatacaggatccatatgacaaacaacacacgaaaatagaagtcacacctttttaaagggacctttttgaatagagttgtggttcccacatagttttcctctgattcaccaccataaccttcctctctgtaaccatcatcatttttcaagagctaggtgcaaaccaggaaatggtttgacaagtccttggtagatttggtgttgggtaactgcattgctacttcagcacactgtgcaggaggaagtttaacaaacaatctggctctctggatgtggtgttggcatcctggtttaaaagtgatttggaagctgagctcagccatttgctcagcacctccaagagaatgctggggactggtttgctcatgacgctgccttctttcttattgtttcacaatgcaggatctgtgtctccagctgcccccctggccactaccacgccgacaagaagcgctgcaggaagtgtgcccccaactgtgagtcctgctttgggagccatggtgaccaatgcatgtcctgcaaatatggatactttctgaatgaagaaaccaacagctgtgttactcactgccctgatgggtcatatcaggataccagtaagctcacttcaaatacttgggttttagagaagaaatgtggtgttttcatttgagtgacctcaggagggatagcctctttgtgaaatctggaattgtgcttcatatcaaacaggatctagttcattcattttaagagaaccctttagaagcttcatgtaaaaatgcttataactttgtcagagtatcctcaagaccacccccagattcagtgatttgctgggaatattcacaaggcctggggtatagtcgtgctcatgaactcacagataggagatattacagcaacaaatcatcaaagggaaaaggcatatggaacaaggttcagccacacagggcatattcacttccccgtgcaacaatgcgtgacgacgtgcatgaaatgttgtctaccagggaacctcattagagactcagggcccagggttgtcactgggggctggtcagacctgacacataccaaaattccagagtcttcaaaggaaaataggtgttcaccataaaccatattgtttatacaaacagtttagacaaagtgagccactcttttcagggtagtgggaaccctcccaaaattcaagttcccagatgtgccagccatgggccaaccttacaagcagatttgctaaggacaacattcaggctgctcttttctgcacactgaccaaatagacaccaggcctgtatgatatcaaaatatactttttaaaaagttcaaaaaatatgactgtcttttaagagtagaatgaacatttgtcaatgacttatttaacccactaatgagggaacttgcaaggtgacaaatagggctaaaagatgatcaggtactgtagtccaccaggaaaggcaaaatggaaatccttttgctaagttggagacaaaattgaataatttaataattttctacatggcaatacaagtagaatttgggggagtgttttttttttctaatgaataggagtaatttgcaactttaccaaacaaaaatgtgtaccttaacacagagtttgggccctaatcagccatcattagcaaacagacgaaggtatattgccctagagaattaaatagtcttaaggtagacctattagacagtgctctagtgtggctctgaaaaggactgcagttatcttttcctttatttctgagttctggataatttctcttaacaaggacctcataccatggtatatgatggcactgaaatttcatgtttttgcacaacctaaggaggcaaagagaaaactcaagtttaaaagaacaagagttatttaaaataaaatcagacaagaaatctgaagtgaatactcttgcttcttaagaagtgaaattctctctggtttcaaagaggagcatttctctgtgaggcagagagggtctttcaacttaccctttagggcagtgggtaaggactctgcctttcttgcttgccccaaaatttagaacatgaaatttgacttgagggagaaaggagaaattgggagacagaagggggcataaagaatccacagaaatatgcagtattccttgtgaggaaaaaagtcaaaattctatcaggaaggttgagccttgaaaaagaaatttgattctggaatgttgtatgacagaaccaaggtaattgagagtccgttgtttccagagcctagaaggtagataattaaggtgttcaaactatgacttcagctaccaggaagtgttgatccaagtggtttgtatatctctctctttctatgtaattgccttatgttatagttttcctctctaatgagtccatttatgtacaacatgatgatcacatatgataatgactagtaataattactgccaacacatttacagtgcttaatagttcatatcgttcccttgaataattaattttatttaacttctcaagacaaccagagaggtgggtaacattgtaatctcattttaatgaataaaagaacagagaccctgaatttgcccactggaggtgcttaaagcagaatgcaaatctaggtcatctgagttaagattctatgcatgtgcagtgttctcaatgagacagtgagagagaccgtatgatgactactgttaagattgtaaggggcttcgtatttcatgctcagaggctcagacttgatccagcaggcccttgcagggatccactaagctgtgtttctctatggaaccctgaagaacatcaacatttaaagagcagatggaagcccatgaagaaagcttcattcatttctacaaattcacatggatataatccacttgcatatcagagcaggtaccaagacattagcaaaattttatctaaggtagaaggactttcttaatatgccaaatattttcctccacagaacaaccataaatttgccaacttttttcaatatggacctggtagtaactaggaaagcaagtattcacagtatacttgttcaaatgatacatttctattctccagaatatagatttctccagaatagagatattatctgaattgtaataacatttataccaattccactgcagctgtaaagtgcaagacactaaaatagtgtttaaaataaacaatgttagaaataagcaatccttacccttgcagtcttaaatgtagattcccttctctagttcagctcaactgaccagtcctaaaagctatgagcatgggggtctacattcccattccttcgtctcaggcattgcctttcaatccctatacagtgatgttgtcccagcttcatgagggggatttgcactgttgcaagttaggaaaccctcctggggagagagactaggaagaagaagaaaaaaaaaaaggcctataaactattcaactaagaattagctaggctatcattttcttgtctgcaaaatggcagagaagtctaaggtgttttccagtgttacagttcctgtctgtacttggtttgctgagaaatgataacaaatagtgattctgtggcttttcctgcaattgtctagtcaaggccataggtactgtagcatacattagcaagcattagaacatctctgatgcttttatggaatccaattgaccaactgatttataactttctcttttttttaacagagaaaaatctttgccggaaatgcagtgaaaactgcaagacatgtactgaattccataactgtacagaatgtagggatgggttaaggtaagagagtgaaggattttatcaagtaacacagcccaaagagcttctcaatgtaaataaaatgaaaaaatgataaacaagtaaataaacagctctcttatgatctaccctgggtttgactcccattcaagcacttgattgctatttgcattatctctgctattatatgtgaaaaatgggatgctgtgttggctaaagaagggttatatccaaataaattctctttagaaaagatggctcagataaaactcaataaaaatggccatttgagaggcattctttgtgctttttaacctgcattgtgccagtcaaggattactttgcaggtaataccaatgaattatatttaatcccccgattcattccttggatggtcggaaattattcccttatctttattatttctctccacatacccaatcattctcttatcttaagtatctcaggcttggttccattatgctatggtatgcacatagatttaacaccaggagatgttttccttgaatggatgacttgctcattgctaaagctcaatagttggtcaactctctaagagaacaatgtacagctcaaattaactaggtagcctcttgatctcagtagggaaggtgagaccattctgcatttagtgaagagttggactgaggctgtacgtagaattagaactctgctgcactggatttcttttaagtattgatcatatctttatttccacctgtgattggaggtaaactaggcagggtccaggcagtttccaggcaggtacattcttcaccattaaccagtattggagcatcattttcatttagattaattatctatggcttcatttctttttccccccatgaatgcattcagtattagcttacttggcaattttcatctcaagacttcagtactgagaaagaattagccacctaattcttcttggagaaggagcaaagcagtataatagaaggaaagaaagtagatgtgggctcacatcctcctctgctatttattaactgtgtgatttggggcaagtcacttaactactccgagccttcattttctcctctataaaatgatgataataataatccctgttttgctggattatgataaaggttaactgtgataacatttacaaaatacctattctaccatctggcacatacttggttcatgagaaataaaagatgatttaaattattttatttcttagggaacattgtatagagtatgttaaaccagtgcatgccggtagaaacatgagagccatatatgtaattttaaatatgccagtaaccacattaagagaagtaaaaagatacaggggaaatgagtttaataaaatattttatttcacctcatatatctaaaatattatcatttcaacaatataaaaacttatcagatgtctttcattctttttcattgttgtactgtcttcaaaatctgatatatattttacccttagaacacatctcaattcagacaaaattgtttttatgagaaatatttgatctttatttaggtttcacagttgaaaaagaaaattttacatagccaagttgttccaaacgtacccaaatttttgccagtaatggaatcaagtgccaatttttcacatttagacttaaattagttaaaattaaattaaataaaatgtaaaattctgtttcttagccatactatagccacctttcgaggtctcagtagccatgtgtgccagattatgttgtacagcacaggtctaacctggccagtttatcacagagagaacagaggcgttcacaataccaagtgcattagcctcgcagtacctgtattttggaagcagcagaaagcttcagggttggtgactgctgtctgttacacgtcccccttacctcattccttctccatacagtgcaacctctgtgtcctgctgaacagatgccaacctcacaaggaagtgctgtcctgtattagaaaaactaggcagctttttaactttgataagtgtttcggtggtccttatttcctctcaaatggatccatttaaggcagtatccttttttctagtgctacagaaagggaaagggattttcttttggctttttaaatgacagcgctctctctctggccagtgaggagatctatgaatgaagtccactttcacttatgctgcccttagtctccttgaggccccttgcatttttctaagggcttccagggttgaccattttgcctcaagagacttgtaaatttttaaatagtggtgaagaacaaacaggggaaaaaatatatcagtgcacaaaatccaggaaggaaataaattaaatgctaatggggactgttcgggtttcttttttcttcaactttgtttttgtactttccaaatttttttaagagcatagggaaaaataaattttaattttttaaattagcattatccacatacaaagcagtcaattaagatgtcaatttggagcagtataaagagtttaaaacaatggaaaccatttaaccctgtttagatactgatcttctagtttcattgatttggtagcataggattacattttctcactatgtttccaatcacactagttattcagtgaataatattttttatattaactattgtaatttttttttttaagagacagagtcttgctctgacagccaagctagagtgcagtggtgtgatcatagctcactcaaactcatgggctcaagcaatcctctggcctcagcctcccgagtagctgggactgcaggcaggcaccaccatgcctagcaatttttttttagcctttgtagagatggcgtctgactgtgttgcccaggctagtctcaaactcctggcttcgagtgatccacccaccttggcctcccgaagttctgggattacaggtgtgagccaccatgcccagccaaatatagtaaaaattttttatttgctttcaattttaagaattagcctgtagactgtgaaaaatatgatagctgacagaaattagaagggagagaaaaatatgcatttctcatttgacattctgacaactcattaaatactatctcatattgctaggtaaatagaaatttaaataggttatttaatatagtttagataactcccagaaacactaaataataatataacaacaaagaaaagtcaagatgattggggaaatagcagtacagttagttttgataaatttttcattagagtgtttaaaatgaataaatcaagaaatagaggcaaaagtattttaaatcttgttgttttgatgagaacctatagaagactaaaatcagaaacacttaaaatcagaatggctactccggagaatttgagctgtgggttggacaggatggtcgtacacttttactcagtcataattcattgtaccatgtgttcctactgcatttataatcatgaaataactgttgaatttattatgtagtaagtctggatattaagaaattgttgggcttattgctagacaatgtgattgttttgtcaatcaaatactttttaaaacctctgggttgtaagatgttgcgcaaagtaggagtgtgcccatcagtctaacaaattaaggaggctgtccccgaagcctagcagcgtgtgtgtatgctacagatatcattgtaggcacagagaagcattataagcattgagaggagaaaaaaaagggtacacgggctatttccccggctttgaagctttgccaaatccactggcctctgagggaaactgtatctgttacatatggagtttggggagtcattacgttttggcctcatcacaacagtctgcttgaagctccctttatacttcttccagcctgcagggatcccggtgctctgtctcctgtgaagatggacggtatttcaacggccaggactgccagccctgccaccgcttctgcgccacttgtgctggtaccttccctagttcttttgtttattctcccggttctggttttgcttttctttctggtttgggccatcactcatgcaacccacttgatacttttaaagtaatgctggaaaagtttatttctcgtttgataattgtgtgtgtattctcattgaaagtcaagcagtcatcagcatcctatcctcattgagaaacttacatagcccagtgatagctcctctttcaaaagacagtgaatgtttttgtcaagaggttccattttaactttgaaggcttttttcccagggaaatcaagaaaaagcatgaatattaaattattattctttgacgccattttctcaaactgttaaagaagaagcccatgacaccacctcctctgaggttttatttctcgtttcctgtgtttgtcttgcttttaaggggcaggagctgatgggtgcattaactgcacagagggctacttcatggaggatgggagatgcgtgcagagctgtagtatcagctattactttgaccactcttcagagaatggatacaaatcctgcaaaaagtaagtggatctgccccctgggccctagcatttagacctaagttcttttgatgactatcttcataagaaaataagaaaacttagaatttgtaatgataacactaggtttaaacatgtacctgtggacactgttctgaagctttcacccagcttatcattgatatttttattcctttgcctcaggggcaccttaaaacctttaatatttcaatttcaagtacatgctccataccctttaaaatcacagtgtctacctgtgtcacctaacctagcaattgttgtgaggaaagatttttgagtaatcttcagagggataattaaatgtaagacattatgaggttgctagtaaacacaccttcccctgtgcatgtgtgaatggattaaaaaattgtacatttttctcatagatgtgatatcagttgtttgacgtgcaatggcccaggattcaagaactgtacaagctgccctagtgggtatctcttagacttaggaatgtgtcaaatgggagccatttgcaaggatggtgagtacaactgcccatatcgatcttatgaagcaaagtatgatctttctactttcaggactaatatttttccacttaaaaaagaaactcacagcatgcatcagatatgacatgctcaatattttggtggcattcattcatcttgaacttatgcccttaatggatttgtttgaattgcaaaaagaaataaatcagctacagtggcactggccaatatggctcaagttaatttttttaattaataaactttattttttgagagcagttttagattcataagcaaaattgagcagaaagttcagaaatttcccatataccccgttttccccacacaggcatagcttcccccactatcaacatcaagcactagaggaatacatttgttacagttgataaacctacagtgacacatcattatcacccaaagtccacaatttacattagggctcactcttggttatatattctgtgggtttggacaaatgtataacaacatgtatgcaacattatagcgccatgcaaagtagttttactgccctgaaactcctctgtgaattacctactcatctctcccacccactactgattttttttttttttttacagtctccatagatttgccttttccagaatctgtataattggaattatacaatatgtagccttttctagctaattattgttgtatttctttccagttttcaccatattaaaaataccatgcacatagagttttgtatcttgctttttgcactaagcattaggcataaacattatcctatgtttttacaaagttttaggaaactttatttttaatagcagcataaaattcaatcatgtgaagattctatagtttttatagtttttagccaatctcctattatttggattgtttataattttgatgtataaacagtaattaaatgggtatctgaatctttcattaagcctgtgaggctaggaagtaatattttcatcttacagaagggaaaacccaaggtgtagagctaggaaatgatagacctaagtatagaacttaatatttcaaaatgttggtctgttctttgcaccaatgattctgaaccaggatgcagcaccatccccaaatattctgattgaattgatctggggtgcagcccatgatcataggtttaacttcccaagtgtttctaatctgcagccaggtttgagaaccactgcacatccaattctccctaacaatttagctaataccaagtttcctcacctctctagcctcagtttccccatctgtaaaaatgaatgaatttaaattattccaactccaacattttgtgaacttttttgactcttgaaataacttacgctgaagcgaccctaaaatttactcctaaatttatgcagatattacatgccaatgatgtagaaattgtttaaactatttgtttaaactattgttgttcaaaacatctttggattgttataaaaatagaaaacaaacaaaaaatatgcagttggaacaatctgactgacatgatcgctgccctaggtttattctttcccttcttttgaatgtttccccttctggaaatttcatgaaaggaaaaacagtaccattgtcaggagaatgtggacttggaagtcagaatgctgtcattcatacctggtctccaggccttgggcaggttatgaacttctctgggcctcatttccaccatctgtaaaaaatgaagaagataatactactgacctcatctggttattccacaactccctacaaagaatctcaaaaaggtgtcagaaagaacggggcacatgattgatagcactgataggacatcatttgtggtcttatttctttggagcatcgtaggtgactttgcatctccatggtttttccagtatgtgattggtctggcaggcatgggcccgacacagtcagttcctgtgttctgaggttttctcgccagggctgattctactatagcacactggggtgataaaggcttggggtggtggcaccccaggggccacgtaagtatcattttttagttaccagcaagtgcctcctttactttacttaaaaacatggctcccctatttctgaatatgaccagaatttttggtaggttagtaacagaaaattgaggaagatgaaagtgagaccagcctgagcaacatggtgaaaccccatctctactaaaaatacaaatattggccaggcatggtagcacgtacctgtaatcccagctacttgggtagctgaagcatgagaatcacttgaaccctggaggtggaggttgcagagagcagagatcgtgtccagcctaggcaacagagcaagactgtctcaaaaaaaaaaaaaaaaaaaagaagtgatgatcgatgcaggaaatccattgtaacaacttgaaatgttcaccaacagtacttggtaccaggcatttcaagagttgtaatgctttaactactttccctaaaccatggtgagcactggataagttatgtcaaatggcactttgctaaaagcggagtgtcaggcttgtgggctgaagtgggaaaagaagaatcatatctgcagtgagcccattttcaggtcagttacaaaatgagaatattgatggctcaccaggcttttgaaatcacatggcagctgcacttaaggatgtgttatttattctctttcaactgtcatatttctgtgattctaagacatatattttttacattttatcatctcggaaatcagatgcatcttataatttgtggcagtttacaactgcttttgaccagaaaactgatgtgatatcagtgttactgcccagatatgagagttggatgcagagacatctgttcaaccgagttaggcacatgactacttcttcttgtgttgaatttaattcttcttcttgtgttgaatttaattgccgttctaaagaggtttgaaaattaaactattgttcaatattcgaaggaaagattcttgcataagcatggaaacaaacaaacagaatgttacataagtataacaaatacttttaataagtctaaaattaaaattctaattgataagacaatattgtgtcacagtttaatatgaagcatcttttcctttgtgttacttaaaatgatggtgcatcttaaatcttgtgtcttagattcaatgaaatatggtataaatgactgtatactctctgctctaggtatctcaaagaagacaaatttcttgcttgtgttattaattgatttctaatttattctttttctaatctttttttttttttcacaaatggataccaattacatttaccattggactgcaatgtctctcctctccttgaaaaacaatgcggttgactgaaatcactttgggtggaccaaatttcctcctgttgactactcctgaatgatctcttccaattccccaaatctgcctctctggccaatcacaaccttcttccatgtgtgtacatcatgctgctctcgtcttcaactccccttctctcttgctgacttctggaaaagcaacggaagagtcctgggcggaaggaggcttctgtatgcttgtgaaaaagaacaatctgtgccaacggaaggttcttcaacaactttgctgcaaaacatgtacatttcaaggctgagcagccatcttagatttctttgttcctgtagacttatagattattccatattattaaaaagaaaaaaaaaagccaaaaagaaaaaaaaaaaaagcaagccacctctctctttcttttcttgctctctttttctttctctctctctcaagtttgtgcagggagatggtgaactgttttgtcagaacttaaatggaaaaaaaaataaaactacaacaagcctaccttttataactgggtgtttagtgctaaacagccagaaccacagagacagtattgtatgaccaaagcatttgatgccaaaatttgacgttaaagtaatgatttgatttcctgccctggttttgaaggtccatttttttcccttttgcattgacttgcttgtttcccctttgaaacacctaaaaatacctttccaaaacatcgcgagagcatacatagacaaaaatgaaatagaaagctcttgcatgcttgagtccaccattgggggaaatgacagaaaactggacctgagggcattaggaacatcctacagagttgtgtttagtgtcgtttgccatggtatttcacagtgaaacatggatactctccacacatcatttacttcatgctgtgtacttatgtactggtttttgcattttactcacttgataagtctgctccactggtttcatcagatagacttgctgctactggcttttccattgtagattgggttattttacacgcagttcgccaaatgggattgctctgtatagtcaaattggtgatggacagatggacagaatgcagaggtacatagatgagctgaggctgatccagctcccctgaaattcagagtgttaactttgtagaccctgcacaatctcttggtgctatctagccattacccccattttttttttaaaggccatctgaaattccatttgtcatggtgggaagcattttggatatgatgcaggaaatctcttcctggagtcaaaagttcccaagaggtcctgtatttttaagaaatggaatttatttaaataatatttaagcttgtgcccatgttggccgggcaacttttttcaatggtgcttattagaagaagttttttcatcttgtcattttaagaaaataaaactggaaattgaatatgggtggcatgattgtacccttttagttctcttatttttctactcctctgtccctctataactatgccatactattatatgctggtccactgaatgctgagatgatctgttttttggggttttttttttttaagaaatattttcactggttttctgtgactctctaaacacttcatcgaaactagaagactgaattatgaggaaactatttggattagtggccagaaacgatgaaatcttatagatcttttgacagtttctctgtttaggggagcctagactgatatcaagtttcttcatatcaaagcttcattggtgacctcatttgctttacaagtgaccagccatcttgcaggcttcatgcttctgagagccttacttagaagatgctgctggagtcacagctgaggagaggaatactatcaacatggactatcctgggaaagagctaggaagtagatgctgaggtccccatccaaacagcaagctaggaaaaagcctgccttgaaaatatttctagacatcaaagataacttacaacccaaagtgaataataagtaaatagtctgatgaccctcttaatagcattgcaattgtattgaatcacataatgattcataagtaactagggaaccaactgattttgctaagcagtcttccccttataacaccacaggcccttctgacacacaaaaaaatgaaagttaatcctgggtacagcatacagttttacatttaaacgcacagtcttacgtggacaaatgcaagcacaagcctaaagcaaggtcaagcagatggcaaaaccgaatttgcctgcaaagaaatctatttaactgaatcagcccataatatttgaggcacgaggttactgtgattgataggaaagataaaaatgatgtctgtttttgtagacgaataaccatcaacatgacaacaaaattcattggggtctaccagcgtgcattccatttcccactgaccatgcaggtgcacgtcgcggaaatactggtttaactactagtgtgttactgcctcatttatctacataacattattaactagaacataatgctttcaaagtttaagttaatgttatatattatgtataaatatatatattcataatgagatatatgtaatggatagtacaaagtttggagactcaacaaatgctctaaccttctagagacaaaagtcctatttctgttttcttttgtctttttattttcaattagtgacccattgttaaatccaaatccacttttactgaaaaatactgtacatgtgtaaaatgttcagttgtttttttgtaaaatatagtagaacggttgtaactgatactggccaaaatcaatgttattccatattttattttttctattaaattaacctaagttcctgtttatttgatctgttcatacccacgtataaacttctctgaaagggtaaggtcatgagaaacttccctgtttctacatagaagctgaatatgaaggaaagggtggaggtgcatgaaacatctaaataaagttggaaaagaaagagtgagcagaggagggaattgagaaggagtgagaaacagcaatgtaagaaaggaatgggttagatttggtcatgaatatatattaaataccatctttagaaagcaaggctgtgaaaaaaaatccataaaggcttggtattgtttctatcagattgtacagatgctggaccccagaacagggcccacctggtcccattcttcctctagtgcgcagcacacccactagtatgtgtctgtagggttaggagccatggctgggggcaaggaggtaggcagtgtaaaagctgttaaagaggaaggtggctttgttcaatttgctgacatcttgcgtaaagtcggcattggctggatgtctagaagatgatttttgtctaaaataaatctccggtacataccagggggtgggactgaacgagctagctaaaaacagcagtggagtatagatctttctgaaccgtgcctgagatgcaattactagtcttaaaggttcagtgctctgccttttggggaaaagaaattgtaaaccagccaaagccacaaacaaattgagctccaactaggtttaaagatctggagataacaaccaggtatgagaaagagcctctactgctttgaagtcccattatagggatggagagaaattaattttattgatcacttactatgtactacacaatgtgagaatatagagtaggtatatacacactgatgtggatatgttctctctcaattttcagaaggactcctctagaggtgaatgtattatcctccatttacacatgagaaaactgggccacatagacttgaaacaaattgattgagattccatatccagattcataataataatacaatttaacattaagacaattaacagcaagtagtacatgccaaatctcaaatgagtggtacactgagttgttaagttcagaacaggcagagattcctttgaattggactggtcagttccctaaagcaggtagagctagaattggtccctgaagcatggatgagtcttacctgggaagacaggaagagagcgggaagaacattaccaatgaacttgctccagttaccagtgaacttgctgcatacaaggtgcttagggaagtaagatgttctcatggttttaatctaattatctattgctacaaagaacagtgattcaaaatttggtggtttagtccagaaaaatctacatttgtacaccttgtagaagaaggatagtgtgtccattctgaatccccacatccatgggagactgctaattatcactcactttccactccagttatcagaggcttgtcacactgctgatctcttctaccagattcattattttccgctgaataagctacccttcatttttaaagaacttacaaactgagtacttggtaaagaaggggaagtgattgctatagtaactactaaagtttctcaatcaaagtgatcaatacttgcaacatatctgagtatggaaataaatacataacatcttatccccctcatgtaaaaagaatgtcatgccgctaaaatataaaatagacattcattcttaacagcttccatattatcattcagccttgcacagagagagcaatggcagacggcaatgtgttgaacagaaattgcatattggaggcaattttaaactatggctcagccaatttaataccccccctccttctgtccccaaccacaagatggtagaggtggaacagaggacagctgcagtgtgacctcacccagcccagggccctgcgcccaatatgtgtagaagacggcacagatcttcttctcttctctggtgaacatccctttctaaatgttatgtttgttgcagactcatgaaatctgaagttttcacacagaatactttagagcctttgacatatttagcagggcatagccaaggtggacttaatttcactgtagctcattagaactacttggcacctagaaatggggctaatctgtataatcctgtctcctcttcatcactagaggtgaagatcaggtccagattcagttattgagcaataaagatgcagttatgcagcctcactacgtttcagcggaccagaatgtgacctgggatggccagcactccttcccgttctctacctccaagggacttacaaggacagtttgactggcttattaccaaaggactttcttacaaggtctcttctctaaaggaccattgttggatccagttgtggtttttttagggccaggtgtcaggcaacaaaagatattttgtatcccactttctagaaaattccagaaacgttccctgaggcttgagttgtaagatcttttacttttttcattttagaaaacagtacattattttaaaaatacagtgttttaagcttcacagagttttactaaaatggatttatttaatttggcccacacaaaaatcaggccgatagacattcattttctgatgcaagaggcacagctagttaaggggtgtggctgggactcaagcccacagcttcaacattctgtacaacactgattcctttttaagagtgctggagaaaagcaagtccacatcacatatgttgcaaggcaagggggtaagagccttttctcaagtgaagatagaaagcacactgtgtgcctgggcttgactttttctcattccaaaagagttgcttccataaataaatattattgagtccccgccacaaactaggttctgagtgttctcttgccctcttcaaacttatagtctaatgagggaaacagacacttagacataaaacacatggttacaatgtgaatccgtttaagtgcctttaaagggtataaaatattgtcaggagtcaaaggagcaagctcacttcactaatcacgtgctaaggttccatgcccttgcactacaagcttcccaaggacttccaaaaatagcatgaaaccttaaaaatggagttgactctaaaatgtacaaataaaactgcaaagatcaaaatcaaatgatatctttattaaatatctacaaagtggatcatgtcaaactagtccactgcaactaagaaagtatacttacagccattgtcacttgacagcagggatatgtctgagaaacgcatccttaggtgattttgtcatcatgcaaacatcatagaacacacttacacaaacctagatggcatagcctaccacccacctaagctatatgggatggcttattgcttctaggccacaaagctgtacagcatgttaccgtactgaatactgcatgcagttgtaacaaaatggtaagtatttgtgtgtctaaacatagaaaaggtatggtaaatatatggtataatcttatgggaccactgtcatatatacagtctgttattgaccaaaacgtcattatatggtacatgactataattaatgttaatgtagaataaaggtgaattttaatatgcttgatatgatgtgagacctgcagagattggagaatctaggatcttgagaatcttcatagccctgcaaaggagggaggaagtcactattcaccctctagggaacagaaaagaggagagagagatatgtcctatccttggtggtggtcagggaggtcactggggtggggcgtggaagggcagcgtacgggactgcaatatgtggatgtcttcctggatatcatcctcacttcttccctgtgccttctacactctctccaaggagatctttgtcaatctcatggttttaaataccatctatatgctgatgactcttaaaatatatatagattcctgatctcttccctcaagattcacacctgtagattcaattaactacttgacatttcccttcagctgtctaataggcatctcaaaattaacacgtccaaaatagacttcagacaccccaaccccctgaccatctttaccaccaaatctctcccacctcagtaaatggcattcactgtatttccaaatatatctctaaatggtctacttctgcccactccatagctgtgactgtggccaaaccaccattgttgccatcccagactgctgcaacagcctccgaaccagctcccagacttctccctctcctctcctattttctctcctttccctaatcagttccctacacagcatagtgccattacaaatggaaaatcagatttcatctctgtttactgagcataaaatctgaactccttacctgagatctttgtgctgtcacctcacaccaccatcccccatgccctcacatgttctagtcatgccaactttcttttcatccttcaaacaaaaccagcttgtttgggacccaggacccttgcccttcacatggctggcttcttctcatcccacaggtctcagttcaaaaataacttcctctgagcagttccttccaccactgaccccacacctgcccacctcgttttgactttccatagcactcaccacatgacattttatggttcgttacttgttgtcagccagccccgtgagagctggtgcttcatctgtcttgttcacagctgtatcttacatgtccagcacatgccttgcttaagaaatatttgtggaatgaatgaataagaaaacatccgagagaagtgacatttgacctgggccttgaaggataagcaagaaattaaaaatcaaagaaggttatgatgtttaagaaggatattcgagagagagaacctgagcaaaggcacaaagccattgaaagggtcctgtggacggcgatcacttggaggcccaggcaggggatgagcagggcaggcagcttgggagaaaggatggagagatgagtggggtcaaccggtaaagaaccttcgctggactgtttcccttcctccaccctcttgtcatcaatgtcatcaaccctcttttcagagaggctaattgatttgcccaaggaccccatcaagtcaactcttggcctcctgccaacatatttgagaagcattcactcagacagaatgctgaggcggccagatttgctcagtccccaggcactgatggctgtattgagccagttgaacgaaagaacagggtgcaagctcacatgagaggcagcagcccacagcttctgttcactgtgatgtccacagtcagagcaacaatttggcaaggcctgtttgcaaaactggacttgggaccataagcctgctcagtaccatctttttctcctaagagaagatcccctagccctctaaactgtcatcaccagagaagaacaaaaggaaaaaacatgatgtgctagcacttcccttccctaacaatgaaaacagtaacccccatatgcggagtacttcctatatgctgagctaaaggcttcatatgggttatttaattcagtacttccaatagcctgattctatctccattttacaaataaggaaacagatgaggtaaatgcctaaggtactccagtggtagatagaaggtctgggattaatttaaacccagacaatctgatatcagagcacccacaaggagaaatacaagagccaaggaggattccatcaaaacaagcttcacgctatgattgtggagtgtgcgacgggtttctatattttagctggtgctgtcaggtcccaggtgcatgttattaatgtccacccaggagtacacactgtggctacatcatgctttgtgtgaacaaggcaggagtcaatatttgatcattaaagttagtaacaaccaatgggccatatggacaaaatcaaaatggacctaaggtaaatgaggcagtggctgttacaaagaaatggggatatgatgacatgacacttcctttcataatttctttgtaaagaggctattgtttgcattctctagcccaagttgaaatgaagaagaaataaaatggagttattgggaacattagaagaaacattagcatgctgaaagttaatacaaatacttaatacaaattctgtgagctcctttgacaaatctggtgaaacaaattctttccaggtgatattaaacaggatttcttgccaccgaaatcacaatggttgcaatataataaaagctaaactatgaaaaaagtaaggctttttattatatataggaatataatgtttaattgttctatgttatcagaagagccacaaatatggcagaaaccggaagtcatcttgaacatctccttcgtcactcccacatcagatccaacaccaagtcaagacagttctacctcccaaatctcccagatccactttctgttcttcatctcttctgcccctatcctagtctaacactttggatcaagctacttctcacctgggatattgcagtatctcctcattagcctccctgaacacaccccatctgtccacagtcatgtgtcttcatcttcatctcctattccattttccacaacagccagaatgctctttttaaaaattcaaagctcagcatgagactccactcccctgtgacttcccagttccctaggataaaactgaaattcctttccacggccttgaaggccagggtcaatctgacccacctctcctctctaaacttagctcacaacattctcttcttccccaagtattttcctgccacatttactttccctgattcttccattctgccctgcaccctagaacacccccacacatcactccccctcctttaatgttatctcacccgaatcatctatcgtctgggcctcagtttaaatgtcacctctttgattcctgatccttaacagagaaggttagatctccttagtgtaagctttctaggaagcctctacatttcttttatattaattttatgataaatatctagttacttgtaggaatatttgtctaatatatgtaattctcactacatagtttgtttgatgggggcaaagtctgtaaatgccttatatgtcgtgaacctggtaaaatatcttgtagagaaggtgcttgataactgttatggatagttgaaaaaaatgaatgaatgaataattaaatgaaaaattgagcaaatgacaggaaaggaatagctctgatccaatacttggacaactaagttctagcgtgaattctgtaaaacttcagcatagctctctatgtgtctacacctcagtttccccttcttcagcatcatccctgtgaaccttccagctattctgttccatgtaaagagaaaatagcaggagacttcacagagtttccatcactggtcctaaaacacatgcaaaaccattggcacaaactcattaaagccaatgctttaggaccctgccactaaaagtgtggaccagcagcagcaataagcggccaggaattgtctagtgtgacagcagatttctaaacttgcattctcattccctgggtactcactgttgacaagggactttgcaggagaaattaaaggttaatatcaaatgaacttaaaatagagagatcagcctgaattgtccagatgggcccaaggtagaggcaatcagagaggtgtggtagaagaaggcaaaacaagcagaaggcagaaggggaagttagagagattcaaagtgtgagatggacttggcccacagccgaggaacttgcaacagacccaggctcagagcctccagaaagaatgcagcctgataacaccttgatttcaatcttgtaaaactcagagcagagaaccagctgagccgcaccgtacccagctgtcttacctacagaactgtgagttagtgaaggggtgcttttttaagctacaaagtttatagtaacttgtgatggcagcagtggaaactagcacaatgagaacacacctgctcaatcacaatatgtccttttgccagatcccaagttgatcttttcaagacatggttcaatgtcatagttactatcacagaatctgaagggaggctgcctgggttcaaatcctggctctgtcatttactagctgtgtgatcttagggaacacatttaacttctctgtgcccctgcttccccatttggatgatggtaatcctacctctcttccaggaacattttgaggattaaatgacaacccataaaagtacttaggacagtgcctatatgtattaggcaaaaacatgttggttactaatattacttaaaccagaattttttattcattgttgatccctctgcctccactaatatccaatccatcacccagctagttaatttacctcttgagtttctcttgaatctgtcctcttccctctatccccaccatgaccgtcctaggttggctatcatcatcacttcccagaagcactctgtgaatcttctctagttccgcaaagaagctaaagtgacttttcaaaatgcaaatctaatcacaatgctctcctgctaaaacctgtggctactggggtaaatacaggatccattaacatgtcctgcgaagtctgatacccctacacccatctcaatttcatttttctttctttttctttctttcttctctcttccctctcctctcttctcctctcttctctctctctttctctcctctactctctccccccttctctggccttcctttagcctgtcccggtggccaagcctccccgcactggaccctttgcagacatggttccctaaggctagagtgctggaatcacaggtccacaattgtgtttgttcttatttgttggatgtctgagtcccactccagactctaagcatgagggcaggagtgcatttgctttttctcatcgttgcataccccataattagcacagttgctggcacaaatactagctcagtaaacagttttttaatgaacaaatgaatgaataaaaataccgtggcacagttgaagaggcaggacaaataagatgttggtgcttcttttggtttgactcctacttgggggcagggagggcaagaattaaattatgtcagatggaaaacataaattcactggctggatcactgttgagttactgcaacctttgtgagtgtgtcacagactatgttggaagtagctgagcacaggaggagaaatcagaaattggttcagcaaaggggtcatctcaaaatatgctacaagtctaaggggttatataactaccaaaagctgaaaaattgtctttccacactctcaccatatctatcatttctttaggtttgctgcctagaaagatctcattgtcaggtattttttcccccaccaaaatatataaacctcagtttgcagctatctcactactaggttagccctcactgtccctttccgtattcaaccctccacctcccgcttccagctctgtaggtgtaaaacacgatgatccagagctggagaatgaagacccgcctatgctgttcccacacagaacacagcgtgaggaggtggcgagacattcgcagaccatagagggccctcgtatggggctggggcaacttgacctcagatgtctgtgccagaaaaaaaactgatgaacaggtacatcattcaggaatgtccaagctcacaaattctttatgaggccagcagaacttggaggcctgaaaccctcctccagaatctaactcataccccaccattctgtaatatgtattctctgggcttccatcactgaagttccgtctccctgtcttataagctccaaggaatgtagggaccatgtctaacattgagaattccagatacaggcaggtgctttaaacctgtagcttaatcaaatggttgtcaacgagacaacatcagcctccttttgttgtctcaggctaattattagacaattcagaaataaaatacagatgatgtttagccatgtcttactgaatgattcaaatcaaactcactctccaggtaatcggcagaatttctgactctgtgctggatccctccttcacctccctcctaaaccctctaccaagaggacatacaccatacccacccttccggatggcaagtttggaaatatgcttgcactgtgcacattggccactttctactactggtgctaagcaataacccagagtagcaagcagcctaagcctgggttgagatggcgacagtctttccgaaggactctaaggcaatgagcatagagcaatggctgtcagacttgagtggccatcagaatcaccgggacagcctgttcaaacacagattcctatctgccacccccacctcagaatttgtaattcagtagatccgaggtggaatctgagaatttatatttctaataaattcccagttgatgctgatgctgctggtcctaccttgagaaccaccaacactggtgttaactacatagtcttagtaatgatactagaaagatgtgggttcaagtcccagctcagccacttagcatgtaactttggataaagtattaaatctctcaaattctcactttcctcatctataaaaagaaagtattaacagcagcaatgctgaggattaaatgggtgatgcatctggaagcatacgaaacatccccaccccagaagacagagcccctttccctgcaccacacccagtccctgctctccccaggctgccggtgcaactctccttaacagggctgctataggaacatttgagcagtgggcagggcacagctaattgtctccacttgcctctgtccagtggtgtcctgtccacaagggcaatgctaagatgagcatcagcccacctcacagagcgcaaacaaggctattgcctgatgcttctggaagaatggtgtttcacatagctttttgccctgagactaagagataaagtaattcatccaaaaccacacagctaataatggcagagctccagagttaggacaatgcacctgctgactcgcctatactgaactgcatttgtaatcttgctgtattaatttcttatggctgctctaacagataactacaatttggtaccataaaacaatacatatttattccctcacacttctggaggtcagtagtcagcaatcagggtttcagtagggccaccctaccagagggtccaggggagaatccattttcttgtttttttcagcttctagagctgcattcctggcattcttttgctcatgaccccttcctccatcttcaaagccagcagtagcctcgttaaatctctcactctacagtgagagagattagatcaccttcttctgtagtaaattctccttctgttttcctcttctaagaacacttgtgattatattggtgccaccctgataatccaggataatctccccatttcaagatctttaacttaatcacatctgggaaatcccttttgctgtacaaggtaatactcacaggtcccagacatgaggacttggatatctttggaggccattttacggcctcccacacttggattttttgtctaattctctgagccaccatttttacttcagtgaagtggaaataataatatgtcctcatgagaacattaccatgtggtacacactaactcactgaataaatgtccgctggattgttgaatgcttcctgcaatactcttttgtgtgtatcttgcattaattcgttaactatttactcatctaacttttattaaacacttactatgtgttaagtactgagctgggcatagggaatataatataagggtatataaggatataatagaatacatttcctccctttacagattttatactgtaataaagggatctaaatgagggagcaaatgccctgatgtgttaacacgtgttatgaaaaggaattagagaggatatgctctaccgaatgggttgtcagtcccctgggcaggaggtaggagtggaaggatagagctggagataggaggctggaaagggacagggaggtgtgagcacctggaaagtgccaggaatttttccctgatggagccttggggctgtcttagtctgcttcctgctgctataacagaataccacaaactgggtagtttataaaaaataggactttatttggctcatggtcctggaggctggaaagtctaagatcaagcagctgcatttggtgagagccttcttgctatatcataacatggtagaaggcatgacatggcaagaaagcgtacatgtgtcagagagaaatgggagccaaacttcatctttttatcaggagccctctctcaccataacgaacccactttcacagtaatggcatagtccatttatgaaggcagagcccccatgacttaatcacctcttaaaggtctctcctcttgatactgtcataatggcaattaaatttcaacatgagttttggaggggacattcaaaccgtagcaggtcccaaggactgaggcacagtgggagagagatgagctaacaatgctgccaagggtctgactgcaatgaccctgggtgccatgtaaagaaatctgggtcatgttatgttctccaggagccactgcaaagtttaaagaggcccttctcagtattccatcctctgcagggatccaggactcctggcaggaaaccctgaaagctctgtcctcctcataaatattaaaataccaaattcacagaattgtctgtgaagtggtagtggtttccttaagtgcctcttgcctttgcctttcttcctcattgagaccttttatgatttatagtttcagaattttatttttagagcctcccattacagtgagccatcatctcccttgaacctctgtcaatctaatttataagtcatctgttcttaaaaatattcttatacctctggatcccatttaactctctaatctttgcagttcttttcatatgagaatgttcaaaaggtaaattcaccaaattaactattaggcagagaagaataattctgattgctcatgcggtattttttttccaacctggatggttttgctgagaagtggattgatggtaactgtgatgtgaatttatttgaaaatgtttgctttcctggatgcatagtccttggtctattttatcccttcactttacctcctgaaacttagcacccctctctaatatatttttgtcaactgatatcattctctccatgaacttcaataaattggcagtgaacttctgtgctggaaagacattttgcattaaaaactggattcacagcaggcaatctgcctggggaccacatgtctaagaaagcagtcatttttaactaaggatatttcaagcctagatagaatagggctggtgtgctctgaagccacaaatgtctagcctactaaaagcaaaattactgtactgcatgttggtaattaaccttgtcaactaactttcagaacaactccagcgtaatgtacacacctttcttttgagttatattgttgtgattcctggatcccattacattctacttgcaacctgcgttcctatcgctaccccttaccagcactccctgatttgcttgccctgttcagctttttggttcatagaatttagtagcttctaaccgtactaatcatgcaaaatttactagtttactttatatctcctgtgttatgatgtaaacttcaccaggaaggagatctgtgttttgcctactactgtatctcagatgcctggaatagtacctgacatgtagtaggcgctcaataattagatgatgaatgaattactgagtgccttttcatggagcttttaactatcgtgtcactgcttttcgcatccctaacgtccaatagtcaacttatttatttaccaaaatgtttcgatcacttcaccacatggcaagttgtggtctagatcacagaaaattactcttgaccttaaagagcaactagtccctgtcaaggagacacatatgtgcagaatcaccagttgatatacataattataaataaataaaattataaattaaaatataaattatcaatttaaatatatattaaattataaattaaaatatgtacaaagcacaaccaagcacagaaagaattaattcagctgcataatgatgtggtaggaaagattcagataattcttcacagaggaggctactttgagttgtagagaatgagtagaagtttgctggaagaagaaagaaaggagtgggcacacttcaaatggctgttctaagtgggagagtgtatcatgggcttgggggactggaagtctcttggaaacgccagagcatgaggatgtgtcttagttgacctcaacagcagctgaccttgagacaaagattcaagtccaagagtttttttaggggaggtcaaagaaaacgccagtggtgaagcaggagagtcagatagggaagggaatgcagccaatgaaggttatgtcatcaagccagttactgtaagctaccagaggggcaactggagttcaacgtcgtggagaaactctggaaaatggtatataacataggcctcagagtttccccactgatgaggcaatgtagctgtgcttttcatatactaaatctctgtcattggttgaggacaactcccgggggtcagttcgctccctcttctggcctgccatgtgtgcctgacagagcacaggcctcaaggaagtacaaagcaacactctcccctgtaagtttgtttctgcatatggatgtgatgaggccaaatggtgtgtgcagggcaccaaaagagtctgctacagtttgtaaggtgagcaatagaggatgagggtaaaattgaagcaagggccaaatttttaaggctcttgtatgtcattccttcgagctttattctgtattgagggagcagcgttgcaagattttaggtaggagagtggtctgataaggtttgaatttcagagagaacattctggctacagaatgaatgacagaattggcgtggggggtggagaatatcgagtccaggagaccaattaggaagataaatccaccatatggtatagaaatgattgagctaaaagacatgggctggtgctggagatggggatgagcagatggaatggagagctgttcaggagatagaacagactgaaattgtgagggattagatgtgaggagggatcggggatgactccctggcgcaggctcccctgattggatgatggtggcactcacctagattggaagcacaggaggggtatcagtgctgggctaaagtggtaaggcttgttgaacatggtaagttggagatacctgtaaagtatccaggtggagaatccagtgggcaatagatgcaggattattgaactcaggagaaagatctggactgagaagaattgtttagaaaccactactttatggaagagatttaagggcagagaagcagaagaaattccaggatacataactgaaagtttgccatgtgggatgagttaattgaatgttactatcaacatccattcgtatgaagtcctttgctaagctagagatgacctggcacctatcatccctgggtattgctttgcctttatttctctctgcatctttctaaaattattatttctttccctcagcctagctggatttggagagggaacaagacaaattgtgtgatttggggcaagctgtagaaactctaattattagcttcttcatctgtaaaatggggctcccataagtggagactggtttgtctgatagtcaattgaagaaactttcttgagaggctttccaaagctttctccctctcctgacctcaaaagatcttaagtctgggcatggtggctcacacctgtaatcccagcacttggggaggctgaggtgggaggatcactggaggccaaaaagttcaagactaacatcgacaacatagggaaatgctatgtctacaaaaataaaacaattagtcaggcatggcggtgcacgcctgtggtcccagctactcaggaggctgaggctagatgagtgcttaagcctgggagcttgaggctgcagtaagctgtgattgtgcctttgcactccagcctgggtgagagaatgagaccgtgtctcaaaaaaaaaatcaaagtcatgctcttgccctacaaggcacttaggtgggttgatacaaaatgctcctcactgcacccgccatgagcattcacccccagcaagcactgcaccttttacctgctaatgctggttcatcttttacctagcacttcataattgattaaatagcagctacgcttgggaccattctaaatggtcccagccactgagaccactgtgagaaaagccctttgtaactacttaccttctcttcgtgtgagttttatgccaagtatctacggatgtgcaactcttccgccagacagttctgctggccaaggacaggatggcccctctgaaggaatgtgtaggtgatgacatttctttcatcattttggtacctaaacatgacactctatctggcaacaatgaaaggcactcctgattgcttatggcatggctgtagggggaaggggctgtgagcgtctgcactatattttgctccatcaactcttgttatatgggttgatatagcaggagagataacaagagttgtgtgtcttgttgatatcacaagagttgtgtgttagagaaagaacacagccatccagcattgagcaggctgaaaatactgccactgacaaaatactgccattgacaaagtactgcctgtggcatgtggttaaacgcacagtgctacgccaggagttgcttagtttcaatacatctgctagatcattccaaccagctttcctatattcccaggctctggcaatgctaccaccattttcttaactcactcaagtttaagtccatcaactcgactcctttttctccactcatttcctatatgcaggttgtcatcatttatcagtcataatgacatttattcaccatttgttatattccagacaaaccctgtgctaagtgcctttaaatactttatcaaatttagtcattacaacaactttctgaggtagggttatttttatatttttttgcacctatggaaacgagggttagaaaagttaagtagcaagcctaaaacaccacacagctagaaagtggcagagctggaatatggatctggctttcccagccacttatgtaccatagtccctcctgcagagcattaaggatcttatctgcccctcctatatgtgacactttgaagtttccaaagcattgtcacaaagctatcatttgatcctccaagtggagcagagaactaggcaggacatgtatcattgtcatttccacagaagtgactaagccccacggggtttcaccgacctactcaaaaccatgcgtccatgccttggactcagatcttctctcttttcattattcccataaatatcattctttttgttcagagaagctgattcttctgtaatgacccatgtataaaatttcatgggaggccagatttagcctactacaaagatatttcagatagttgaagttttccaaaaatggaagaggaggtagtgagttcttcttccttttcggtattcattcaaacactgagcagtcactggctgggctagaaaatcattgagggaattcaacccattccctggggacagggtaaataaaggcagctagagtagatgagctctaaaagccatctgtccctgagatctgatggctcaattttctggggaccactctgtcctcaccattttggttgtagtggttccactccctcaccctggcttactgcagccatctcctggttgattttctggacgctgtctttcaattcatttagtctcccttgaccagggtgatcttcaccaaagttgtgcccagcatagactttatctctttctaaatcttcagtgactccctttgaccagctgtacccacttgatacccctctaactgatgttccgttatctgtctacatcctccatccaaggtcatttttcatttctctcgaactcagtttctacttcagtcaacccaatcatttgcctgctcccagagacatcagacttattctaccttcaaccctttgctttccttgtctctctctgaaacattctccactttccctcctgcccacttaaccacatcctccattctttcatgcccaaggcaatctgatttgcagttcaacaaacaaaaaaatggaatgaattcctcacacttaggaacaatcttccactcatacagtgaggccacggagaccccagaataagcaagagatggccctgtcctcggggaagagtataatcagaaccagctgctctggacaagacttagatttgaacacttgattctacattggctagttttcttgatagttgatgtgagctgattctatcccacaaagggtagaaagtgagccttcttccaacaccccacgccccatgcaagaaaatggtaggcaagcaaatagttccagattacatgattgaggagtctaggattgcatgtttgactttttccccacattcactcacacacacacacgtgcacacacacacacatatgtgtgtgtgcacgcagcccaccagtgatttgaatttctaggatattggaaggggggtgccatttaaacatgaaatctcatctctactactttcttgaaaaagggtatgtatagcaaaactctggttaaaagaggagagtttggagtctgacttcttggtttaagtcccagctctggcaacagctaggtgaccttaacagaccactaatgtctcattgcctcaactttctcaacaacaacaacaaaaagcaggccttggggatgatttaaaaaacaagcagtatacaatgcctttctcccaacagggtcaagttattgtaaggatcaagtaagttagtatttgtggagcactccgaacaattcctagcatatggtaatcatgaaataagtgttagctgttcttattattactaattcagtgaccttggacagactgcttacatttcctgagccttggtttcctcatctgtaagaggagagcaatgctcacctccataaactggctctgagaattaagtgtgaaaatattgagaaagcttttctagaaaagcttcccttatctttgacccaatgcctggacttacgctccccaaacaatacaactacaactttctcctctccctacttctttagccattttgcaagtctatcattcatgctactgttgtaagctggttgtttttattccatagaaaatgttggcctctgacaaattcatctttagaaaattataacctaaatgacactagacaattgcataagccaaagactgttcaagttccccaagcccacaggcagcttttccacagcccatccctgcccattttggcaaactgtgaacagcagagagaggaattggccttccccaggaaaatttggggccccaggcacatcataccatgtaaaatctggttaagataaatatcaagagcagccttgaaagcaaaaagaagtcacagcaggtcagacagcagccagagggagtttgggaaggggaggagggcctgagtcaccagctctgcctgagatgatcactagaatcgagtttccagggaaaggcaggcttcctgagctgtggatgctaagcctgcctggtagctgcagacctaagccatgggctaggctttgaaggcccaggacccccgatatggggcccagacttgtttcactggttgcttgttccctagagatgctgctaaagaggccaccaaggggaaagttacttaactaattcaggaaggtgtggtggcctccaagggagacgctgagggcctgcttggggtgggcttgataataatggagagtggaggccaggtgtggtggctcatgcctgtaatcccagcactttgggagaccaaggcaggcaggcgatccttctctgtaaggatcacctggggtcaggagtgcaagaccacctgattaacatggtgaaacccagtctctaccaaaaatacaaaaattagctgagtgtggtagcacacacctgtagtcccagctactcagaggctgaggcaggagaattgcttgaacctgggaagcagaggttgcagtaagccaagatcacaccactgcactccagcctgggtgacaaagcatgattctgtctaaaaaaattaaaaattaaaacaaaaaaaaatggggactggagtcagactccaagggggagagtttgaaggcactgcaatcggctcttctaccagagggactgaattgttctagaggccacatagactttctagagctacaatgtttctagcaaagtcagaggttttttgcaagctcctcctctgtcctctacatgactccgcaggacttctctgtaggactaggctgagaaggcaagttctcaggtccatatggtggagggagacagaggctacaatgccactggtggaacccggcgctctacagcatagatggggtagagagaagcatgtagagccttgaaaggagatatcaaggcattcaggaaaggaaaaaagagcaagaatgcattgagtcataccactctgaaatgttttgatgagtcaagcatcctctcatgatgttattaatgtcaaagaaacaattccttgggtttatattgaggttgcacaagttagctcacaaccaattcctgaccactgtgctaagagctgggtgaagatcagtgagtgtcacaaacaatattatattactctcaagagcttcctccataaggcaacaagaaggataatattaagcaatagaggaagagctgacctgcctttctgtccaatattggtttaagatgcccacaattttttaggaagtgaattgttctagaactgtagatttagtattgggggtcaaagggaagggggctgccatttcctgaatagaactttggtgccaaatagaaccatgcctggttgacttcttaaaagtaatacaatggttaatacaattggagtctgttttcttaaggggtccctgaagagttgtggagaagaaatccttttgaaatattttgtgtatacttactacgcatttctttttttgtttgtttttgagatggcgtctcgctgtcacccaggctggagtgcaatggtgcaattttggctcactgcaacctccatctcccgggttcaagcaattcgactgcctcagcctcccaagtagctgggactacaggcatgcgccaccactcctggctaattttttgtatttagtagagatggagtttcaccatgttggccaggctggtctcagatccacctgcctcagcctcccaaagtgctggggttacaggcgtgagccaccaccattactattacccagccattactatgcacttctaaatcaaccacagtatgagaaggaataatattacctgatattaggcaggagacaaacaggaactagcaaagtttggagcaattgaactcattttataaagctgaagagagattaagtacattattcaaagccaccagacaataagaagtgagttgagcgttgagtgtttctaaaggtctctctggtgtttgctctctggtgttgcttatctgagggacccagttttactcactggagtagcaacagctgaaaattattgagtgcttactagtgtgccagtatgtttcaaagcacatttcatgtgttaactaatttaatccatctggccattttcttagctgtgattatcaccattttacagatgagctgactgaggctcagagaggttatggaacttgcccaaggttacacatgtagccaagacagggctgaggttcacatctaggacacctggttccagatataggcacttcagttccccacctcttgggggaaggcatgcttccaagtggggagaagatagctcatcgtcatccgagcacacagtgggaatgagaggaatctcaaaaaggagaaagagccatcctctctactgtggaaccagtgaggttctagtcctggattccacactctggacagcctaaagctctgataggatgcaaaccacggggaaggacgttagtaggcaaggaaacacctgagctctctgacacctggatttggaagcctcctgcccctccacaccacattccccacccccatccatacaaacgccgctgccctcactttcattctcatctgtttatgtgctccacctcaatgaggtgggaaggactgtacaatgtgtcctgatacctgccaagtaggggagcccccacccactcagtgaagaagcaggtacagcccaagtgcagtgagcagtccatagggggaccaaggatcccaagttctgaacctgacttgatgaaactctgctggggaaaagccccatctgatggagattcacctatttctgaccgactttgacctcagcagcctaagaagggcacagccatggctctggaattttccacagcacagtgcaggaaaagctggctttgtttggtatagggaggctgtctccaggcgatgctaataataaaaaaaagaacgtgtgtaggttgcatctgaagcccaattgctttgcaaggtcattgtgcttggtctggagggtcattaattttagctgcctcattgccacccacatatgcaaccaatacattcctcaggggcaggagaaaaagcacaatttgggatccagtctgaccagggtttagatgatgttcacacaggattaacattctggtgcttaaattccttgatcaaatggagctgagacccctaactaccctacattattatctaatatttaatgagataacacaattaaagaaacagaatcataactaacctctgtcatccattcttctggtgctgtaggtctgttttctcatttgatccccaccacatcctatgagagagagagagagtattatccacatttacagaagaggaatgtccgggaaatatgtgatttgattaatttcacacagctggagaaggaagggacccaaaaatgtaacccaggacgggatgactccaaaatgtgtgtccttacccaatgtagtgcttcttacgatgctgacccgcagtaggcacggagcaaaccttgattcctgtctttatttccacacttcgtctttttgaaagcacaatttggtcactcccaataaatcattgggcagcccaacgaatcaaatgcttcttcagtcaccaagggacagaggcatcctgggtgccgcattccatacagacctgtcactgggcaaacctgcggatctcttagacagtgttaatgagaaccggtgaaagactaaactgtccgttacaaagctgcgaccagctatcatgcagctagagccccaggccttggtatgcagctcctcctctctccaggggcttctcttttctcttaattagagatttggctaaaatgtttgagcacttgaagtcagggcgtaaagaaataggaaaggagtgtgggagatgaatgatgagccagcactttctatgtgttgatgcagagaaagagaaagagggtaatttgaggatgttccttcccatggggcaatggagcagagaaagccacactgcagcggtattttcaaggggtttaaaagcaagttatgaaagccatgagggaggttcattgggttgctaaaaaaacgaaagaggatgataacaagtctcatccatgtgtcggtgtttcaggaattaaaagctgtaacaaggaacatttgggtggtattaagctctgtggggaggacttggggctttaactctcagtgcactagcacctctatgtagttcagaacctcaggaaggctctgtgggccacgctcctgaaaatttcacctgccatcttcatcactccaaagagaaaggaaatggcacatcccttaaggcctggcagtgtcgtgctcactcatgggaagcgctctcagcagcggcttcccctctcctgctgcgggcttgcatctcatgtggagagaggccccctttctcccggccctcagccctttcaagtcattcactttctcagtaagcgtctcccaagggtgacttgcatcaggttgtcggcgctgctttctgaaagataaataagttattctgtcaaattatgctcacttatttctgtcaacatgtattaaaacttagatatcgcctcaccgtgaatgcatcagacactgtactgttctcaccactagggtgggccctctgcagccacaaatagaggagacagttggggataaaatcataactgatgaatagagagactgagtgcactagcaaacctgtagaaattctaggctcacaggaatagcaaaagacagcccactaaataaagagactgtcaagaagcatttcacacctaacatgagcaataaatggattcccatccaccaacaacgtttttcatgattttcctcatccacaggttcaatgagaagctttgtaaatttattttgtttaactgcagacaataatcactctcagggctgggcatggtggctcatgcctgtaataccagcactttgggaggctgaggcgggcggatcacctgaggtcaggagttcaagaccagcctggccaacatggtgaaaccctgtctctactaaaaatacaaaaatcagctgggcgtggtggtgggcgcctgtagtcccagctactcggaaggctgaggaaggagaatggcttgaacatgggaggcagaggttgcagtgagctgaaaatgcgccacagcactccagcctgggcgaccgagcaagactctgtctcaaaaaaaaaaaaaaaaaaaaatcacactcaggtcttttacctccatcccacccccaaaccccaccctttgggtctggtcttacaaccagctgtttagaaacttaaaaaaaaaaaattgacacataaaaattgtgtgcatttatggtgtacagcaaaatgttttgaaatatgtatacattatggaatggctaaattaagttaatatatgcattacctcacatacttattttttgtgcatgatgagaacacttaaaatctactcttagtgattttcaagtacatgatacattgttatcaactctagtcaccatgttgtaccataaatctctcgaacttatccctcctgtctaactgaaatgttgtatcctttgaccaaaatccccccagtcttccccaccaccacagagaactgttaccataattgtggttgtaagctgtttctgaggagccagtttatttgttttgaacagaattaaacaacatagaaaatccctgtccagaccctcaaccaagttaattcattcaaaaaaatatttctgagttcctcttaggaacttacagcctaacgggcaaaacaaactgcttgtaaaatctgtttacttgatacatggaattgccttttaaagaatgatggccattttaacagagaaaataaatttggagggtataatcaatcattgagtaaatctgctttgtgaaacatgcctgctcaaagtttgtttgtttcacagtaaattcctttttgatgcccttacctcatcaagtagttgagatgaggcatgtactcagttctttctttttataaatagcaaagctacttggaacactaaagggggaaatgaatccataccagcaaatatcgtagaaagagcatgggctcagtctcagacacacctgggtcgcagcccagctctgccacttacctagttgaatgaacttatgcaagattttttaatctccctgagcctcagtttcttgtttataaaagaggtttttgtctggattaaatattacatagaacagcacttgtaatacagtaggcatccatgaataggagcttgtatgattgctacatcactactacattcaggtgcgtcagccaagacttcactttggatgtacttttttaactgcctgactgtggtcaagggccaaacgacggtggaaactagaaagatcaactcttaattctgccctttgaacaacgtgtaggctgaaggaaactaaatatttgtgtgtgtgtgttggatccacaatttacgatccatcctttttgcaggagtgccaacccatgaggttgccagagtagcatttcagagcatctgcacaaaccccacagatcaatgtcagtgcctgcctgagaatgaaaaagcaatgggaccaggaaggataagtcttgtcaatcaaaaacagaatatgcaggaaggacaagggcaagttgtccttgagagaatgggatagagaagagatttcctccagacacctccagggtagggatgtagaaccctctttctagctgcctaatgttcattctgtctttagtgcatccttgaggaaaggaagaagacagagttttccatctgccagatgtctcccttatcccaagttttattcatatatcaatttatttccattatcacaggaggtctcccaagcctcacttcaacagactggcttcccaagatggtggattggttgataccctttggacccatccccaaagacaggcaatactgattttgttttttggctaaaatgaagtattggcctgctaagacacaaactctttgtgtagatatttttttaaaaaaatattgtaaaatattcataatatatatttaccattttaactatttttagtgtgtagttctgtggcattaaatacattcacactgctctgcaaccattaccaccatccatctccagaccttcatcatcttcttccactgaaactctgtacccattaaataaccctttccccctacccttaggccctggaaactacaattctactttgtctctatcacttttactactccagttacctcatataagtaaaataatacaatattcgtgcttttgtgactggcttatttcatttagcatagtgtcttcaaggttcatccatgttgtagagtttgtcggaatttcctttctttttaaggctgaatgattgtgttgacttaaagatgttgcagtctcagttgatggcctcatagtttgagccttgctataaaactttatgcttaacaaagctttgaaaaacaactgatttcattagtacataagtagctgaaagtgttgctgagtatttattatagctggcgaaaaaaacatatagatgtttttaataaaaattatcttcacagaatggtatcttaagttggaaactacatgttggcatccttgcaaagagataatattatttgattaacacttgtgatagtagaatcactcatactctatgatttctggcatctgagtgacgaggcacataaataggcctcacagggaagtctacagataatttcataccccaaggttactcactgaaataactagatcaaaaaccaagcaactgaattctcatcaaattcctcccatcctctcttaccaatcatcttgctaaaaagtttttaaactcacatcataaaatatcatatttatgtatcgattaatttattcagtgtacatatttatttgctagaattctacaataaatttagctgtaaccaataaggaaatatgaggtataaaagaaagcgtagcatttgttcaggagaaatgaggctcttctggccatgtaaacctaaaaaaggattatacttcaatcttatgttgtaactttggatgctatgatacatgttcagttattctggaagactttataatgtttgcttagaatctggacttgttgatagtattctacagtgttatcaagagatggaataagcacagtaagccacttgtaactttttaaaatttataagtattaatttttaagctgtgtcttcaacttttgaggtagcattcctctccaagtgactacacttcctcagtgtctttgaaccattatagcataggatgagaaagaaactaaagggggaatggaacattttttgatcacaggagaaagatgatctggaaatcataacaatggatgaagatgccagaaagaagagcttgtaggatgaggtggaaaacaaaatactggctcctgaaggctctgttaaaagttgactttttgtaagaattttgtatatcatgcctgtcataaacattcagcttcattgtgcaatgaagacagatgacaagaatttgctgctccaaaaacaacaaaaaagagcaacttctctgtgtccttggaatctggtttcttcagttccaaacatgcagtgaaaacttgtgcctgtaagagctgggggcagttgcttatgtaactaattaaacatctacgtaaatatgagaatgggagaagccttctctattctcatcagctgttctaacgtgaagaggcatgcagacttgagagacaggcacagtttagttgtcttacactgacgctcttacataagcttcaaggtcatgaagttttcaccattttgtttccaaatagtaggaggaaaaaacaagttttacaagtcccttatcagggagggaaagggcttgggaaggtttaagttagcagaaaacttttgtagatcagacaaggattggagatgtgaggaagagattaaacacagaggaactggtggagaaatattctgaggaaagaagattataacagtagatggggaattgacaatagccaggaagagtggcagacctttcttttggagacagaagataagtaaaaagccaaagagaagacagagatgacttttgacattgagaaaaaaaaaagccaagggaactcagacatcttattgcaaatgaggaggtgatgtctccttttgcagaagaatgggtggaacttgggctttgggatggcttggcctaccccaggtgggggatgcaagctagagattggaagagatgaatgaagggataatcgcacagtgacagggagtcacctaggatgatgtagacttatagtatggcataagaagctgtgtctggaggatgtatttaaaatcttggagatggggtaatcttttggggtcattatatctaaggcagcacattgtgagtgccaacagaggccattatagttgagtagattgaagacatgcaaagccagagtattaaagccacctactggtttatgaaagccaatgagaaggcaaacaagagatacagaagaaaatttaaaattttcacagttatatcttaataaccctcgactaacctaacgatgcctcatctgtatgataaagactttgagcgcagacatgatataactctcagaaccttctaagtagcatttgatttagcagagcaaggtgttttagtttaaaatcctatcctagcattggatctgacacatcatggaaatgaggatagatgaatatgaggagttctgcccattcctacaggcactgatgtcaaggcaaagtaattgtctttgcctctgggtctagcagagtcctgtgtacacccttgctcttctgttctggtttttaatctggcctgtctgaggaagtagaagtcccttggctagcaattgtgttataactatctataaatcactcgcataaaatctttgagaacccacgagtagggtctttttaatttgtatgtctctacatctcccttagtagctggcatgtatgtagtgttaaaaaatatatccataaaatgaatgaatggataagctgtgctctctgagtccacatttctctagaatacgatttttgtgaggttttcagcttctatgaacctctccattcttgttccactcagcatatttttttgaaagatacatagatatcatctaactgtaaaaacaaatcgtttgcactggcccctgtaggcaaggtctgcttcttcccactgagtctgccttgggtcctctgctcttaattttgctggtacctggactgataatcaccctgctcaattgattgtgcctcctacaacaatagtggaagccataaataagaggtgaagtgaaggagcctgaataaatataaagaaggctgcataactatgatgatgcctgtagtcagtgacacagtctcagcttgaaatcaccactcctgctagatggaggtcacagcttttttctgtctcagggctactggttaccaagaatgtaaccagtccagtcaacacctttgtatgagttaataaaaggtgtccctctacagaggcaggcgcagcctacaccagagtgcctggcatggtgaagcaaatgggctggatgtcagcctccactggaccattcgggtgggtaggcaccttgtgcagtgaacaacctgcatacctgctggtatgcctttgcccctgctggttatgcactcttttgggcctaggtctcctgggaagtttcctagtcagtcctgaagtaagaatcacagtcccattcccattctaaaaattgtatataagtttcccagtccaaactgtaccttggtaacaatgaggagacatagaggaacagagcccggggtgtgcagggtgtgctgtgattagatgtttgcatcactctgaacatgcacttttcccttctgttaacaaaatgaatagaataaccctacatgaaaggctttttctgctacataaaggcaaactctagttgtctcttcacagtcatctttggggtttagtgctagcaagtgtaaaatttacatatataagatttacttacatgctagctgtaccagtccagtaaagcgatgggggaaagagggatgaatttccctcatttcctcaccagtcaagtctaggtttccagggttcttttcaatgcaactatgctaaatcaggcagtgaatcttggagttgcagtaagacaacgtgattaaaccctgggcgggtcctgctatctcaccccaccagctggatctcagattgacagtgttcagacatggcttatgggggctgtcagagttggagggggttgaggtccagtggaggttgtgtctctgccaaaatctgaaaccatattttctgggcatgaccagtctctaaaccagaaaaagtggctctgtggatctgaccaaagaagcctgtcaattttttttaagacaatagcaggttaggatgagtgcaatgagggttggattcagtgagtagaggcccatctttgagtctatgagatttactttccatgagattggcctccctctgccacctttgctgtgggagtaatttcttaaaatgtttccaagaaacttgtgaggctggatttgcttctgttgcagggccccatatgtgtttttccttgggaaagataaaatttccaattaaaggaagaattccctggctatttcttcactattactctttcagagtgagatgtagcttacaatcacccaatgtcagccaagactcagcacccattcttgaccagtaaccatgattaccacacctctaccccatggggtggtaagaaaagatctaggtgggtcctgctcattgcttgacttgaaccaagactatacggccctctgtggaccaggagacctcagcttttaatggaaaagtcagcaggagttcagtaaaggggtctggtgggaagccccgcttggccttccctacttataaaatctgtaacacatgttgactagattcagaaatatgtcattgcctcataactttttgaggttccaacttctggagcccccgggagaggagcagttgttatgataaggtcaggatttgggactagcagctgaagccattcagggcctctcctctctgtgttgtctgcattgctttcaggcagccacagagatctggctgctctcagactgacagcccaggcaggcttgccatgtagaaatgaaataaacaactagattttgttccccaggagaatatgttgatgagcatggccactgccagacctgtgaggcctcatgtgccaagtgccagggaccaacccaggaagactgcactacctgccccatgacaaggtaagtggcttctcaggatctcccggtggtgtgagctcatggattgcagggtggagagaggaggtgctcaccatcttagcagcacctcatgggcctgcagtgaaaaagaagcaaactctttcccactccacagatattctccttggtctgggcacagcccagctctgtagtatcctctccccatgacgcccagtccccaccacaaggaccagttccctggacatggaacagatttcctcatcaatcaatagggtgcctttgatgcctgaaatctcatccttttctgcatacccgtccctcaatcatcatttccatctgctggtcaagtatctacttatttctagagtcagttcaaaagtgaactgttcttttttttttttttgagacagagtcttgctctgtcacccaagttggagtgcagtggcgcgatctctgctcacggcaacctccgcctcccgggttcaagcaattctcctgcctgagcctccctagaagctgggattataggcgcccaccaccacgcctggctaacttttgtgtcatttagtagagatggggtttcaccatgttggccatggtgggttctatgtctgcttcctctcctatttctgaatggtcttgacctcctgacctcaggtgatctgcccgcctcagcctcccaaagtgctggggttacaaggggtgaactgtttttaaaggcatttctgacctcttcccagtaaaaataatctcttcccagcaaaaattaaccatttttatgtccctttgctctctataagcttccataagagcagctgtagcctttgaaggttttcatttacaaagctatctcttcattagactgtaagccacttgagatactcatctttgatctctagtacctaccacagttcggggataatagcaggcactcagtaatgtttgctaactgagttaatgagggaatagcaagtatgcaaatggaatgagcatctttgctaatacactgggaatttctaataaagaaagctggaggcctgttttattttcagtcaatgctcctctgagcctagcactgaatattttttggctaccgagtatttcagtgaatggcctcatcactgccctgcccaatgcaaaggaagcaggtctcttgcaggcaagggtgatgaggctgctccagtggcaggcgctttgcatctctgggatggacatgccctctgctttgcattatggtcattttgtcctacttctgcaagactataatattcttgcaagcgggtgctgtggtgtgttttttcctttattccccacagtgatcaacacataattcaataaatgtgctttattgaacttgatgaagtgtggaatcaatatcataggtttggctctccaaatagctccctcagaaagaggaaggaagaaaggaaagaatgaataagagaaggaaaagaggaaagaaggaaggagaaaggaccgaagaagacacaaaggaacagttttaagaatttttaatgctaaccatgagcatatttttccaagtgtctctttaaaataactatgcctctaaatattgaatttgctttaaagaagcatcaggacttactctaagatacagatagcattctcaaaatgaggttctgttttttctccaattccccaccataccaacaatcaaatgccaatgcatgtttggacgtcttttgaactaggggaatattttaacatttgtttaataaggcagctaccacccttcttttacaattttataaaccactgggtttagctccttaaagacaattaaaaacctggagaaagcaagtgacctctttgccactgtatttaacatgcaaagctctgtgatgccaggatcctcattgcccaacctaatttccctgcccagtcctgaaggagttagagagtcagtgaactaattaaaaatatttcaaagttacctctgttctgacccatgctcaaacattgtatttgatctatttcaatgaattcagagaaaaaaatctttttactagatttcattcttttagaatattaaagaaccaagaaattacactaagtgctgttttaatggctttaattaggccaagtcaacaatcagcaaagaggaccagctaaccctgacatgctgtctctttcattacagttcatgtcacacacacatctgggggccttctggaatactcagcgccagtgttaagatcatctctgcccagctgcttagcacttggttccactgcattctccctttctttcagccctgtttggtctggaatggttcacttcctatgaaaaggtcaagagctggcatgagttggggaaagaagctcttcccctgcagagatgagcttgcctgggcatctcaggaatccatgaattggatgactggtggtcccagagatgccttgagttggctttaaggaacattttcatcagacccattttctacttttatagagaaaaatatctattctcttccactagggaaaatttgttggtgtctgttgaaaactgtggccatttgaaatgggatttttcttcaagtttcttagcaatattttggggggaggttggagaatgtggggtgggtcgtggtgacataactcagtgccttcacttaagcataactgtcttccctatctttctatctttagaaataatcatcctcttacaaaaactggagatctcacctatgcttttgttagggtggacatggagggaatggtttaaagcataattatgtgattgatatgttcctcaaatcaagtcaaaaagacagcccctttcctacataaacatggaagggttctatatctgcttcctctcctatttctgagtggtttttaatggttcccattaatgggagattacttctcccaagacaaatgatttcccccccaaaccaatctgtcatctcatcttggacaggggtccccaaactccaggccatgaactgatattggttcatggcctattaggagctgggctgcacagcagcaggtgagcagcaagtgagcaagtgaagcctcgtctgtatttatagccactccccgttgctcatattactgcctgagctccatctcctgtcacatcagcagcagcattagattctcataggaatgtgaaccatattgtgcactgcccatgtgaggaatctaggttgcgtgctcattatgagaatctaatgcctgatgatctctcactgcctcccgtcatccccagatgagaccatctagttgcaggaaaacaagctcagggctcccactgattctgcattacggttagttgcataattatttcattatatatcacaatgtaataataatagaaatgaagtgcacaataaatgtaatgcacttgaatcatcccaaaaccatcctctgccccccatttgtagaaaaattgccttccatgaaactggtctgtactagattgttctcatgctgctatgaagaaatactcgagactgggtaatttataaagaaaagaggtttagttgactcatagttctgcatgactgggaaggtctcaggaatcttacaatcatggcagaaggcaaaggggaggaaaggctccttcttcacagggtggcaggaaggagaagtgctgagcaaagggggaaaatccctttataaaaccatgagctcttgtgagaactcactcactatcacgagaacagcatgaggataaccgcccccatgattcagttacatcccacttggtccctcccacgactcggatcatgagaactataattcaagatgagattttgggtggggacacagccaaatcaaatgacagtgcctagtgccaaaaaggccggggaccactgctataaaagataaaatgatgatgtacttcacatccctttctcaattgattttagcaagaaaataaatccccagaataaactcgccccattctctttttcagcagaacattgaatagcttccttgcttaaaatcctcagaaagctcttccacagtttttcttatagaaagattttgggtttttttgtttgtttgtttgttcattttaaactagccacatccagactattccttgaaaagtcttctagctcagtaactggtgccagggtggggctgggatattcccctttggcattagtgccatccgctaaaaatctgggctgggagcacaggcatctcattctatgccatggtgcaggggatctgttttgacatggacagccagatgtgtgtgagtgtctgtttaggactgggactcatactctgcagtggaccaaaaggattgttcattcaatggtgctgcggatggttaacagaacatgagggcctaggaatccaagagagaggtggacttctctcttaggttgtcggcttgaatcccattctgcctccaaacagatgcaaatgacacagactttcagggtatgggaatgaatgagatggaagactgcaagtgacatactattcaggatgccttgtcccacccaaccttcttccaaacctgggattgaaatggcccaccccccagttcagggttggttctagctctggaaacagtgaagtttaaacaagccagtgccaatacaggaacaaggtgcttgaggcctacatctgatctttcgtgtggtgtccagcataagtggagaggagtagtagagagaaaaagacatccttccctttcttcgcaggcccactcagatgtcccaggcctggatggcagcattatgcccacgggagcttgcgtatgctatgtgctcagtgaacctcacaattgatacaataacttattctaagggagctgtaagagatgccaatttgatgtcacctgtattacataggaatcatttagcgaattccacagtaatccagactgtcactgagcagcggatctcaaagagtgctcaccagaccagcagcactggcatcatctggaatgccagaaatgaaaattctcagctgcctccccttaagtcccactaaattaggaactctgggtgtgcagcccccagctcacttcatcgattcatattacctatctgactcttgcacttgataaacattttgtatttttctgaacagaatacttggatacaatttacttagtcacatttgctcttacgattagtttgcaaagaataatgaagcaaaactataaaaatattaacaatgacattaggatatacattgtatatatgtaaaaccaaagttttagaagcccatataccaactcacctgtaatgccctttgtaggtgttcacagtaggtgttcatggtcagaaaaggagactgcagtactccatatctcaggaaatgtttgcaaaacatgacactcaaaatcagagttcattgattacttgcaatatacacaggccaggcttctaagtagcatccgagctacaaagcagtgttttgtttcactcgtcaagagcccttggagctgacatttcccttgcaaagcatgagcatgctgatagataaaggaagaatattttctccaaggcctctctcagaggcccactgagtgtgtggaaagtttacagacctccatctgactgttggctgggtttggttggggcctataatctggatttcgtccctgtaggcaccagttagcttgtttggaagcagattcgggattgttttcccagccagtttctggcatgctggctgttaggtccaaatcttgggccaaggatgggtacgtgactaatatttcacatgttctaagatgatcactcccaggcatcccccttgtttctggaacaatgaagtcaaatctgtccagcaaacatgaataccacatgttctgatacttagggccactctggaaagtcaccctgatgaattctaaaagtctgcttttcctctaggatttttgatgatggccgctgtgtttcgaactgcccctcatggaaatttgaatttgagaaccaatgccatccatgccaccacacctgccagagatgccaaggaagtggccctacccactgcacctcctgtggagcaggtgagagactgctgctcctccgtcttctgcaccccaaacctgttcctcttctgatggccatcatttggtttgacccaaaagccttgtgtctggggctgagggttaagatcagacagctgttcactggagagcgtgtacaaccttgaactttctgcttgctgtcagtacacaaaaagcttgttcaccttattcgggtgtagactcggtgccctggaaaagatgagaaagcagctaagagatgcctttccagagaaggagagagaaggacgtagaagcatgaggtcagacatgagatagacagtgaagttaagatttgtggaggtaaaagtgaagacctggggaattaagaaagacacgttctgtctttaagggaagtatgccacttagaagttgccagagctcggcagagcaaggtcatcgtttcaaatgattacaaatgtgaccttttgtgtcccagatttacctgcactaaaagtttcctgctgtcattggattctatttcatgctctcaagggttctctgcattctgacccttgactcctttccagcctcaactcatatgcctgtcccctaccgacctcatgtgggccagattcatattttatttttttctatatactactttttaaatttgagtcaaatttaaaaattgggacattgcaaataaaaacttgagggtttaatgtctcttgaaaattcaaaagatctgccaacactggacctgcgtttcccaaatcattacctggagtccaaaagaggctgctctccatctctccccagtccccaccattcccagttgtctcactgatcctgaggctgtcagttaccagcatcatcatccttacatcatttttctggtggaagagaattattgatctttattcttccttgaaataaaccaagaaaaatgaagaacacattgagagtaccaggcatttgcaggagatcaggagataacacatttctgtatataaattcattgctttgtgtttcatgtgtcaaaacatgacaaatatctgtcatattttacttctagactgccttattctgtttccttcttcatctacaaggtgatgataatgcttacttctttaagagtttttatgaaaattaaatgacatgaaatgagataaaacaataaagcatttagaacagggctagccacatggtgagcacttggaatattaactgtttttatttttattattattactgttattgtttgtagctgcttagtcttttgagcatttgagtttctcttgctcctaagacttcatttgagatgtttcctcttctctggctgatgtcttcctattccatcttagtttcaacatcatttcctcagtgagggctgccctaacctccttgcctagattaggccttcacatcagcaacctgggaacgctgcacttcccccttcatgagcctcaacacatttgatgtctatttggtccataagtttctatgccccataagagcatggcatggtttctaccttgtttctgctgtattttaagcatcagcacagtgtctggtatatggaaggttcataataaataactgaatgaattaatgaatgaatggttcaatggaaggaatgttaagaccagcagtcagaaaatgtgggttcaagtcccgcctttgttactgacgagaaggtactaaaccagtcacttcacctctttatgcctcttcttatttgcaacaaaaaaaaagaagaagaagaagaagagaaagtacaagatggcatccaaaatcacttttacatctccatatatagcacaaaattagaaagaagtttagataccaaacaaatgtctagtcttctaagcatcctacaactacttggaccaatctacctataaatgcactgacatttcttctatttttttttctatttgaaattgtgtttaatccattatcttaaacatttattgcatcccttctatttacaagttactatgccctgaatgccagagaaaatgagataaatgatagcatgatactcatgttcaaggaattacagtctaacaaggaggtttgtcctcatatgttacaaaacaagaaaataatagatgaagaccaaatgcatggtagaaatcctatcccagatcagagaagcagcatcacttccagctgtaatgagcagagaaggcttcctcgaggtggggtgttgtttaccaagccctgaggtagctctgcctccttgagagtgtgatgtccttaagaagcattagtgaagcaagtgtagcagagaccttgataacacagtgctgaagaagatggatgacttaattgaagaagttccatatccataaatggaagctttaataaaaggctaaaaatcctccagccggggtgtcccatcaaccttcataagcccctcctaccaatttgtagagattgcatcccttgtttaattgtgacttcattaaggtttaggtatgatgcctcttggaagtgtacatctccagctatattgctgaggattcactccaattctcttccagatttattcactaccaaactacccaaagctaaattccatcaatcacacaacagctacagtaagcaaaatgtggtagtcaacttcatcaagtttattttcagaatccctgcacctttcttttatcctttccagcagtccttttcgcctcatgccttcaaccctcaccctttcttttcttctatggacatccaatatcatcatgctggtccactttctcacctaacagaatcagctgccaagaaatgctctggtaaaagtgaattactctccagaataaacaaaagccaatccaaactcttgtcccctattatcccatttgaactcttgtcgcctgttttcccaggaaagtttttggtgcctaacaaaagtatcagcccttctaccgctggaaatagcttcgtctacatactattataataatttaaagtcgaagaccctgggcaagtagccaaaaatttatgcatggtatttaaatttctgagctatccaaattatcatccataactaattgagcagggctactcaaaatctgaccgaatcttgacatagtcctggaccaaacctgtcggaaaagctggtcatggccaaggcatctaagtgacctccctttgtaggtctatgtattttaaacactgagaccccctgaaatctctgttctttaaacccaaattataacacccaaagaggcacctcaataaagccatgtccaaacaataaaaatgggattgaagaacacttccttctaaatctgggcccgtcgttgctaatttttaagattgatgatccagttggatataggggaaaaattgaatattgccaaattccacaaatacatatttagagccttagactccctctaagcatctggatcctgagttgatgtcttgtgaaggtgcaggggatggagaagaggtagacttcctcactgctctccctcaaatcttcctacctacaccagagaaattggggaactctgaaaaaaagatttttttctcaatgagtcatggtggatggaagtggcatttgcaacggtttcataaagtggcttagaacataacttggaaggatgaccctcttgtgatcttcagagattccaggttccaccagatcagagtcttgtgctccacaatgttgatcgatagctatagaatcaccaaatgcacattagtccttccaaaccctcttctttccttagaggataatctcttctatgtctaatttagaaacagcagaatattttcttccaccacctctgtggaagccctttttattttcttagtcctatgggaaccagtagccttctagtagaaaatcacaattagcaaaataggtagcttgagagcccataatccaaaagcatgttttaaaaattgcatttcaggcgaggcacagtggctcacgcctgtaatcccagaactttgggaggccaagccaggcagatcacttgagtccaggagttcaagaccagcctgggcaacatggtgaaaccctatctctacaaaacatacaaaaaaaaaaaaaatggttgggcatggtggcacgcacctgtggttctagctacttgaaaggctgaggtgggaggatcacttgagcccaggagaggaggttgcagtaagctgagatcatgccactgcattccagcctggacaacagagtgagaccctgtctcaaaaaaaagaaaatgtatttcaactattgcttttaataaataagaaatattatgataaatgatgtgaaagtgccatgctcacaggtaaaaaatagttaaatatcagcaatttcacgtgggtcaatttaacattatactgactctcagtttctgcacttgcaacatggggttagtgctatctttatccacaaattcagcagccttgcatcttgaaggtcaatgattctggatctccatgtggtagatcacatgacgaatgaaccctagaccccggttattctgagtaacacagatcagctgctcttcagaggcagggacatgtgggaaatctgattcagagaagatggataccccgagcacactcagcacaaaaactccgggagggtgggagtaggagacctctagatgcatcagtagtcatcttattgttgtttttgtattcctaacggattagaatcctttgtaactaattgtgatgctttgtaactagttagactttttcattccctccagaaacaaattcccatggtctgttaggctgtgggcactgctgattctttccttatagaatccaatgttgacaaaagtcaggaaccctcaggaatgcacgtaaaagagtcaaagaagtgtgcttggtctagtgcttcaataagcttgtcattatcggcattggcagctctgcagaaattcagaccttagatggttaacgcaagcatgtgaccgataacaattcaaaatcattttaaaagattgcactttcataaaaagtgtcgatcattatgcatgtgtttattctcatgggctctctatagcccccaagtctgagagctttcacagataccaaaaggagcctttgggaaagttaaacacattttgaattgtagttaaacacaatgtgaattgtagttattcacagagcatcgttttgcaatgacatcccagatagtagtcgctgttcactgaaatatataaaatattggaaaataattccctgcaaggaaaacttctcaactacaaggatgtagctattgcacttttcattaaatccatccttacacccctcatccactaggaaaaaaaagcactcagtcgcatctttttaaaatataatatcttacattataatagcttcatggctaactttgtacattttccctcttttcgttgcccctgtaactgatcagacaactatggccgagagcacttcctgtaccagggagagtgtggagatagctgcccagagggccactatgccactgaggggaacacctgcctgccctgcccagacaactgtgagctttgccacagcgtgcatgtctgcacaagatgcatgaagggctacttcatagcgcccaccaaccacacatgccagaagttagagtgtggacaaggtaagcctgctcctgggcccttgcccagcacccgaacatgggaggaggggctgcaccctggatgtcctggagacttgaattgccttcctggcttgcatgtcagcacttgggatgattttgggtgactcccaaccctagtggggagagaggtaactttctctctccctctctgttcacacaccctttctctgggtttcctcagatataatccaaggtcataggaatgcacttaagtgtatagaaaattggccaggtgcagtggctcatgcctgtaatcccagcactttgggaggctgaggcaggtggatcacttgaggccaggagttcgagaccagcctgggggaacacggtgaaactctgtctctactaaacatacaaaaattagccaggcttggtgttgcatgcctataatcccagctacacaggaggttgaggcaggagaatggcttgaacccaggaggcagaggttgcagtgatccgagatcacaccaccgcactccagcctgggagacagagcaagactccatctcaaaaaaaaaaaaaaagaaaaaaaagaaaagtaagaaagaaaaagaaaatgatcttggcgggtggggggattgtggacaggatataggtgagagaaaataaaattcgaatccaaaagtctgggtcaacagttttctccttcccaattactagacatgagaccctaggcaaaactcatctaatttgcccatgccttggtgtcttcatctgtcaaaggaagagcacagcatcaagacagagtggctttgagaagccagtgaggaccagcctaaaaccacttgaaaatattaaaatgttctgtgaatcgtatgtgttattgttattgcccagtttcttatcttttatgggaagaaggaaattaaaaaacaacacttatagtttcggctctcttctatgtaagaatgccacggactgttattgccctgctctgtataagaattatgcccggtctggtgctgaagagagctccaagacatttttagcataattaagacactcaattctgtttctccttaatgtttatgaatgtagtaaaagattttaaacttttttaaaaagtgtttagtagcacagatagaaagagaaaaagaacctgttcatttacatacccaattccattttcccagaagcagagctggcttctttaataaataaaatcaatgagcttgacttcaaaatgagctgcatggcatatggtccaacctggttctctttgtacccaatcaagctgattcaatctattcaattaatagaaggagattaaaaagtagaaaccacatatatcctcgaggacggttttgggcttcataattgctctatgatttactttaaaataagctacacacgaacatatttttgtagcaattaacgtgtctccactcaatggaaatgagttgtgtttttcacttctctgtctgtgtaggtgaagtccaagacccagactatgaagaatgtgtcccttgtgaagaaggatgtctgggatgcagcttgggtatgtcctcttcctttgtcacctaaagagttgaaatagctaagtccttttccacacatcttcatcctgtcattgccccagcaggcactcttgtcattgctgtcagcctcagtgacaccatcaacgtcttaagtaggctttcttcaatacaaacaggatcactgtgaggaaatacttgcttttgaagcaatgaatgggtttcttgtctttatgaaactcaagtttagaaaaggaggccatggcaccttttcctctggttgtcaatgagttgttggggcttactgaccagcaaccgcatttcaggtgcctgagactcagcctctccttagcttctcaaggtgacacatttggaagattaacagtgaatgaactcaagcaaagaaatgcctaattcctctaactcacttgatgtgtaaaacacagaagtttgtgggtagagggagggggggtttcctttataaaaatgactctgttgggctgggcacagtggctcatgcctgtaatcccagcactttgggaggccaaggtgggtggatcacctgaggtcaggagttcgagaccagcctgtccaacatggtgaaaacccatctctactaaaaatacaaaaattagctggatgtggtagcaggcacctgtaatcccagctattcgggaggctgaggcaggagaattgcttgaacccaggagtcagaggttgcagtgagccaagatcgtgccattgcactccagcctgggcgacagagccagactccatcttaaaacaataaaaatgaaaataaaaatgactctgttgcttggagcctaagacaacccttagagaatcaagcatcgtggtaacagtggagttgaattccccatcatgcaatgcaaagcacttgtcactctcacatgtaactctttaattcaagtcagtggctccttctttcttcccttctcacatgcctgcaggagatgatggagacagtttgttaaccacatggcaccattgcattggcgataaaatgaaaaatagggaggttactgaattccaggattgtttcttaatgtacgtttaggcaacatataaaaaataattagcatgtgtgatctttgaaaggaaactcaactgaaaagttcatggaataatttgtcttcatggaacttccatgaagccctgggattggttgactaatcaaccactgaagcttctaaaacttcaacgtgggcacaaatcacctggggaatttgttgaaatgcagattctgattcactgatctaaggtgggcctgaggatttgtgtttctgacaagttgcccagtgaggctaatgctgttctatagaacactcatgaagttactaggggtaagattgtgccagaataaagcagactttttatttgccttacccaatggattttcttaatttttttcttactaatacataatagttttacatatttaggggatacatgtgatactttgatatttgcatatgatgtgtgatgatcaagtcagggtaactggtatatcatcacctcacacatttatcatttcgttgtgctaggaatattctaaatcttctctttgagctaatttgaaattaatacttaaatattatatatgaattataatttatattgtggctatcaccaccactctttgccttaaatggaaaagatacattttctataatatctgtaactagaaaatacagtttctggaagcttaaataccattgccccattatcttccactataaaatgatgcttatattactggataataaaatctcataataaagttaataaacacttaagaagaagataaaatttagagtcagatatttaagggtaaaatgctaattacctgggaagcaaaaaataaacctaggcataaataataaaagtactgaagtaaaaaactataagcaaattccagtgtctgtctcatgtgaagtgatagaagatgagtttgcacagagcaatgatgaatgttttgattatcttgatttcactgtttgcccatttcagatgtattttcccattaagtttcacaccccagctaatttctgtggtcttctctggcatctttgctgttgtgtgttgtgtgcccatactagcatctttgtgcatcttggaggcgggttgtgtgtaatctaaaatctgaggtttgggctctcttggctctgctcagtgatgagagtggggcaagtctacccagcaagatacacatagagaaaagaagatcttccttccatagcttcaagacaccttgacaggaatgtatgaatgtgtgtgaactccttcaggttcagtgaggatcttatcatggaggtgggaacagtgacaagaaaaccatggtcactaggtgttcgcattggcctcattctccacttagctgacccagctaaagatgagaccaaggggaagtcactggaaatggactccacagcagacactgaccctctggggactcaaaatccaaaagactcaccttgcaaaaaaagatagattaggaagtttgatttacttgatttactttacaaagcactattaagctcttcagtccattcattacttaagaaactttgtctactgtgtgctgagtgctcgccttgatggggagaatttcaaaggtgatatggctgtgatcctactataagggatagcaggatctgtcccaagtgatacacctggaatgaaacctcttagaagacaacctgccagagtagagacaggtataaagtgcagtgacaccaccagaaagggtgacaagaccattctaaatacctctaatttctcattttaaattctaaaatgcccttaatttataatatctgtatgtattgggcctcatttattcttggatagacttggctgaacccaattgtcaccttatttctgaaccctttgttgatctctccaatagaataaattctcccttttctagtttccctttgttaggccagcgagaataccttttagaggtgactagtgtaatatttgctatgtatacacctttctgcctggacactaaactacctgagaacaagctctttgacttatatgctctgaactagcagagtgcccaggacataataaatatgaattaatgcatgaatgtttgttgaattgaatttgagaattgcccaaattcaaagcagagatgaatggcttaggatacccagggtcttagatttgctgttttctctaatcaaactttgtttatgaaccaagaagaagaaaaaataaaccatacaatacaaaaataaatgattttggccaagtgcaatggctcacgcctataattccagcactttgaaaggccaaggtgggcagatcacttgagcccaggagtttgagaccagtctgggaagcatggtgaaaccctgtctctacaacaaaatacagaaaactagccaagtgtgatggcatgcacctgtggtcccagctactcaggaagttgaggtgggaggatcacctgagcctgggaagtcaaggctgcagtgagccgtattcatgccactgcactccagcctgggcaacagagcaagatcctttctctaaataaataaatatttaaaattaaaaaatgatttttcatgaactattagaactataaggaagctttgatcagaccatggtttaagttttataattttaaagagataaatacaaacttgaaaaatttgaataatttactatagatttccccaagattcctcctgtgagaagggacatcatcctttggagagaacttaactttattccattttaataatgtagattcacctctgggccaggtctagacgatctctaggggagtcagagaaaagtgaaatcagttattgtgagacatttcatctacattatgtaataattagctgttgaaaatcctggggttttttttttttttttttagctttgtattcctttccagctatttagtgaacattaatatctatcttttatacctaacaaaaaaaaccctcaaattccagattaactagaatctcatctatttcctgggtggacctagctatctgttattccaaggaaagattaccaaaaagggggcagaaaactaaactcatgaccaaaaatgattgtttcgtctggaagaaagtgttgaattaaatactttgagacgaaataaggattttttaaattatgagattcgatttctcttctttgtcaagttgtaaacaaatagataacattttatataatactattctgctccaagaatatttgatgtcaattctttctctttctaaccagtatcctgaatggaaattttaactactaagataaatctaagttttaaattatatttcttcactagctgaggatagaagtaaatggagtaacttttacctaatgttttgaggcacattttttgtttgtttgtttgttttaatttagggaatgtagcaatagctatgactcttaactataacctgagatccagacatcttagattatataccattgacttgatgattgattttaatcaaattacataagttgttcttacttttctacctcatcaataaatatagtggttaatgtgcccttgttttaacttagaaagagatcatgaaaatgtatcggtatttgcagattgaaatggctgtctccactcttgggataaaacatatccaaatttaaaaattgtaaggaattgcaaaaaaaagagaaaggctatataaattcactgccaaataaggggacaaatatatgcaccaaaaggattttttaaaaaaagagaacctctgggcactgaagtgttcaaggaaggcttttaagaagatgggagttgaggtgaacattagtgtttacatagaatttagacagataagagagaagagctgtactatagggggtctttatatttggacaatagcaggaaaaaaaggcttctgctatggattttgagacaccaagtatactaattttgcagaaggaatgaggaaatataaggaaataggcaaagagaagtttggggaagtggttgaaaacaaaatcttgaattccagactaatgaggttaaaagtattctgtgactaaaagagaatcattgaaggttcttctaaaaacagaagtgggagagtgggtgtcttgaagggggtattaagaagttaatttggttattgcgttaactgtgttcaggataattaaagggagagaggctttagtagataaaccagccagaagactatttcagaaatccagatataaaataaagcagacaaatctaaagtgatagccaggaaattatgaggacagagggagagatgtttttaaaaatcacatgaaacaaatggccttcaagcataagaaaaagatgcttgttcactgtatgggaaatgcaaattaaaactgtgagaggcctggcgcagtggctcacgcctgtaatcccagcactttgtactttgggaggccgaggcgggcagatcacttgagttcaggagtttgagaccatcctggacaacatggtgaaacccccgtctctactaaaaatacaaaaattagctgaacatgatggctcaaacctgtagtcccaactacttgggaggctgaggcaggagaatcgcttgaacccaggagacagaagttgcagtgagctgagattgcgccactgcactccaccctgggcgacagagcgagattccatctcaaaaaaaaaaaaaaaaaaaaaaaaaactaccgtgagataccatttctaatttatcagactggcaaaaattcaaaagcttacaagttctataggcaaggttgtaggaaagcaatcaccactgttattgcttcctggtgggaagacaaaatggtacaatggctgttgaaggaaatttggcagtataacacaactccatatgcatttacccttggaccccacaacaccccttctaggaatttaccctggtgacatacatcctcagattcaaaacagcatattcaccatgctatttattgtggtgttacttgtggtagtaaactatcagaaacaacctaaatgcttgtccatggaagactggttgaatgaatggggtacatatacacaatagagcactctgcagctaccaaaagagcaaagacgatccgtatgaactgatggtgatttcatgacacactgttacatggaaggcaaggcacaaaggtacacatagtatgctactattaccaggggtccttgctcccagagctcctaagatggtggcaggccacttccaaaatggcggcaggccgcttccaaaatggttgcaagcctcatgttctctgacctgaggttcttggcctcatggattccaaggaacggaatcttgcgccatgaggtgagtgttatagctctattagaagctgtgggtcacggaagagaaccgtggaacccagtgactagtgttcagctcgattaggatgaacctaggcacttagtcatgcaggaacaatggcaagcctttagccagatcaggagtggcaatgggcacctcgctggatcaggagcacagtggacaccctgcctgatctggagggatggaagtcagcggcaggtctgtgacagcggcaaacagcagtggtggacgcgagcgaaacttcagcttgagccgtaacaaacatggaccagaagagtgcagttgcaagatttaatagagtgaaatagagtggaaacagagctcccatataaagggaggggacccaaagagtgtagccgttgctggctggaatgcctgggtttatatcctgatcattgtccctccctctgtgctctcaggggatagatgattggctatttctttaactcctgtctttgcctaattagcattttagtgagctctctgattggtccggtgtgagctaagttgcaagccccatgtttaaaggtggatgaagtcaccttcccagctaggcttagggattcttagtcagcctaggaaatccagctagtcctgtctctcactacctttgtggtaagaaaatggtgagataaaatgtatgagtgtatttacatttttatttactttggcaaagagaaaaaagataactaagaaactaatgaaagtggttacctatagagaaaggtaaaggagatgggcaggacttcactagctatatctttttattttttaatctttttttttttgagacagagtctcgccctgttgcccaggctggagtgcaacggcgtgatcttggctcactgcaacctccgcctcccaggttcaagcaattctcctgcctcagcctcccaagtagctgggattacaggcacctgccaccacacctgactaattttttgtatttttagtagagatggagtttcaccatgttggccaggctggtcttgaactcctgacctcgtggtccgccagcctcagcctcccaaattgctgggattacaggcatgagccaccgctcccgaccttaatcttttttaaaaaaatttttttttaagagatggggtcgcactatacttaccaggctggtcttgaactcctggcctcaagcaatcctcccatttcggcctcacaaagtgctaggattacaggcatgatctaccgcacccaacctttagctgtatctttctagttatgatttgaaccagataaatattttacatattcataacaaatgacatagtaagtagtgtgaatggactcccactagccaaatgtaggacaattagagcatttttttttaaatgggtgataattccaactcaattaatattttaaatccatgcatcaatagtgaagaaaaaggaagagagaggggaatagaataaaagggaaagctcttttttacagaaacagttcagctgtcatgtatttcaggaaagaattaggaaatcatcattttgcatcccctagtatatgaacccaaaggagaatcatcaaatcataagtagatataaacacactgggtggaaagttgctatggaacaagatcatcacacagactcaaagtactactacaattaatagttaattacaatgaagagatttgctggttaccaacttaaacaagttattatacataacatcactattatcagttccataaacctgacattatatgtctcctgatgtggtactcaagtagataatatcacctcatattctttttgttttgttgttttgttttgagacagggtccccctgtcatccaggtttgagtgcagtggcttgatcatggctcctgagctcaagtgatcctccccgctcagactcccaagttcctgggactacaggcatgcactattagcctggactaatttattttttgtagaggtggggtctagctatgttgcccaggctagtctcaaactcctggcctcaagcagtcctcccaccttggcctcccaaagtactgggattacaggtgtgagccaccgtacccaaccctcacctcgtattcttgacaaaagtgtctagatcactgattttcaactggaggcaattatgcttccatgaaacacttgtcgatgtttcagacagttttgattgtcgtgactggaaggttgttacttgcatctggtggatagaggttgaggatgctactaaatattctatgatgcacaggactgctcccccacaacaaagaaatccctagtccaaaatgtcaataatgctgaggtcaagaaaaatcgtatttagcctcaagataatcacaagataaatcaagaatgtggggtatctataagacaactggcctgtacttggaaagaaaattcaatattaggggaaaagtgaaaattagggaattaaaaaaataaagagataaaacaatcaagaaaatgcagaagtatttttatttttattttgagacagtgctctatgtctgaagtgctctgtcagcagaaaggacttagaagctacaataccccagcagcagtaaacacaagtgccttgattgtggtttctaataccattctccaataaacaataccaaggctccttagagaattggctgatttggggactgggacaggaaataaacaggatgagcctgcagcatcttgtaatgacagaatgtaggaggatagaaaggggtatagctcagaggtaaagcatttgactgcagaaagtaaggaggtgctcaaaggaaaaaatccacaatgatggaaatatgtcaaagggacacaagagccaactgaagagctctcactggcctaagctggaacaatttgggcaataatatagatagaatggtattagattataacccaaagaataaaataagtatccatgagttcatacaaatataaataaatggtggataagtaaataggaaggaggcgacaaatctttcatgcaaaagaataccaaataacttatttaaatattcctcttttaagaaagtgaaggccaggcacggtggctcacacctgtaatcccagcactttaggaggctgaggcaggcagatcataaggtcaagagatcgagaccatcctggccaacatggtgaaaccctgtctctaaaaatacaaaaattagctgggcgtggtggtgcgtgcttgtagtcccagctactcaggaggctgagccaggagaatcacttgaacctgggaggcagaggttgcagtgagccgagatggcactgctgctccccagcctggcgacagagtgagactctgtctcaaaataagaaagaaagtggagcatcactccctactacttcttacctgtgacttttatccaagagcacagtatggaaagggcaggggcagaaggactttacagtgtagaaagctgacaaacactacgtcatacatgtgataaagggaaacatcaccagggataaatcatatggattgaatgtacttttgatacaatgtaatgagaaccactttacctctatagtctttctgccaaaaaaccatgaccccagtctagtagtgaagaaaatatcagacaaatcccaacggagggacattttgtaaaatacccaattaatactcaaaactgtccagttcattaaacaagtcaagtctgagaaactgtcacagccgaaaggagcctaaggagatatgatgagtaaatgtaatgtggcatctcaggtgggattctgaaacagagaaaagacactaggtaaaaactaaagaaagctgaataaattacggactttacgttagtaataaccacattataataaaaataaagggcctgatagagctatttggggttttagaaatgtcctatatcttgattgttggagtgattgcatgactataagcatttgccaaaatttatagaactgtacacataaaaagggcaaatgttactctatgaaaattgtatttcaatcaatctggcttgaaaagtagtccaagcatggtagctcagacctgtaatcccaacactttgggaggccaagacaggaggatggcttcaggccaggagttcgagaccagcctgggcaacatagccagataccatttgtacacaaaatttaaaaattgtcaaggtgtggtgtgcatggctctagttctagctgcttgggatactgaggtgggaggaagacttaagcccaggagttcaaagcggcagtgagctatgatcacgccactgcactctagcctgggtgactgagttagaccccatctctaaagaaagaaagaaggccaggcgcggtggctcacgcctgtaatcccagcactttgggaggccaaggcgggtggatcatgaggtcagaagttcaagaccagcctggccaagatggtgaaaccccgtctctattaaaaatacaaaaaaattagctgggcgtggtggcacgcacctgtaatcccagctactctggaggctgagacggagaattgcttaaacctggagggacggagcttgcagtgagccgagattgtgccactgcactccagcctgggtgacagagcgagactccgtctcaaaaaaaaaaaaaaaaagacagaaagaaaaagaaaagtacttcaacattagaatgattccattaatattctctttgctgattctgtataatacagtaactgaattgctagcatttattgaatacttactaatgtgccaggtgctgtactaagttttttaagtatattacctgacttaactctatggaatagatataataattattgttctcatttttcagctgaagacataaaggtcagaacatttagaaatgtggataagttcactaggctggtaactagtagaatcaggacttgaccctgaatagccccagaccaaaactcatgtattttattacattccaatcatactagctaatgttcttcccttctgattctagagcagaatattatgcttttttgcaattataaaaagataaaagaggccgggcgtggtggctcacacctgtaatcccagcactttgggaggccgaggtgggtggatcccaaggtcaggagatcgagaccatcctcgctaacacggtgaaaccccgtctctactaaaaatacaaaaacttagccgggcatggtggcggggtgcctgtagtcccagctactcgggaggctgagtcaggagaaaggcgtgaacctgggaggcggagcttgcagtgagccgcgatcgcgtgcccctgcactccagcctgtgtgacagaagcgagactccgtctcagaaaaaataataataataataataaaaataagataaagaaaggcttcttttctgcccctttcctcagtccttcatactaaagccatcatatttagttttggctacatcttcatgcccaatgacataactgactcaaccagtcaaacagtgacactgttcttcatagtcatgcaaattaatttgggttcactgctcatctagagctgtcagccttcaaggcctacatctggaaggttctgagatgggattgagcacacaggggagagctctacagcagcaagactgagagagtcagtgagcatattttcagttagccgtggcatcctccccaccactttaccttccttcagtttcgtttacctctacaaaggaccttcgtgctctgtgggaaagtgggttctattataagtatgtgattggcagaagacaccctaacccttttcatctcaacccacattaaattcaagcttcaaacctaggacttagagaaccaacctcatttactcttactactccatctttccataggaaatgagaccctagttcatagaaaaagtattggcgatatggaagacatgaagttcactctttaatttgctattgcagcagatatgcaaggttttcaagttaaatactgtggacattgactgctatttatttcacttttactcagatctctcattggaacatttccacatactttcagaggcacaagaacggtgtcaaaccattttggtaccttccaaaccaaatatattgcagaataaaatatatgccagcagtttgtctcctttaaattggaaggaagtggctgattgtaaaaccgctgctcagcattcataaagcatcgtcttttcagggacctagtgcatcatccactgtgtagccaaccttagtgcatgacccagggagttactgaccatcgtctccatgggcagatggggaagggacattcaggatgcctcttcttcttcttctttttttttttttaaggccaaactcagagccagcttcagaggaaggtttagaatataaatgcaatgtcaatagtcttctgaagataagagaaacaagctccattaaacagttctgtctttaaaaaaattataaactgactgtttctattttgtattcattagagcctccctgccccctcattgtctaaatgatacctcatttcacagatgggtactaagaagacataaaacctttaaaaaagagaacacaaagttggaagaacttgcagacattgtgcagtttcattgtcccttactcatcctggctttcttcattgattcatttggcacatatttattgtgtacttttgtgctttctgctttcctatcacttgttccgtttattccacatataataggactgtatagcctaatatttatcaagcatcaccaggctacacgcttaatgtacgtgatgtgttttcacatctgcaacccaacaatttttacatatggggaaactgagggttagagaaatgttgaaatgtgaccaattttatgcatatgggaaatgacagagtaattcagaagcagtttgtttggagcaaccttgtgcataactttgctccctgtcttcacaaaggaagtagttggcttagaagctctttgttataagtaaacactaggatacacagggttgtatttcccaaatctcggtgacttcaaacaacacaggtttatttctctctcatgctacatcttcatcatgggtgagctgagaactctgctctgtgtgatccttaattcaggaccaggttgatagagcagccactaccttgccatggcagacacaaagcagacactggctcttagaggtttctccaggatgtggcacttgtacctcctgcttacgtatttttggctaaagcaagttacatgattacgcctgggatcagagagtggggaggtgcaatcttaccatgtgcctgcagaaaagagagaaaataatgattgtgtgtaatggtgacagtctcacaggggaatgactatgggtcatgggactgttgctggcatattctgagctttcacattgtgtgtttgtacatgaaatagtcccagatgtgtgcccgatatgcttcaataaattatttctcttctgctcctctgaacttgtccattgtcttaccttggaaatgtctaacttttttcttctctcaaagcaactcttttgaagaagtcactatttaaaaaaaaaaaaaagatgaaatttccccaagtattctgttatctcacttcttttatctctggcaactgatgagtcaagaagaggaccagtggtcaatgccttatagtcaataggtaggctgtcagctaaaaggaacttgacccttctttagtgtcatttttcaaatgcctactgtgacaatagcaagtgctgctgtctcttgcctttgtttgctgcctaaaaaatgtattcgcccatataagacacgtcttgggaatctgaacagcatctctcagtttttgagttagattcaagaaatatttcctgagcatctacatcaggctagacatggggatataaagatgaataaagcttgttctttgctcctaagctgctcacatgcaaatgcgataggccagaagttctcagctctgggtacatattaggatcctgcggagctgtaaaatgcaggtgctgatacctactcccaatgtttctaatttaattagtctggagtgaggtgtgggcatcagtatttttttaaaacgccctggccaggcatggtggctcatgcctgtaatcccaacaccttgggagactgaggtgggtggatcacttgaggccaggagtttgagatcagcctgggcaacatggtgaaaccccatctctactaaaaatacaaaaattaattgagtgtggtggtacagacctgtagtcccagctactagggaggctgaggtgggatgattgcctgagcccgggaaattgaggtttcagtgagctgtgatcatgccactgcactccagcctgggcaacagaataagactctctctcaaaaaaataaaaaaaataattttaaaaaactccctgactaattctaatgtgcaaccagagttgaaagccactgattaagatagatatagaaacagataacttcaacatctgtttaagatactgtgttgagaatggaagctgaaacagaggcagatacattatattagaatgtattgttcagctaggtggacattttacaaacatgacctctaatcttcaatgtaattctctctgctcaaaatccttatgataggctaggctcagtggcttacacctgtaatcctagcactttgggcagttaaggtggcaggtgaggggaatcacttgaagtcaggagttcaaaaccagcctggccaacacatcaaggccccatttctacaaataaattttttttttaagttagcctggtgcggttacacgcacccatagtcccagctacttagaaggctgaggcaggaggattggttgatcccgggaggctgaggctgcagtgaactatgatggcaccatggcactccagcgtgggcaatggagcaagatcctgtctcaaaaagaagaaaaaaattccttatcctcattttatagatgaaaaaaccaatgcccagggagcttatgtcatttgcctaaagttacacagctagcaagtgttagagccaaattcagacttaggactgtctggctccaaacccacagaccaaccaaatagttgctctttttccaaagtagactgcactcatacactattttcctaaagaacataaatgaaagttgtgcaaaggtcggtctgctgcatttgtttcattcttgattacattctctgttccttagttgtgtctcctgacatttcctttgctccttctccaacattcaagctcacattcttagagttatgggggagaagaacatagtggcgaggtatcttaagttcaattctagagcaattagctcatcatcttggctcttcatgctattacgctatttcccccggagccgggtataatcgaagttcctcctacttgttgtgtaactgacctgctaagtcgagctgtgagccaagtctgtctggatcacgtaagcttgcagagagaactgagccaagtacttccaaaacaaacctcgttaaacaaaagcggagtgtggtcgagccggacacacagggtggagggttcagaagaccgtctgccagtctcgaaagcaatgtggggtctgtgacattaaacgtccaagggcagttgagctggagggatggattcacctttacagatgaatctggaaaccagtgagaatgattctgcatgattaggaataataacctggaaaatcattgccaaattacttccttttagtgaaatatcttcgatttttctgaaacccttagtcaatcaagaccccagctcgtgcctgttcatcacgcttaaagaaaaataaaaatgagtctggcagtagtgactagaacttcagatggttaggtctcatttagttttgcaggagtgtggaaaattgagtcagaaatcttagtctctattcatttccatccttcccttaacacagtgaaaatcttgggcaagccctttacattttttgtttcttaattctatcctgttttataaaggaaagcatcacataaattgccttccttgtacctcctaataggtccctagagattatgatgaaaactagaaaggtgctcatatcttgagttcttcaagagagaggaaccaagaggctctattgtgaatatcaaaacagaatttaatttgctttctctctacgttcaccctttttctgagaagcctgttggtgtatctgaagccacatgtctgacatgcaccactgtgtcacagcacttagcacagtgcctgtcaacagggaggcactcagtaactatctgtgacttctgtgcctgttattatctgtcctcatctcaccccccaactctccatctccctatgccacaaccaaactgctatttcatagatggtaggaagagcttcaagctccactggttgaggagaaaaaaaaaattgatttaagtcacagagcagacaccagaatagagagatgctgtgtgtggataagacaggagcatctgcatgttgatacccagctgctcaacaggctggtctccaactgagagttgggccaacgatgagtgtcagtaaattgcctctgcacctctagagcctgaaattcctgctttccaaaagtcaacaggagggtaatttggtaggcatccagactcatcctttccacaaagtctctctgcacctcccaccagggaaaatttggctccagtcctccccgcagcctccagttcagcttccagcacagtgggccagccggggccgtcagaagcagaacggggactaaacgctgcggcaagctggagaaggaccagttccaggggcaggatctggacagggccatgcctcactgatcaccctttggccaagtaccccaaattgaagcagtggaaggcaaggggtatccaggctgacctctccaaaccttagtcatgttctcatggatgatgtgactgggtcaatcaaaacttttttcctcgcagctgtgcctgtgactatctgtagcaaccaactttcctttatgtatatatgttttcctatatgtatatgttttccataaagacagtgtgttctgactagctataaactatccattattaggtgagacaagtgaatattgttttgtatgaaccaggcaggtaacccaaggatgtctacctctcagctcccttttccacagctcccaggtacagggagggccctggggacactgggagaacagtccccactcaatcagatcaccagggcaagagcacagacatggcattatctccagaggggtaggtggtagaacattagaatagaaaagtttatcagtctctccaacctctgatatggaccagaaagagctgacagcctaatttatcatcatggtagaattttatgccctcaaataattgctagtaacctggatcttccactggaaaaataaaatcaacccaaaaatataggctccagattaccatgaccccagcatttgagtgatgacattgagcctttgggtcaggtttggaggtgagtcttgagagagaaggaaagttcttttgaaggggtgcttattggaaagcctagtgcaatcatgctagctgcccaagctaattgtaaaatttcagatttattgtgttcagcagaaatacagcctgtacatttgaaatattatccaaatgacctggcttcaacttagaaatcttacatgaattgaaacaagtgaattagggagacctcttgccttcagccctaaagggtctgtgggaggtaagtcaagaaccatttataatagtgataaaatactatatttaaggctgtaaaaatttggcatgcaagaactcagctcagaagtaaattcatcttatgtgctcggcaaaggagcaactggaaagttttacaaatgggaagtttgacctactgagattttaaagataaattatgtcaattattccttgagagtgagtacggtcatttacccccttgaatgttgaaatggaaatccgaaccatgaagtcagtaacaacttcactttgccatggtgcacgtggctaatgacagttacccaaagccattgtccaactgtcacatcatgtgcccaaatgtgcattagtgggatgggccacttgggaccctagcaagcaaccagggagagcatcagagctatgcccaattaacaaacacctcatatgatggcgcatgatgcttttactctgccaagaagccagtgatcctttccttgggaattctataatatgtctgtctgaagctagaactagtagataatgcttgatgactgacagatgtgtacttttttcaaaagagccttattaactttagtctcctgcacatctctggcctcagtgtctacctcttgttcctcacctccctctccagctacactgcagggccctagtcatgattgctgtagcccattcttgccccagggccctgcactagctattccctctacttggaatgtttttcccaagataccaatgtggctgggtccttcctgtcatcacatctcagtttaaatgtcagctcctaagaggcttatcctcagcacccaattcagcctccctccctctctgtctacactacacacacacacacacacacacacacactcacttcagtcatcctactttaattctagcagatcagatataagtatctgatattttgatgttttattgacttttaatatctgtgtgtcgtatttcttccctcacttaaaatgtaacttccaggcaggcagagacttgatcgattctatttactgttgtttcatcagctccttgaatcatgcttaccacatgcaggtaagcatatggttgaacatgcttggttgaacatccataatgttcaaccaagtcaatgtcagcgtcctcacaggtaaatctatggtgaatgatttgaaagcgcccttgtggagcatggaagagccatacttcagtctcagggctcacctcaggtgagtcgtttcaaccccgtctatgggtctccctccctcatctggaagcagaggggactggactggaccagtggcccaaatcagcagcttgccgcctctcttctgtgaagccctttctcttcctcaccatccacttctccctatttagccaggacagctttgctttcatcttgttaggtgtatttgatttttcataagttttcatttggtaaaggattctgctgctaaagtaaaattttaaatctcccagcttagataaatccttctgttagaaattaatcctggctcagctgtaagaggctagttgtgtgctttggggaaactcacttaagcctcagactcctcatgtaaatggaggataatttccatatctgtctcacagtattggtgggagtattaaatgagataatccatctgtagtaggcagaataataggcccccaaaagatgtccatgctcaaatcctcagagcctatgaatatgtaaccctacacagcaagaggactttgaagatgagattaaggttaaagattttgagatggggagattattctgaattagctaagtggactcaatctgagctcatgaatctttaaagtggagaacctttccagctgcagtcagaaagacagacgagacaggagagaaaccatcactgatagccgtgaagctggcagaagagatgccccaagccaaaaaatgcaggtggcatctaaaagccaaatacaaccctcagctgatagctagcaaggaaatgaataaatggatatctcaggcctacaactgcaaagaaccgaattctgtcaacagcccaactgaatgaggaaacagatcctttcccagagccttcagaaggaacccagccctgctgccactctgcttttagcccattgagatctctaccagacttctaacctacaggactgtgacataataaatttttatgttttaagctgctaaatttatggaaatttgttatggcagcaatagaaaactatttaactattacatttaaactatgtaataaagtacttggcacatgggaagggctcaataaatgtgagcatttcttataaatattattaatggggtatttattaatatcattatattatatcaataacctcttcctgccttgatgctgagctttgaattctgaaactccatttcatgcctatcctgaagacgtttactcttagttgccttacaagaattattcaccaccttcaaggtccaggtgttgtgctggatagcaattagaggaaatttctgacatgcaaaaccaagtgtacagattaacaacactaaagaggtacagatggacactgggtgcttcctgaggtgatgtcttaagaaaggcacatgacccatgtagtagtttggctgcagatgctaaacttgagtttacacatgaggaaacatcaggacaatcccaaatgagaaactttattaaaaataaaccgttgcctttctccaaataggaaaagaagtcaaagtatctctccttgcggatgatatgattctatacctagaaaaccctaaagacactgccaaaaggctctaagaactgaaaaatgactctggtaaagctgcaggatagaaaatcaatgtacaaaaatcagtagcatttttacacagcaataatgttcaagctgagggccaaatcaagaatggaatcccattcacaataacccccttcctgccctcacaaatatgtaggaatatatctaaccaaggagataaaaaatctctatgagaactacaaaacgctgtcaaaagaaatcagattcttcctacccatgagtatggaatgttcttccatttgtttgtttcctcttttatttcactgagcagtggtttgtagttctccttgaagaggtccttcacgtcccttgtaagttggattcctacgtattttattctctttgaagcaattgtgaatgggagttcactcatgatttggctctctgtttgtctgttattggtgtataaaaatgcttgtgatttttcacacagattttgtatcctgagactttgctgaagttgcttattagcttaaggagattttgggctgagatgatggggttttctagatatacaatcatgtcatctgcaaacagggacaatttgacttcctcttttcctaattgaataccctttatttccttctcctgcctaactgacctggccagaacttccaacactatgttgaataggagtggtgagagagggcatccctgtcttgtgccagttttcaaagggaatgcttctagcttttgcccattcagtatgatattggctgtgatggaagaacattccatgcctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcatgcatcaccaagtcaatcctaagccaaaagaacaaagctggaggcatcacgctacctgacttcaaactatactatgaggctacagtaaccaaaacagcatggtactggtaccaaaacagagatatggatcaatggaacagaacagagccctcagaaataatgccacatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccacaaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggaggaaattttcgcaacctgctcatctgacaaagggctaatatccagaatctacaatgaactcaaacaaatttacaagaaaaaaaaaaacaaccccatcaaaaattgggcgaaggacatgaacagacacttctcaaaagaagacatttatgccaccaaaaaacacatgaaaaaatgctcaccttcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgactcagccatcgcattactgggtgtataaccaaaggactataaatcatgctgctataaagacacatgcacacgtatgtttattgcggctctattcacaatagcaaagacttggaaccaacgcaaatgtccaacaatgatagactggattaagaaaatgtggcacatatacaccacggaatactataaagccataaaaaatgacgagttcgtgtcctttgtagggacatggatgaaattggaaatcatcattctcagtaaactatcgcaagaacaaaaaaccaaacaccacatattctcactcataggtgggaattgaacaataggaacacatggacacaggaaggggaacatcacactctggggactgttgtggggtggggggagtggggagggatagcattaggacatatacctaatgctaaatgatgagttaatgggtgcagcacaccagcatggcacatgtatacatatgtaactaacctgcacattgtgcacatgtaccctaaaacttaaagtataataataataaaagaaaaaaaaaagaaatcagagatgacacaaacaaatggaaaaatatcccatgctcatggattggaagaatcaatatcattaaagtggccatactgctcaaagctatgagattcaatgctatttctattaagctgccaatgtcaatttcacagaagtagcagaaactattctaaaacttatatggaaccaaaaaagagcctgaataggccaaagtcatcctaagcaaaaagaagaaagctggaggcattacattactcaatttcaaactatactttaaagctacagtaaccaaaacagcatggtatttgtacagaaacaaacatatggatcaatgaaacagattagagaatccagaaataaattcatatacctacagccatctgctctgcaacaaaattgacaaaaataagcaatggggaaagcacttcctatttgataaatggtgctgggatagctggctagccatatgcagaagaataaaactatacccctgtatttcaccatatacaaaaattaactcaagatggattaaagatttaagtgttagacttcaaactataaaaatcctagaagaaaacctaggaagcaacattctggatatgggtcttgggaaggaatttatgactaagtcatcaaaagcaattgcagcaaaaacaaaattgacaagtgggacctaattaaactcaagaacttctgcacagcaaaagaaactatcaacagagtaaacaaacatctgacaaaggtttaacatccagaatctacaaagaacttaattcaacaagcaaaataaaaaaccttaaaaaatgagcaaagacatgaacagacacttctcaaaagaagaaatacaagcagacaacaaacatgaaacaattatccacatcgctaacatcagagaaatgcaaatcaaaacgaaaaggtaacatctcataccagtcagggtggctattatcaagcctgtggagaaaagagaatgcttataccctgttggtgtgaatgtaaagtagttcagccactgtggaaggcactttggagatttctcaaagatcttaaagcagaactactgtttgacccaacaatcccattactgggtatatacccaaatatatccagtatatttatatatacccaaaagaaaagaaatccttctgacaaaaagacacctgcactcacatgtttatcacagcactattcacaatagcaaacatatggaataaacctaggtgtccatcaatggtgggctgaataaagaaaatgtggtacatatataccatggactactatgcagccataaaaaagaaaaaattatgtcctttgtagcaacatggatgcagatggaggccattatcctaagcaaattaacacaggaatagaaaaccaaatactgcctgttctcatttataaaagggaactaaacatggggtactcatggacataaagatgacagcaatagaaaacggtgactactgaagaggaaagggagggagggggaggcgggttgaaaaactaactactgggtactaagttcagtatcagttataccctaaaccacagtgtcactcgatatactcaggtaacaaatctgcacatataccacctgaattgaaaataaaagttgaaaaaaggtgaaaaaaaaattgccttttaaaaacatcaatatcatcaaagtcaaagaagagccaagaaattgttctagattagaggaaactaaataaatgagatgaataaatgcaatgcatgatcctagaatagatctctattgaacattactgggtcaattgaaataattggaatataggtgggagagtagataaatgtatttattaatattaaatttcctgagttgaaactttctgaagattgactctattgtggttacatgacagaacatacttattcttaggaaatacacactgaaatgtttatgggtaaaagaccacaagtatccatcttaatttcaaatagttccaaaaaatgtatgtataatatataaaacaagtgggtgaccaccttctaaagcaaatgtggcagaatgttaacagtaggtgaaatctaggtaaagggtaaatattttattcttgcaagttttctgtaattttgaagttattttcaaataaagagttttaaaaattgcccaattctctttgcaatcctgtaaagagaaggaaatattagctcttggtgcccatttaaaccacagtttttcttttgatttataattgcatctgatacctatgttattatgcctgcccatttttaagactttcacaatgtagagctttcaaaattagtataaagacagaaagcttcttcaaacatcccttcaggtgcattaaaagtaagcactggttaaagaaagcacagttttcatgtaatccactggttttacatgctaagttcttagtactgaagcattagcatagtccctggaaatattcatctaataggataaattatttctggtaggctatatatctcttcaaaaaagtggcaaagctgtcagctaaacagctagatgaatgaagtaaacagtccattgtaaaaaataattacatggtacttactatatgtagacataattggcaataatgggccaaaaggagggatcatggcagcttgggtcaatcacagaggtctccaaatgtttctaaatgtgtgcctatttaattcccattgcaaaataagccctttcatctttcataacattgataaaaaaacgttgatgttcacagcagtgtttttatggaaattgtgtcctgatcccctccatgcacatgccagaatctatgagccttctgtgatcaagctcatctctcttccatcagtgccaaacttcttagaaatactgaagatttctaaaatggatcaatgctttggcaaattgcctcatcaccaagaataaacactcacagacttaagcagccacttgtgcatctatcattgaatagagcctcaagatactggaagtgatgtatcaatggctttcctaccagccagttgcttctctggaagcaaaggaaacaatgctgagcattgtcatccatgtaatttgtggccattagaaagactggtagatgctctttcattgagaccctttggactaacaacacagcccatctggagcacaaaagctgtaaacctggaaaaaaaatagactgcacagatgagcagtttcggtgcaccttccccattcagaggtgctaataaggaaaaatgctgaattactatgattacccatgacttgaaaatagcttatcacctgccaatctgaatgaaggcccctggagggctgtgaaatgccacaaagaacaatggccttggaatcagaacctgcagtgtctgagagaggcatcccagtgcaaggctaaagggccaccagccttctaaaatggagctcttattctcagtaaaccctgcaaactggttctgggctgttcccatgccagagagaaggaaaatagaagtgctttcataaaacaatcaggcccataaaagtagaaatgcaggggagagaaagccagcaattatccaaaagaatcatatcttagataagcggccaatttaaggtatttcacggtggggcaaagctctctccacattcagcagataattgttagcctgctttctactttatgtgtgattgtgtaaacttaatcatactgcaaaatccctcttgtcttcagacctcagtgcccctggaatgttgttaaagtagtcacatgaggttcattaggaagaagagcttggctttgtagagactgggtatttggctgttcacaggaatcttttcttcgttatcacaaagctctgtgttaagaccattgtagacactaaagcagagtatctcccagctgagcaagacataatatctcagtggtggcctgccccattggcaggtgctaagcttttatttttattattataatggctttgtttccccatgaaccatttagatgaagtatgaccacagtctgagtcttcacttatggccaacttcttctcttaatttactgtggcatcaaaacaataaggatttatttataaatttttgttctctttaagaatggatacaaggagaaaagtctcccaaagttgaagagcattgcctttttattcagtaatgcactgcctaccctcccaaaatgcacacacatgcttatgggtatacacacacacacacacacacacacacacacatttgtgggtctgccttccttcaaaatgttctaacgtgggactggtgaggtggataggctgacttgtgccacagactaagacatctgccattaattggtgggacagcaaataatgtaaaaatatgttttctctttcactagcttctctagacaaatcagctttgtgttcctagtgctgcttctaagtttctttcctcttgttcataattcctagctctcagattgcctttgaaaagctgccacttttggagcagaatgatctgagagggtgttttcccttttcttccccacccaccccacacatacgcacatacacgtgcttgtcagctggtaatgcgtttctctatacctgaatcataattcactactttttctaaataacaccaagtgtttttttaaagcccacagtgataagagttgttgctttgtttgttgactggtggtggcccacatggatttgtatggttctcagtcataatcagtctaaaacatatttcctcattacctggtgtgtaccccagtctgtagtataaggagaaactagaagatacagttttaatcttcaaaaactagaagcggctgggtgcagtggctcatgcctataatcccaacactttgggaggctgaggtggacagatcgcttgagcccaggagtttgagacccgcctggggaacatagtgacacctcatctctacaaaaaaatacaaaaactagccaaatgtagtggtgcacacttgtagtcctatttacttgggaggctgaggagggaggatcacttgagcccaggaggtcaaggctgcagtaacctgtgaccgtcccactgcactccagtctgggtgacagagcaaggctctgtctcagaatcaaaacaaaacaaaaaacaaaaacaaaactagaagcaccaggctagtgatcagtaaaactggatttagtcctcaagctgccactaattaactgtttggctttggccaagtccctaaaaatttctagtctcagtttcttcatctgtaaaatttggaaaggggtgaaattcatatctacaagtgccaggcaggtaccatggtcaagtgggccagctggggactgaggccacagggcatccccatctacaggagtcatttgctcctcagccccaaccaattgctgcatgcagaactcgaggtaattcagacttttatgaaaaatctcttgatttccttaaatatagtttaaacattgtttgtgctggctgaacaaatcatttctgcaaagtatattccagtccaccacttctagactcctggcactctcaagtctctccttccctctttgtgtgttgtttagaaccattcagcaattgacatccaatctaagtgttcaggggagtgaatacaacccaggaaagatgatcacgatattcctcgggctaccaagtgattaagaattgcaccgatcactcatcacagtttcagcaggtccaagtgttactagtaaaaattgagatggattgttgacttttgagaaggagaagaagcttaaaaagggtattaaagaaaacaaagctccatttgtaactagacagcatttccacccggcagtatacaaaagaaagaacaagtggaagtgcttctgtataatttgctacacaactctggagcttcagctaaacctcctatagctgtaagcaataaaagcacagaagtagagagaagtaaccaaaacatacctagtattccatagaagccatcacataacacagaggacaaaaatgtgtagcaataaataacacatggaacatagcaaaactctcagatcaagagaaacatttttgaagaaaactatttccaaaatttgtgaagttttaaaaaggtagagcaataggccaaggctccaaacctagagggaaaggatagattctctggctggtgcctcctgattaatgaatagaaagtgatccagttgctatagtgacttgaagatacacaaaagaaaacatcacttctttaaaatatgcctgatgatgaataggcagattctttcaaaatatttttttaaaaatatgagcaactcttttttttttctttaaagtgaatcacacaggatgtctcttagatttctttcttctttttttcagataacaggacttgtttacacaagccctagtttgtttacatgaaccagcaattcgggcaaaaattaatgatcagaaaatacgtctgttggagaataagttttgtttttcagcagttttgtttctgtttgagcagcaagggagataagtgtatgttgtcttggttttccttttttccagcaatatatttatttggagagtttcctcggatgctgagaatgtgaaatgtacctaagcaatcagggaatggaaggttgtgtttgctgaaaccttcccttatctgtctgaatggagaggtaataaaaaatattattttggtgggactgaatgcccactccctttggctctccagcctggcccccacaatctccaaaggattgttctgttttgctccaggcagttcagccttggcacagtatcctgaatagaggacattcaaggcaaggtcttgaaataaaaactgcagtgattaaatatcctggggaccccttctgtgggggatggagaactcttagttgaatgatttgggtaaactgttggcacaaggtcccagctgaagtgtcccaaggcctgcagcctggagagacattctttagctgaaaatgtgatgtgggcttttgctaaccagcagaggggtcaatgatcttgaacagcatcctaagcctgtgtaatatggtcttttaaagtgggtgtgtgaatatttttattaaaggatatgtaattttaaataaaggtaattcacaggggagtagggaaatcacttgaaaatcataggaagagaagttcccaaacctgcacctgttctgtgtgatcttggacaagtaactgaggtttcttggggctcagtttactcacccctaaaatgaggaagttagatcactttaaagtcagcaaacatattaagtgcccgctgtgtactatcatcttccacccatatccccagatcccactcctgagtcccagggatccaaatactgcaccgttcagctgctcaagccaaaactccaggaaacccatcattcctccccctttccttgggcttcgttgaaataaaaaggtaataatcacacctctcccacaattcagaatcaaatgagcattaagggagaaaggagattatacagaaaaaaaatcaaagcatcagctttattccttataaggccaaaagggaaaatatgaattagatctctgaactgcgaacttcctaaccactcccctctgcattaaccttcccatctctctcatctgggcatatgagttccttctcccaaactcaccaattcacacatgataaagcattcctcttttcactaagaagaagtagctgaatttaaaagaagtggcagctctctttcgaatattttaaagatcaaggcaggaacacatggtatccctaaatgtaagttacattttagtttcccagagctgctgccacaaagtactataaaatgagtggcttaggccggcagggggctgacacctgtaatctcagcactttggaaggccagggcaggaggatcgcttgaagccaggagatagagaccagcctgggcaacatagcaagaccccatttctaaaaaaaaaaaaattaaaaatggatggcttacaacaacagaaatgtattctctcacagttctggaggctggaagtccaaaatcaaggaattggcaaggttggcttcttctggaggctctgagggcaaattctttcttgcctctttctggctccttgtggctgctggcagtccttggcattctttatcttgcagctgcataactctcatctctgccacatagtctcatggccttctcccttctgtgtctgtgtgtctgtgtcttcatgtttatacagaaatgagtcatttgatttagcttagggcccaccttaatgtaatgtgacctcatcttagcaaactgattacatctgcaaagaccctattgccaagtacatagagtatttgaatatgtactatgtacttagagtactaagagtgttactatgtatactatgtacttagagtactatgagtgtgtacgtagagtacacattcataggtaggtagtaggtattaatgtttggacatatcattttggaagacataattcaactcacaatggttgaacaagtcttttctacttcctaaatatttttcgctctgtctacttctacccatctcaacaactatactttagttcaggccacagacaccattcccccagataccacatcagtcttctaactagtctctctgattccagtcttcttctattctctcattttcaaaaatccactctctcctctaataatggccttctttctgaaatgtaaacctgacggtgacaactgcctacaaatctaaaatgacttcccatggccgtggataaagttcatactcccagccaggcgcagtggctcatgcctgtaatcccagcactttgggaggctgagacgggcggatcacgaggtcaggagattgagaccatcctggccaacatagtgaaacccccatctctactaaaatacaaaaaaattagctgggcatggtggtgcatgcctgtagtcctagctactcgggaggctgaggcagaggaattgcttgaacatgggaggcagagattgcagtgagccgagatcacgccactgcactccagcctggtgacagagtgagactccatctcaaaaaaaaaaaaaaaaaaaaaaaaaaaaaaaaaattcacactcccaagaatgccataaaagcttcttcattatcattgatcttcagccactgatctgtccagcctttcctctcctgcctcttcttgcttctccaagcatttctacttcttactctagctaccccaaactctttgcaatctaccttggtactttccccatcctattattgaaaacctgcatgtttttaagacgggggcaactatgctatattttgaggtcttgtcactcattctacagttccctcaaggggaactgaataaatcctttaattaaaggaatcatctctgtagattcagctctctctacatgaatgcctttctttccttttctgccttctgtctgtaccactccctctaattcatctttcaggtctcacctaagcttttgcttcctcaagaaaccatgatttgaaggctctccctacacacatacacacatgtgctctaatttaggtatcactttattttcttagcaaattgttcagaatcctcttagcaatactgaaaacacagaattcattgtgatatctttctacttgcttcattccccctgactctgagctaagtattgtactaggaattagtctccttcatagcctccttctttcatccaccaaatttcattgccccttctcaaggtgtttcttcttacatactatgtctctttatcactctccctgggctaacagctgtttgctttcttggttattctgtaatttcactgtgatgagtcttcttatagattaacaaaatagtaatatatatatacatatatatatatatatatatatttgtactgcttcttgaaattaatcatggggatttattgatattattattatcattacagacagtatatctctgtcacccaggctggagtgcagtggtgcgatcatagctcactatagcctgaaactcctgggctctagagatcctcttgcctcagtcccccaagtagctgggattacaggtgcatgctatcatacatagctaatttttaattttttttttctttttttttttgtagagacagggtcttgctatattgcctaggctggtctcaaactcccaggctcaagcaagcctcttgctttggactcgcaaagtgctgtgattgccagcatgagccactgtgcccagccagattggtgggttttgtttttttttttccaacaattctggaacattttcaaggattttattgttatcaaatattgtacctttcccattctctcagttatctcttcggaactttgacattttttagcccttctcattttaacctccacgtttcttaaccaccctttcctgttttttagcttttattgcctctatgggttgaagcttctatcttttctttatatctatctttgagtttacctaattctttttctgctatgcctaatctactgtttaatctatccactgagctttagattctaatttttatgtctatcacttatagaagttatatgtagttgttttacaaaccacacggttattttatattttaagatgttctttttatttctttaaaaattttaaatatttgttattttatattttgtaccagctactttcaagatctgtagtctctgtgggtttgattctggtgttatttctgctgactttctctcatggtgactgatttccttatgtggtctatgtttttaaactgtgaccattttccttgaaaatttacccatgaaaatactttaaggcctgggttaagattatattttttaagagaagatttgcatttccttctgtcaatggtcttaaggcattacttacctggaactacttgaaactgaattttccttttgagatgttctagaacacacaagtaacatgaattatgactataaacctatgtgatatctagcttagggttacacattctcaaaggggtttttttgttgttttattttattgtatctacctgtcttagtccatttgtattgctataaaagaatacctgaggccaggaaatgtagaaagaatagaggtttatctggctcatgcttctgcaggctgtacaagagcatggctccagcatctgcttctagcgagggctccaggctgcttccactcatggtggaagggggagaaagcaaggggaggggaggcaccaggctcttttgaacaagcagccctcataggaactctcacgggaattagtaaagcaagaactcactcattcccaagaggacagcaccaccccatgcatgaaggatccacccatatgacccaaacacctctcattaggtcctgcctctaacattggagataaaaaaaaaatttatcctttttttaaaaatattgtttttatacctatttgaatgggaggagataaaattttaacatgaggtttggatggtcaaatagcactactcaatgctaaggatgagaccaagataattttttcctgtctcttcctcctgaaaagtttatttttcatccatccttcactaagactgcaatccatgtgttcctatcccagccctgcattttatctgacaaccctaactataataagaatgctctgaatttgcccattaagcaagattttaaaaaagctattttttgtttgtttgcttctttggttttttgggggttttttgtttgtttgtttttcagatgcagtctctttctgtcacccaggctggagtccagtggcatgatcttggcttactgcaacctccgcctctcggattcaagtgattctcctgcctcagcctcctaagtagctaggattacaggcatgcaccaccacacctggctaatttttgtatttttagtagagacagggtttcaccatgttggccaggctggcctcaaactcctgatctcaagtgatccacctgcctcggcctcccaaaatgttgggattccaggcattagccactgtgcctggctgatgaaatactaattatgtgggaagacagaagagagagaatcataacttggcttctttcagcctgaaaaaatatttctgtggtacactacattagaggtttctccattctatcattcgccacactgtgatttctctctaattagctttgttaattactgtcccttcgccaatttgcaaattccttgaggtagggactgcctttctcatctatactcgttacagtatccaaagcagtggatggactgtagtgtgggatcaattaagtgtttattacttctaagtcgacttcactgctgggtgctcctcttctcccatccatccaggtgcttggacaaggccggggagtaatcccattccctcaccccacacatcttatcatttaatattctcaattttatttctttactttctctcaaatctgagttttgctgttactgcacccacagtcttagtttatccctaatcatttctcctctaggatattcctaaaaatatataaataaataaaaaaataaaataaaataaaagtttcttgagtgtgttacatagaatctagttgagcaagatttaatagatgtatctgtttctgcagttaaataagccattaccacacagtagacacagtcatcattttaaataaatcagatcacataggtcatttttactgaagcttctcatgccctcccattactcttcgattagaatgtaaacctcctatcctggcctataagatcctatatgatcttgtcctgcctatgaccctggcatcacctcctgactctctccctttctctccatctcttccagccccactggccttcttgatgttccttgaaggggacaagctttccctggcctctgtctggaacacctgccctcagaacctcccatgctagctctttgttatcattcgaatctctactcagatgtcaattcttgcaagacacggcctcactagcccatctaaattagggcctctcctctccaccccagtctcatcactctctaaccctttatctgaatttacgtacttacttatgtgttttcttcacccaatgcatatttctggagcatctgctatataccagcagttcttggcactggagatacaggaaaacaaaacagaacaacctgtcttcatgaagcttgcgttttactgtttgcttcatgcatttattgaacaaaaatttatgctttgttttcattctaataattatctaggctgggtgcagtggctcactcctataatcccagcattgtgggaggccaaggcgggtggatcacctgaggtcaagagttcgagaccaacctggccaacatggtgaaaccctgtctctacaaaaaatacaaaaaaaattagtgggtgtggtggcacaaacctgtagtcccagctactagggagtctaaggcaggagaatcgcctgaatctgggagccggaggttgcagtgagatcatgccactgcactccagcctgggcgacagagtgagactccatctcaaaaacaataataataataatctaattttttctttttattatgtcttccccccaaagaatgaaggcttcagaataaatgaatacgtgaatgaatgtacagcgttagtgagtgatccctataggaattgctgcatattttcatccatcacttctacctgctagtcagtctagagaagcatggaaatccacaaacagcttgcctattatgatattccatcactggaattagaggactcgataaagactagagaccaatagaagactgaaccctctttagccaacatttgtagacaataatttcaattacttattccagtctcttctaccaccctgtccctccagggagttgtgccccactgtcagttgcaccatttgcattactgccgattcaaacatttattcattatccctgggcaccgatgaggacaacatgattgaaaatcactagcaaacccccaaccaaatactttgtatcccagcaccattgaaccttccagaaaaatcagctttggcaaaactgtcagaggatccattttgtattcgagtgttaattatttgaggcaattctaagtgcaagacctatttgaattatgtactttttagtgttatttggggcttataattagttgcactctttgggaatataaatgttttacccagttcattatcttcgggtggactgaaaaatgtcagtgactctcctgcaaatttgtacagcgttgctcagtaagtaagtatatatttaccctgggagaatatgcattattgacaatttacttaattatctctcaaaacaattcaagtattggctgcttataatgctgtctttctcctcaaagggagcagtaggacatctcaacaggggtggacatgctgctgctactccaacaaggctgcaggtgctcatatagagacttgtttaagaatgcttggccccactgaaagccacgagtctcaggagagccaagaataaccccatctcgtattcattggcctcctttgcaaaattgtatcagaaaaacaattcgttttaaaagtgaatctttttcaaggagattatacaaacatctgccaccatttagccacaccccacggaagaacatcagtcctgtcctggtggtgtagaattaggaaatgccaggagacaaaatgggaagatgagaaaataggagtgggcaggaaagaaaggaacaaaaaagtaaagagcttagccaaatgacaagctccctcatgggagatctgtgggaggatgctgttttcaaatacatgacccaaatgatgtctagaactcaggacctgagcttttttttttccttaataacatttttgttttaaccaattctgtaacacacatttattttaaaagcatagaaacatatatatgtatatgtaaagcaaaaattaatattaatattttagctttttgccttctgattttcaataaagccatctctatctgtctatctatctatctatccatccatccatccatccacacaggtaggtatctacctaccatatacatagagatggattatcatcattttttacatagcctatcatgaaatgtttctgtgtcattaaatactcttgagaaacaaaatttcaatgtctattagcccatcttatataagtgaacaggcatatctcattttactgcattttgctttattgtacattgcacatgttgcattttttttattatactttaagttttagggtacatgtgcacattgtgcaggttagttacatatgtatacatgtgccatgctggtgcgctgcacccactaactcgtcatctagcattaggcatgtctcccaatgctatccctcccccctccccccaccccaccacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacataggacatgaactcatcattttttatggctgcatagtattccatggtgtacatgtgccacattttcttaatccagtctatcattgttgggcatttgggttggttccaagtctttgctattgtgaataatgccgcaataaacatacgtgtgcatgtgtctttacagcagcatgatttatagtcctttgggtatatacccagtaatgggatggctgggtcaaatggtatttctagttctagatccctgaggaatcgccacactgacttccacaagggttgaactagtttacagtcccaccaacagtgtaaaaatgttcctgtttctccacatcctctccagcacctgttgtttcctgactttttaatgattgccattctaactggtgtgagatgatatctcattgtggttttgatttgcatttctctgatggccagtgatgatgagcattttttcacatgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctagcacatgttgcattttttacaaattacaggtttgtggcaaccctgccacaagcctgtctctaccactcctccaatagcacatcctcactttgtgtctctgtgtcacatttttgtaattctcacaatattttgaacttttcatcattattttatctgttatggtgatcacagtgatcagtgatcaattataattgttttggggcaccatgaaccccaccatgtgagatggaacttagttgacaaatgtgtgtgttctgccttttccactgacggcatttccctatatctcttcctctcatcagaccttccctgagatataataatatggaaatgaggccagttaatacttttacagtggcatctacatgctcaaatgaaaggaagagttgcaagtctctcactttaaatcaaaagcttaaaattgattaagcttagtgaggaaggcaagtcaaaaacaaaggtagggccggacacggtggctcacacctataatcccagcactttgggaggccgaggcaggaggatcgcttgagcccaggaattagagaccagcctgggcaacatggggaaaacccgtctctactaaaagtacaacaattagccagatgtggtggtctgtagtcccagctacatggtgggctgaggtgggaggattgcttgatcccaggagtaccaggctgcagtaagccatgatcacaccactgcactccagcctgagtgacagagccagactctgtctcaaaaaaacaataaccaaacaaaaagataggctgaaatctaggtctctggcaccaaacagccaagttgtgaatgcaaagcaaaagttcttgaaggaaattaaaagtgctactccagtgaatacacaaatgataaaaaagagaaacagccttagtgctgatatggagaaagtttttgtggtctggatagaaaatcaaaccacaacatttccttaagccaaagcctaatccagagcaaggacctaactctcttcaattttatgtaagctgagagaggtaaggaagctacagaagaaatgttggaagctagcagaggttagttcatgaggcttaaggaaagaagctgtctccataacataaaagtgcgaggtgaagcagcaagtaatgatgcagaagctgcagcaaatggttcagctaagatcattgatggaggttaatatagcaaacaacagatttccagtttaggtggaacagccttccattgggaaaacatgccatctaggactttcatagctagagaggagaagtcaacgcctggcttcaaagtctcaaaggacaggctgactctcttattagggactaatgcagctggtgactttaagttaaagccagtattcacttatcattctgaaaatcctaggcccttaagaattatgccaaatccattctgcctgtggtccataaatgaaacaaggccgggttcagcacatctgtttacagaatggttactgaatattttaagcccacggtggagacctactgctcagacaaaagagttttcaaactattactgctcattgacaatgtacctggtcacctaagagttccaatggagatgtgcaagattaatgttgttttcatacctgctaacaggacattgattctgcagcccatggattgaagagtaatttcaaatttcaagtattattattttgaaacagggtcccactctgtcacccatgctggagtacagtggcacactcttggctcactgcaacctccacctcctgggctcaagcaattcttccacctcagcctcctgggtttctagaactacaggtgtatgccaccacactaggctaattttcatattttttatagagatggggttttgccacgttgcccaggctggtcttgaactcctgagctcaactaatccaatcacctcaacctcccaaagtgctggtattacaggcttgtgccgttgcacctggcctaagtcttactgagaaagacactgtgtatggcaatagctgccgtagagattcctctgatgtatctgggcaatgtaaattgaaacttcctggaaaggatgcaccatttttttctttctttttttttttccccactctgttgcccaggctggagtgcaccattcttttctttgcttttttttttttttttttttttttttttcgctctgttgcccaggctggagcacagtggtgtgatcatagctcactgcagcctcaaactcctgggctcaagtgatcctcccacctcatcctcctgactagctaggactacaggtgtgtgccactgtgcctggccaattttttattttatttccaattttttctttctttctttttctttctttctttcttccttttcttctgtctttttttttttttcgagacagggtttttgcaatcttgactcactgcagccttgacctccgaggctaacgcaatcctcccacctcagcctcctgagtagctgtgactacaagcacttgccaatatgcccagctgatatctattttttgtagaaatagagtctccctatgttgcccaggctgatctcaaactcctgggctcaagtgatccttccatctcagcctcccaaagtgttgggattacaggtatgagccactgcacccatcttatgtttttataatttcaacttttattttgattcagtgggtacatgtgcagatttattacatgggtatgctgtgtgatgccgaggtttggggtatgaatgatcccatcacccaggtagtgagcatagtacccaataggtagtttttcagccattgcccatctcccatagtagtccccagtgtctgttctcgtcttcatgtcaatgggattcaccattcttgatatcatttgtgattcatgggaggaggtcaagatagtaacattaacagtttggaagaagttgattctaaccctcatgaatgactgggaagtttcaagacttcagtggaggaagtgactgcagaggtgatggaaatggtaagaaaactagaattagaagtggaacctgaagatgtgactgaattgctacaatctcacaataaaatttgaacagacaagaaattggttcttatggttgagcaaagaaagtggtttttcaagatggaaacttctcctggtgaagatgctgtgaacattgttgaaatgaaaacaaatgatttagaatattacataaatttagttgataaagtagcagcagaatttgagaggattgactcgaattttcaaagaagttctactgtgggtaaaatgctatcaaacagcatcacatgctacagagaaatctttcatgtaaaggagggtcaatcaacgtggcaaacttcattgtttcaaaaaattgccacagccaccccaaccttcagaaaccaccaccctgatcagtcaagcagccatcaatatcgaggcaagaccctccaccagcaaaaggatctgaatgctcagatgatcattagcattttttagcaataaagtatttcctaattaaggtatgtatattttttagacataatgctattgcttacttaatagactacagtatagtgtattacttttatatgcactgggaaacaaaagagtttgtgtgacctgctttattgtaacacttacttcattgaggtggtctggaactgaacccataatatctctgaggcatgcctgtagtatactattttaaatatattcccaacagatgcttttttattaaggcataaccaatgattattttgatctagaaagtttgctccggggaataaatttatgtactaaagctacagaaggtggtgaagaggttgaaaaaatggaatctaatcatatcattcaaacattttcattcacatctatatttccacttatctcctgaccccaaaatgctaggtaaacaagttaattagaatcaaatagtccgtctataaagaagggcttgaagccaagtgcaggagattccttatgtacatgcgagtcagagagccatttcttctggttacaatcttaaggaaccaaactcaacatgttttgacaaggttaaatatgaatttattagctcagatgtagcatttggttaggtgtggcctgggtcactggtctccagaaagaggtaggaaaaataatttatttaggctgcaaaagaaaaaaaaaaaagaacttatgttcatgatttttatgttaacctcttcaatcttaaatgttctactctagcacatctctttaatgtatgtgaaatattcattgatatggtttggctgtgtcctcacccaaatctcatcttgaattgtagctcccataatccccacatgtcaagggagggacccggtggggggtaactgaatcatgggggcaggtttttcccatgctgttctcatgatagtgaataagtttcatgagatctgatggttttataaaggacagataccccgcacacactctcttgcctgccaccatgtaagacatgtctttgcttctccttcaccttccaccatgattgtgaggcctcctcagccacatggaactgtgagtccattaaaccctttttttttttttttgtcttttttttttttttgaggcagagtttcgctcttcttgctcaggctggagtgcaatggcgcgatctcagctcactgcaacctccgcctcctgggttcaagtgattctcctgcctcaacctcccaagtagctgggattacagacatgtgccagcatgcctggctaattttgtatttttagtagagacagagtttctccatgttggtcaggttggtctcaaactcccgacctcaggtgatccaccagcctcagcctcccaaagtgctgggattacaggcttgagccactgcgcctggccaaacctctttttcttttaaattacccagtctcaggtatttcttcatagcagtatgaaaatgcactaatacattcatgcactagtacataataaataataatgaataataatttatacacacacatatattagcatgcaagtggagggtgagcataacgtgtataaatgttatattttctaacatactaattttttaagccaatgagtgattaatcaaaacagtatggagcttagaactttagatttctgttgttgattgagattggagagtggctgatgctggaagttctatgaagtatggctggagcatgactttggtctaatacttggcctaagtgtgggagatattggccaagctgaatcctgggaagtgaatggagcccctagtttggtagagcataagatatagatgagtagaccagagaaggtgactgggccaaaaggttgagattgtctgggagaagcaagtatccagggtatgctaaactacaatcaaatgggtaatgttttatggaacatttgcagatgtagcctaagagagtcaaagtggaaggaacctaaggagtctagaacacttgagaagagagtgagagaggtgagagcctaggagtctcccaagagcacatatttgccatgcccattcgtctgtcatcctagccagtaacctagtaggttcttgcagtaacaggacacaggacagataggtttcaatagcaagtggtagggggggagtctggcttgcatggggtatgaatgaaagtcctagaagcttgaatgagatagccaaagataagataggagcaccctaaaattacccccccaccaccagttttgcggagggttgattctgcctaaacatagtgtctacttcatggccaattctggcagatatagacattctatgataaaaggctatccttaagacattgagtttcttctgtctcccccaaaagaaaaataaacatgtgaagagaataataaaattagaaaaaaaaaataaagttagaagcattttagctagtatgttcctctttttttgaatggaatacaaagacatttcattttcgtcttttttagatagtgaactattaaatttctttggtaataaatgagaaaaaaagaggaaagaaaagatctgggctgcgatgattactgggttctatttgtctttctgataatgtgaatttaaaacagttaaatcacacttacaccactacaaaaattagtactagtaaccttttggagattataaaatacaatatacccagtggacataaatgtgttcaaaaggtttttttcctgcaggtcatttttccccccataaacagagacaaagtgaacatatgattgggttggtaattctgctgtatattgcaattcacccagcttcttgtcattcacagaaatgaagaagacaggcattagattttacttgtcatgtgatattagtagccagatgttttaatggcagcttatctgaggtccatcaatcctttgaatatgtgtagaaaagcatggccattgtttctcacctgcccacatctgaacacattcagataccatggaaaccacaaaggaagaaaaaaaatacttattccaagattcattgattgggatatttaagtgtcctttctttcatacagccaggggtgtgataatgtgctagggcctgctgtgttttctggcatgagctccatctctgagggtcctgagaaagacagtggatggatcctggagtcctcttgaaaggggaaggtggtcctattgagtggaacatgtgtgtctcaaatcctggaggtaggggcagagcaatagcaggggtggggacagggcaatagcagttgaacatggcaaggcaatgttcaccacagctgtaggagcacttggaggtaggttgaagtcattggcagatgcatctgctgctgcagaaggaggaagagctcccggcagtactggaatcagctctagctggatccccgggtctggggttctgtcattttcctttcctctggctgcctgggatcttccccattttacacttagtctgcagccattggtgattaacttattaaaggacttctctacagccacttgtgcagcctgccctgtggaaacctggatgaaagcacaccgctgtctctgcacaacagggattgtccagatctctctaaataggtagagattatttcttaagatctgtctcagtaatggtatcacccggatcaccggtgtctagtgtggggatagtcttatcctctgggagttccagatgaggcgtggctgaagcctactatagaagcttatctgctacagggtcgttgactatataatatcagtttttaatatctgatcagcaagggaatcatgtggacctgtaggcttctcatgtctctatcgaaactcctctcctctcttaccctctcccttcacccagaaggagcaaatgtggggcttattctttaggtaatagggtatggtccaggccagtttgtctagcatgtcactggtggatgtggctttccccagcaggccaactggctgtcttccattcgagttagaaatccctctctccacattctgcgtgtagtactcttctcttctctgacatctgactttggcatgtcatcttttttttgttgtttttttgagatggagtctcactctgtcgcccaggctggagtgcagtgacacagtctcagctcactgcaagctctacctcccgggtacatgccattctcctgcctcagcctcctgagtagctgggactacaggcacctaccaccacacccggctaatgttttgtatttttagtagagacggggtttcatcatgttagccaggctggtctcgatctcctgaccttttgatctgcccgcctcagcctcccaaagtgctgggattacaggcatgagccaccgcgcccggccagcatgtcctcttttaaagacaacgcagcatcacaaacctaggtgggcaggccatgctccaggtctaagaggcaggtctgacagacatacttcaggcttctgcaggttcgacatactttatttttcttgaaatgcatgtgggccccagggcaccagcaaaacattgtgaatggcctggcacagatttctcatttttctcatacttttctttggtcattcagatataatgggtttcctctaagacatgtctgatacagaatggagaagtatgcattttcccagtgtttcctgtttaaggtgttgaaaccaagacaggtcaccatctcgagggggtcttgaagtagtggtaggttttaggtgggagagagacaccatgatcctgtcaagcccagctcttctttgttcccctgttcttgatgctccggacaattgctttgacagtatgtgattctcctttcttgattcaaggtgaaacttacttctcaggaatccccattcttggagaaaactctggatttcctggtctctccaaggactggcctgtaataccagggctttggtagcctgaggcaggaggattgcttgaggtcaggagttcaaaaccaccagggcaacacagggagaccccatcttaaattcatgcttttctgctagaatactgagatacataacctggaagctggaagtccagtttcttcacaagtatctttttccagtgacaaagtaacttccctgtaatctcagcactttgggaagccaaggcagaaggatcacttgggatcaggggtttgataccagcctggataccatagggagacctggtctcttcagacagccagcatggccagggcagccagtctcaccctgtaattgtgacattttgtcttcatgaaatgccagcttgctgacttgtgccgacattttatttctcacagagcagtaagaggccaggaccctttcacagtctgcatggggttgccatggttatgctcaccctccacttgtatgtatcctgaattatgggacaccgagtttatgtaaaccataaaaataaattcttcttctctagacgttcaagtttaaaatatctcctttccaatacatcttataggtatgatgtgcacagctcccactgtggccctcatccatccaaattcaatggtgaaggtgatcgttattactgagaacaaaataaaatggcatagaatgtaaattggctgctgaaggcgatgttgaagcaggaggcaatgtctccatgggacagtgagttcgtgatgagtgacagtacagatgatccccaaagacacagtgggaaggtgacacaggggatcatgaagagctctcaagagagagcggactttgtagtccggcccaccccaccccatacaaatgagacaataaaaatgacttttctcaagacagaaagacggcatccccgtcctgacgaggcatctgctcgcatgttctccttaggaaagatatgagcagctggaagccagccactgtttctgaagacttttttccaaatgtgtgaggctctctctgaattctgactgaactttccccatctctccccaaaatatgctctctcagctcagaagtttgacaaaatcaaatcacccgagctatttaaacatccttctttggataacaccttccaagacagctaacaattgtagcttgtttagactcccttcccattcccctcaccacacacacacacacacacacacacacacacacacatgcaacatacacacacacacacacactagaagccaggaaaattcatctttctccttaagccacccctcctcaccatctaaatgccaagctgacttagagtcaacttctagatttgggattgttaccttcttccttaatctcataacagcagcctctcagtggtcaagctaaatccatttagcttatgtctgacttgtggatcttctggggtggaaacaattttttaaataattctcattcttcagaacaactgctaataatgagaaaaactaatgagcattcataagctgttataaggcacagttcctgttctatgcattattcatttatgcaaactgttgtaaaggtaccaaattcactgtgcaactgggctggaaaagtccctgaactcaagatggcattggtatgcacaattctgaggcttggttctgtttaacattttcatcagtgacctgcttaaaggagcagagagcaagctcattaagttcctagatgggagggatgaccagaacattaaagaacaggattagaatttccccagcccttgccaaattagcaaaactgttagagtcaaatatgttcattagggaggcagagtaaagtaagctgcccaaatataagctgagtggttggaggttatttagaaactgaaaagaatatggatgcaaaaatagacacgtaatggaaaatgaactagtccaggggaaccactggtgttcactggggcctctgctggcccttacaatgggttcagatccccagcctatgaattggtctttcccaagatttctaagaatgccagggagcttttctttcccatggtcacctctagcttcacttcctggttccacctaattagcctggtttttggttcatttcactgtcctgtcttagtcaccgtattacaaaccatgttgacccagacattaaaaaccatttccctcccatgagcagataacagcttcctgcagaagggcccttctatctctttggctgtcttggctcttgttcaactcttccaattaaacctctaccccaaggagcttaacaaggtagtttcctaaatatagacagttcttttcctaagaggaactctgaaaccagctgttaagacaattacagacacctgtgtcccctagcaaagatgagcatgaccaagtcatgagctaatagtgctatagtcaggggacggcaaattctgtgaagtggcagggagtaaatatctttggtctcttgcaattactcaactctggttatatagcatgaaagcattcttacacaatacatacaaatagatggcaaggtcaaggtcctggagtgggccatagttgccaactcctgctaggctcaacttcagaatctgtgactttccagaagtcttaacaaccatcttgtccaaccagctcattttacacccgcagaaaccaggacccagaaagtaggtgacatttgtgcaagttcacaagataattaagcctgagttgaaacttcaaacaggaagctcaacttccaggccagcactgtttctactgcaccatcatcaagctatttccagaaggttctgcagatccctgctttaattagcagagcctttgctagaaattttcccacttaacatttagtgcaatgcattagttgtattatgtgtagtacacaggaatatcatttggtagcctccctaggacccaagatgaacgtgtgactaaagatttgagtgaggttgtgtctacctcctaagggcagtctgaaaaaaccagaagagggcagaatagattagaaaggaaagctatgcacaaagttcaaatgatatagttttattttgttaattaaaggtgacataaaattttcacataccaagaggaacgttttaaggaggaacagttgtctttcatctcctattaaaataagaagagcaagactggaaggtaggttagatcacagaaagaacctgccagaggtagctctgttatgtgcaagaactgcaggccagaggaagtcaccgaattctcttaatagctagatctgagagttgcatcttctgggaagtgttaggagggagagaaataggctgagatgatgactctcaaaatcttttctctctctttaagtcccctgaaagctgcaggaaagaacccttctgtgagccagcagggatgcattgaatcattactcttaatgagaacaagacagtttttttaagaaagttgcgaagggcgtaacatgaagtggatacttgggaaaaataattgtgcagatttcgaaggagtgccccaaatgatgctcacttccattggcaagattcttgggtaactgatggaaaaccctctattcagggtcagaagcttgtagccccttccaaatatttgtgtgtggacttggttgatccctctatctcagtaaaggccagggggttcttaatgtggatggtcgttgatctttaattcgaagacccagtagcttgaacctattcctccttgaaagtcagggccaagtgtttatgagaattcttactacctttgataaagataaatcctagtgtacatcttgttgctaattaaaaacagtacaatctgttcaaatattatttctggacagtacatttcatgaaactatcccacaggattgtttatctcaagctacagctttcagaccctatttttccaaatgacgaattcctcatgattattactttttattattttttttttccagatgatccaggaacatgtacatcttgcgctatggggtattacaggtaagtctggtcttccttttcatggcactaacttttctgcagtttaagcattactgacataatcctcaatccagcgattaaagcaaagtggccctgcagcccgaagcaactctgtcctgtcaggctattaatgagcaattcttggatttagcaataagagcccagctgtttccttgcctcgaaaggaggccatctctttcttgatcctggaagtcatccagcctgacactggtgtctaggaatcctgccatgggttaccaagattcagatcttgctgttcttgggcagaccttaataatatacctggtcctaagtaagctgtttgcaaacgtctgcatggatactgcgtccttaaccagagcgaaggctccagggtgaagccaggtgctatatcagctcttagtcatcccctaggtaacaagagacacagaccactaggttaaatgaaacagaggtaaccatcactcccaatgtactctaaaaacaatccacaaaatcaaaaatggcatgtttcaatatcgccccctcttcctagtctagcttcccttccagcacacactgttgactgtcctagaaggaaaatgaaagagaaaggagctgcaaaggaaaggaagtccgtgggtgatgcatgggctgcataatccctccctgtcctcctaagaactcaggagttttgtgatatacaaactctcacgactatttcatctctcgatcattttattgagattgtcagagacacaggaggatgttaatctcctgaagagaaaactgaagctcagagaggggcaaggttttactccagttgcaccacagctactgacaggtctacatttgcgacatttggcctttggcgggtcacctcctcttgtcacattgccttttccctccatccatagaattggacaaagcaatgtggtgacaagagaaggcgacccacctgtccaaaaacaaatacacttgaaatgtggtaataggtaagaaaaagtaaaaggagtgtggaggatgggagagaaagggaagcccaacaagctgaaacatactaaaaatgatcagttaaccttatcagttcttagccttacggttttaatctaacttttccagaatagcctgccattctctacattgactatgtctcacatcactgcactcctgacccactttgtttttttgggttttttttgtttgtttgtttttaagacagtctcactctgtggcccaggctggagtgcagtggcacgatgtcagctcactgcaacctctgcctcccaagttcaagtgattcttgtgcctcagcctccctagtagctgggattataggtgcacaccaccacgcccagctagtttttgtatttttagcagagacagggtttcgccatgttggccaggctctgttaaactttgtcaaacatcctctgttaaacgttggagccaaacctggccgcctcttcagctctccactactcgctaatgagcatgtttcataaaaccctctgaaaaacaaataccctggaagaacatgctccaatatcactaagggtacaacatgagatatttatttcaagaaacaaacatatataatctttgaaaacattcagcaactttgaatacagcgagtgaaatgccttacaatagacgttgttgctgggcgtgttggctcacgcctgtaatcccaacactttgggaggccaaggtgggtggatcacctgaggtcaggagtttgggaccagcctagccaacctggggaaaccccgtctctactaaaaatacaaaaattagccgagtgtggtggcatgcatctgtagttccagctactcaggaagctgaggcaagagaatcacttgaacccaggaggtggaggtggcagtgagccaagatcatgccattgcactccagcctcagtgacagggagatttagtctcaaaaaaaaaaaaaaaaacagttgttaaggaagatatgcaaaggtttcccctgatatcatgctgatgctctgaaattcatcaaaggcaggggtcaatttcactccactcctccttcaggtaagcctgcaattcagtggagtctgaattacaacattttactgtagaatgagaataacagataacgtacataaaaatatttataaataaaagctaagctacttcgctactattgttaataatctggttacagacattttagtaagctgcctggactcgacaccaagctatttcaggcctcagtgccagttgctatgtgataaatcacacaagcaaccttttcacacagactttggttaaaatcccagtcccaccgttagctagctgtgtgatttttgagcacttaaccctgagctccagttcccttatctagaaattaaagttacatgatatctaccatacgagatttgtggagatttagatgagctaatacttgacacataatcagtactctataaataagtatcagtaccccttctttctccccagccttctcccagctgccctgataaagagtccttggaggtccagaaggaggtggttagtgacttgggttgaggggtgcataacagaccaagcctgaaattcaattatccactcctgttgaaaatgctgcacaggctgggcgtggtggctcatgcctgtaattccaacactttgggaggcagaggtgggcagatcccctgaggccaggagtttgagaccagcctgggcaacatggcaaaaccccgtctctggaaaaaaatacaaaaattagccaggcatggtggtgtgcacctgtaatcccagctactcgggaggctgaggcaagagaatcacttgagcccgggagacagaagttgcagtgagccgagattgaccactgcactccagcctgggcgacaagagcaaaactccatctcaaacaaaacaaaacaaaacaaaacaaaaaattctgcatggacatacataaggagattaaattatggtgaggagaaatacatcaacataagtcatgaaagaaatgatgtcttcttcctctaggtttgatcaccattgttataaaacctgtcctgagaagacctacagtgaggcagtggaatgcaaggcgtgtgatagtaactgtagcagctgtgaccagaatgggtgttactggtgtgaagagggcttctttctcttaggtaagttagaaaatggcaccatccaagctaagaaccaggcactggagctccacacagtcggggccacaggagcgcacatgtgattggtttcagagtctgtgcgtgtgggcacctctggcccaaggagaaattttaatttggtttagaaataaacattagccaaaccacctccttctgcttttattactgaagcatggttcctgttccactaattaatctcaaatatctccaagctgatggaaacaaggctgaattggatggagatagagagtggggacctgaagatgaatgttttggcattgaagtcacctggcatattgagagctctgacccttgtcttgagacttaatccatcttatatatccccatgcactgtaagaatctaacaagatcccttgccttaggctttggtcaactcactgactgatggaaatggatagttaggaaagaaatacagtgtgactcttccagctgaagaggataatagcccaatgcacttgagtgtttgggggagaaagaatgagaaggacagcccacaatgatcttcagtgtttctctacacagagatttattttatttgtaatttttcaaggcctcaaggattctgtattcgatgctcttaaccctctaatggccaatgtaaattcccagttgaaaaaggacttaggtaaagtgttggatttttctagatggagtctcactcttgtcacccaggttggagtgcagtggcgcaatctcagctcactgcaacctctgttggccaggctggcctcgaacacctgacctcaggtgatccacccacctcagcctcccaaagtgctgggattacaagcatgagccacctcgcccgacctggatttattaaaacacatttcttggttgacataagctaaagccatcttggtttctttgaaaacaaatgcaaaggctggacacagtggcctggccaacatggtgaaaccccatctctactaaaaatatataagccgtgcgtggtgacacatacctgtagtcccggtcactcaagaggctgaggcaggagaattgcttgaacccgggaggtggaggatgcagtgagccgagatcatgccactgcactttagcctgggcaacagagagagactccatctcaaaaataataataaaaacaaatgcaaagaaaaatgtccctaaaatttcctccagcctctttagaacttggccttgcaaagatcactaaagccttcatgctttctctctgtgttctcacataggtggcagttgtgtgaggaaatgtggtcctggattctatggtgaccaagaaatgggagaatgtgagtcctgccaccgagcatgcgaaacctgcacaggccctggtcatgacgagtgcagcagctgccaggaaggactgcagctgctgcgtgggatgtgcgtgcatgccaccaagacccaggaggagggcaaattctggaatggtatgtgccccccaaaaaagaggtcacaggggtctagcgacctactctgcttccctccttctataactctggtttttttagttatccaggagagaaaggctgtgcagaaaaacaagagtttggagtgagaatcaagttgggatcgttcctgagtctctctgatgcttgcagtaggagtgggtaggaagctgaggttggcattcagccagcagagagagcccaaagggcaatttataattagtctacctgcttgagtttctacctgggtgaagcaggcccggaagcaagtgaagagagtcacggagggaaatggccctggtatcattttctcagaaatttcggagtcacttctatcacaggcatgtcctacgtccttattacatgtcctttttacagtaaaggaaaattttacctgtagggtaggcttttccaattagacaagcaagaactgctcgaatgtattagattttatgctaaaaacagacggtctctatggctgcgttattagagctcaccgtcagtcaagcttgcctttaaaagttgctcttcccagttgcagacagggaaagcgtgaagcttctgaggagggaggagaggggacaggtgtgggagcttggaatccaacagcaaagccctgcaggtgctcattcctccccgagtctttagaacgcgcctcctcacacttgagcgtcagttataggcttccttgcaaggtaattacaaactttcagcgacccctctgtgaccgaggtggttaaaaaacaaaatcctcttcctgttggaaaaatctgactcatgttctatgcggagacagtcacaaaaacaggagctgctcttcatttgatttcgaggcaagaatttgttaaaagggtcacttcggtgcaaaggcaacggcagccgaagagagtgctgtacaggaggagtgtgctaagggctcgagggagtgacagctctgtggtttttgctgggctggagaggaggcacgtccatggctgctgtctactacggcagttttacacatgtgacttcaaggaagagcagctcagagaccgtggaaagcccagcagccaaaggccacggagaacacgggccctatttcagagacagagccgagaagattattcaatccagattgggctatcttctgtgagttatagctgaagcaaaatgctgaaaatgagtttgtttggcattcaggcatttaagaggcagtgcaagccaaaaggaaaatggtctggtgctgtgtttctagctgaacatctgtattttatctggcgtccagatgatgacacggtccagggagccaagagttagagcaggcttgattccccaaatgattccacgtcccttcaactggactacgcattttgcaagcagaaaccaggcttcagtggttcccttttgtcgaagcaccacacccacccctccacattttctactatcacaatgtaatgtttttgaggagagggaggaattagtgcatttggggatttttcactaataggggattggggacagagatgagagtgtttctcatggctggacaaaagcaatcaagtcaacgacagagctgtactttcccattcccatgacctatgaaataagacatgcagaccattaacacagagaaatagccatttattcactaagcaaggtaaagctgtagctcagcttcccccagcatagtgtaagcactgaaatggatagtaaatgggaaatgcattccataaagtcctgggagtatttgagccaatgcctacaaccttctcctgacttctttttcttaaaaaaaaacaggatcgagagtgtaataggagaggagaggcttccagagaacaagcactaattagccacacctttcagatgatggaaagcagattgcagtcatcctgggtcaattcagaggaaacccaggcaaattacagagtgtttttgagaggatatagctgcctaggtggtaccagaacgtttttctgtttcattttgggttttgttttattttgtttttcaaacacagattcagattcaggtaggaaaggtaagatgacacacacttcaatccattccttcacccatgctgctccccagtggaaacaataagatcctgtttgcgtctgaagactacaaccaaccccatgagcatctatcagcacaggctgggaaaacacccttgaaataaaagtccagctagagttccctgaactcctcttttaataaggtggctaatcagaatgagaatgacaacagtgagagagccaccattctttgccaactgccaacaaagtgggaatacctcctacctagtctaaggatgcagattcctccacctatcagacaatgcctgacaaatcctccagctaagactaagtaatcaaagattgtgctcgactctctgttttttcagccaccaaaaagtcactgcacaaatgtatagatcatccccagaccctctctcctggtcactagtatattgtgacaattatttagtgtccctaaatggcaggaataaaaccaatattcaaggccggacgtggtagctcatgcctataatcccagcactttgggaggccgaggcgggtggatctcttgaggtcaggagttcgagaccaacctggccaacatggtgaaacctcatctctactaaaaatacaaaaaaaattagccgggcgtggtggtcagtacctgtaatcccagctactcaggaggctgaggtgcaagaatcacttgaacccaggaggcagaggttgcagtgagctgagattgtgccacagcactccagcctgggcaacagagagactccatctaaaacaacaacaacaacaaacgaacaaacaaaaatatataatattcgacaggctgcaaatggcttcagcagtgactcaagcatcacacaaccttggtggaaaggttcaggtatggcagaccacgggctttgaaggaagatgatggcttcggctggtttcctgaagccacttttgggaatggaagcactttcctctgctactgttaaaccatttggattttcttaagtggtttcccccggtagtgctggagagtcctaggagtaatttctgcacatttatcttacctcatatttccatcattgattaaaaccatgttatagcaggttctaattacatattctgctgatagtctaatctacagaacacagacatggtgaattagctttgtgtttgtgaccacatcctaacaatttatcactagcctgtctcttgatcttaattctaatccttggggaaagactgaaatcccagagttagtcacaaacactgaaagtcactcacatgtgaaaaaaaataaatcgacttcagtagtgggaagatacgttgcctaatagtcactgaactttagaaaacttcaaagatgccatggaaatctgatttttagagagactttatagatgtgtacagctgtctcacttagaaatgagtacaccatttttagttatttaacctaccagaacacagagtgcaaaaaaacacatggcactgggtaagtaattaactgtttggccagtaggacaaaggaagcatctgtatcagcttgcccagatcgttatatactcaggagttctggaagtggattgtgaaaccattgacagcttgaaattagctatggtgggagtatttacaccacagaaattggaaacactgcaaatcaggtttttggtttttcatttttctagagacctgtcttaccagcacaccattattttggcttctatcaaattacttcagaattcaaatttattgctgaaaaattctaaagcctatgtctacaccctctagcagatgcaggctttagggcacagcacacatgaattcaaatcccagctctgtgttttgctagctgtgtgaccttcagtgagttactcatcctctctgagcctgtgtccttctctgtaaagtgaaaacatgaaactgcctcacacaaagtcattttaagaatgaaatgagaaaatgtatataaagctctcaggacacatataacacaataaagcctcgtctactccctaactatttgactcggtccagttttaacacttgaaacaccagtttgctttgaaagcagcattccctgggtcacaaaagaaagcaatatttggggccatgcgcagtggctcacacatgtaatcccaggactttgggaagctgaggtgggcagatcacttgaggccaggattcaagaccaacctggccaacatggtgaaaccctgtctctactaaaaatacaaaaattagccaggtgtggtggcacgcatctgtagtctcagctacttgggaggctgaggcattagaatcacttgaacctggaaggtggaggttgcagtgagccgagatcacaccactgcactccagcctgggcaacagagcgcgactctctcaaaaaaaaaaaaaaagaaagaaaagaaagaaagccatttgagagggtatagacataaacagggctctaagggaaatggccctggaaaaaaaggcaccagataatggtaagtcgggatacctaataggcagaatcctgacttagccaagaatgtatactcacaaagatgttgagagcagctttacgattttaaaaagagaagggaacaatctcaaaaatataacaaaagaaaaaagctaaatgaattaccatccatacaaataaatatgcaaaccattgaaaatgatgtttacagctgggcacggtggctcatgcctgtaatcccagcactttgggaggccaaggcaggcagatcacgtcagtccaggagtttgagaccaacctggccaacacggtgaaaccccatctctactaaaaatacaaaatactagccaggcatggcggtgcttgcctatagtcccagctacttgggaggctgaggcaggagaatcgcttgaacctgggagccagaggctgcaacaagctgagatggcgccaccgcactctggcctgggaaacagagcaagactcctcgtggaaaaaaaaaatgatgtttacaaggaatgctaatgacaagagaaaatacctacgagatttatagtgttaaatgcagtgttcagggtcagtcttatgtgtacagaagctataaatgatgacacatctatacatagactgtaattatactcacacactcaatatgaagatgagacatccatgtaccacagtatacacagcagacatttctgggtggtgggtttataggtgaagtttatcttctttatcctttttgcattaaaaaaaaaactaaacacttttttttttaataaaaaagaagctgtgtccactgcaaacctatctgtggtgaagagcctgctgcaggagcgacgaaggtggaaagttcaaatcaaaagaggtaacagggaaatagggaggcaacaatcacagcagcagagactatctctggagatggtctccgtggagaaatcaccccaagaagctgggaggccagaagcaaatggggtgcagagatgcagaggtcattagaaaaagttggagacaggaggggcaataaacacaacatatcagtgggcactcagagggaagactgtgagaagttccacagtggagatttctgtaacagataaggatattcgtgacgagctaaatggtcatggctggcagaggctatcaagaaaagcctctgtccttgcagaactttaataggctaaggaagcacctctgccttcccagtcaccgcagcattgtttgaaatcacaaagactggaaaaaactaagtggttaccagtaggagatgagagaaataaagtcgatgtattcatacaatagaatactatggaggcaccaaaaggaagaggttctttctgtactgataaagaatgatttccaaatatattgcttgtttactttacaggcaaggtgataaaccgtgtgaatagatacagcttgtatgaaaaagggtggagaagggattgggagagagacatcacagtacatgccttttctccattttgcaccatgagtgaattatgtattaaataaaaaataaatacaataaatgaaccccttgctttatatagtttagctacagtcatttctgaagaatggacactgcactttctgggtcaaagtggttctttttttttttttttttttttttgtggtcctgtccagtctagaatttccaaagttggaaaaagagaaactatgatcacggttaaaatttacttgttgagatttaagtccccaatcttttatgataaagaactcttgctgaggaggactttatgccctgcccaggcctaattgctaagttaactgcttgtacagatctccctctggtggacatatgaagacattacagaattttattttatttttatttgttattattttttaagggacaaggtttcaccatgttgtccaggctggtctcaaactcttggcttcaagctatcctcccaccttggcctcccagattgctgggattatagacataagccaccgtgcttggctgacattacagaatttcataccaggagtatgcagtaaaataccaaattgccagaacgtgagatacatgtaattataaatatgtgcatatttgtagatatagacattaaaacttatacaaatatgagaaaattgatgaaaactcatgtctttataaatatattttagtatatacatgataacatcaaaggaaaatcagcctgaagcctggacatagaacattgaagatttgcacggtgttcactgtctgattaatattgttgccttattattctttgaacaactgctctcagccattcagtgagcatctgactattagcaacaggattgttgcttgcctttcggctgccttctctttggggctgagtgatactgcagttttaaaaagccctcggggacagaatcggttactttgagaggcatgcggaacacctttgtgacaatcctgtggccaaggtggctctgcacaaggctaaattcagcccttagcagatgccccagagagaatacatcagtcaatcatcagctttaattagtgtattggaaaaccagggggctggctgcagtagctcacacctgtaatcccagcgctttgggagaccaaggcgggtggaccacctgaggtcaggagttcaagaccagcccgggcaaaatggtgaaaccccatctttactaaaaatacaaaaattagccaggcttggtggcaggcacctgtaatcccagctacttgggaggctgagaccagagaatcgcttgaacctgggaggtgaaggttgcagtgagccaagattgcaccactgcactccagcctaggtgatggagcgagactctgtctcaaaaaataaaagaaagccagggtaaatttttatctccaagctaggaaaaaaccaactacccagcctggcagcctaatcatttatatctccatctccacctgtatttgcatctatccgcatatctgtgtctatccatcctatctatgtatgtacctttctatcatctgtatttgaatctagtttcatctatggcaaggctcatcagctttgtatccatgattgtcatcacagaagctgagcaggccacccaggtatgaaaccagagggaaggaagaggggagtaaaacaagcctcagaaatggagtggaatggtggcaggagagaatcaacaggaagctgaaggaactacaatttactgcgcccctatgttaagcacttgacacgtattgtctcatttagtcttcacaacaatcctataagggcagaattattttctctcattttagagacaaggaaagtaggattctgagagtttaattactgtatccatgtgcccctatgttaagcacttgacacgtattatctcatttagtcttcacaacaatcctataagggcagaattattttctctcattttagagacaaggaaagtaggattctgagagtttaattaccgtatccatggttaccctacccttcggcggcatagctgggatctgaaggcaggtgtgactagagcgccatctatacccggctgactcttaggatgagaagaaagaagatgaaaggcaggagaggaaggaagggagaaagggagggaggaggtaataaggaaaatggtaagatgtcaacattgattgagggtcagggtcattgaaatcccacattctgagctagaacttcgttttctaattttttcctgtgtgagccatgctgatttctgagcaatccctgagctctagtcaaggtctccatatgtattgactgagtgatgtcttgaagctgttctgtccttgaaattgtcccatggagttgctgaggtgacttcctgggaaagcctgcccatcaaatgctgttggagggaaagggagaagggaacacttccaatgtttccttggttaatggtatattaacctgggacaacctacttatagcccgaccaacaagaaagcctgtgagtaggggataattttgatgtttaacaatgatttgggacaaacttaagatgagataaatttaggttgcatagcacagtagctactctaaagaacacagtgacccaaacattgaccaataataaaatctgattttcaaagaacaaaaacagaaaaaaaaaagaaaagaagttcctccacgagaggtacaatgaattgtcaattatcatcttggagtgaagagaaatggtcatccggccgggcgcggtggctcacacccgtaatcccagcagtttgggaggctgaggcgggtggatcacctgaggtcaagagttcaagaccagctggtcaacatggcaaaaccccgtctctactaaaaatacaaaaattagctgggcatggtagtgggcacctgtaatcccagctacttgggagattgaggcaggagaatcacttgagcccaggaggcagaggcggcagtgagccaagatcacaccaccacactccagcctgggctacagagcgagactctgtctcaaaaaagaaaagaaaagaaaagaaaaggtcatccaacaatcttggcaatagaagtgattacctttgactcataaactcattcacaagtgcatacacacaaatacaaactcactcccatttttaacacacaaaagaagtaattatgtgttcaaatatccccacagtatttgaggctatcttgtagaataccacattccttgtggtaccacacattcgtgtggtatctttcttgataatcaattgcaaatgaaggagtaagagaaaaaaaaataaatgaagtctacacaatggcaatgagccagtgccaacaatcagctcatgtacaatcaaaaggattccatctggggcaggaaaagagactaggtaacccatgagatctttttcagtactggaatcctatgtgcctattccaaggagaagcctgaactgttgtttctttctcatacagatattttgagaaaactccagccttgtcattcttcttgtaaaacctgcaatggatctgcaactctgtgcacttcatgtcccaaaggttagtgtgttgcgtgacagaagatggcagcagtcaagccaagtcattgaaactcatgtgtagtggcatcttggtgtaaggaggtctgtaaggccttgatctattcccatcacatgttcctattacagtggctactcgggagacacacagggacccaaacattgaccaataataaaaactggctttcaaaggacaatacaaagaagtggtcaggtacagtggttcacacctgtaatcccaacattttgagaggctgaggcgggaggatttcttgagcccaggagtttgagatcagcctgggaaacatagtgagaccccatctctataaaaattttaaaaattagctgggcatggtggcatgtccctgtagttccacctacttgggaggctgaaatgaaagcattgcttggtcccaggaggtcaaggctgcagtgaaccatgatcatgccactgcactccagcctgggtgacagagcaagaccttgtcttaaaaaagaaaaaagtttcttaatctaaaggcatgatgaagagggagggaggaaggaataagagcagcaacataacagcttgataacttatcaattgcttcatctataaaaacaaaaatcacaaataacataacttccctgaattaggagaatattttacttaaatggtacactgacataaagaatgtttaagtgggctgggcatgatggctcatgcctgtaatcccaacactttgggaggctgaagcaggaggatcacttgaggccaggagttggagacctgcctggccaacatggcaagtccccgtctctactaaaaatacaaaaattagccacatgtgttggcacatgcctgtaatcccaggctacgtgggaggctgagacatgagatcacttgaacctgggaggtagaggttgcagtgtgcacttcaacctggatgacagagcaagacgctgcctcaaaaaaaaaaaaaagaatgtttacatgtttccatgatcattataaagtccacgttggaatgtacaatgttaatagtggaatctgatgcaaaagcagaaaaatttacaataataggcaagccacaattataatcatataaaatataaaaggttacactcaaaaagctaaagcattttcctggaatcttgggtgtgagagtgattttgaaaattggttttcttaatgagtatcagttgtttttcgattgaaaaataggtggatcccctgttaaagggagagttgggtggaagagttgtaactctgggccgagcctgtaatgccagcactttaggaggctgaagcgggcagattacctgaggtcaggagtctgagtcccgcctgtccaacatggtgaaaccccgtgtctactaaaaatacaaaaattagccaggtgtggtggtgcacgcctgtagtcccagctgctcaggaggctgaagtaggagaatcgcttgaacccgggaggcggaggtcgcagtgagccaagatcgcaccagtgcactccagcctgggagatagagcaagactccttctcaaaaaaaaaaaaaaagagttgcaactatgttagtgtcctaacaagatgggctttggggaagcagagtattaatagattccatcaagctgtgcatgtacagctgccttacaccaggaagacatagagagtgtgttaataagactgatcaactgggcaaaaggaagccccatcatgacctatacctaatatctgtaggataggaaagaaacaggcaaaagtctcttgctgtcaattgccttctagaaatgtaactcatcctggaggacttagcatcactagcaaatattttggtaagcctgaaataagtgcctggatactttggtctttggaaagcttaaaaaagccatgtctctgcatggaaaaccacatgatgactattcccatcttccctcttccctgaatttctaggtgcatatcttctggctcaggcctgtgtttcctcctgtccccaaggcacatggccttccgtaaggagtgggagctgcgagaactgtacggaggcctgtgccatctgctctggagccgatctttgcaaaaaatgccagatgcagccgggccaccctctcttcctccatgaaggcaggtgctactccaagtgcccggagtaagtttcctttttaattttacttcctgcttgtaatcactctcctatggtactttgggagcaattctttcttattcaccaaaaaactcttctctgctctacgagcacccacataaatgtcctctgttgactgacatgggtgtgcgccacagcagccaaaacttacatgaggccagatgcccacttctcctctgtgactattttatgtatatatttttacttttatgaaaaatatgttcaggggctgggcgtggtggctcacacctgtaatcccagcacttcgggaggctaaggcagaaggatcgctaggaatttgagaccagcctaggcaacatagcaagactccgtctacaaaatatttaaaaattagccagtgggtgctgtagtcccagctacttgggaggctaaggtgggaggattccttgagcccaggagattgcagtgagctgtgattgcaccactgtactccagcctggatgacaaagcaggaccctgtctttaaaaaaaaaaaaaaaattattttcccaccttatattaatgatcaactgatgtcatgttttttttcctccattacaaaagtaaggctgtgatgtgaacctcttctaaaggtttaaataggtgaggcatgaattatagataataaataacacctggttagttatttattgattcctcctggtttccttggtcccctggtttgtagttgctttactcttcctaccaatagtcccacctccagaatttacctaggaagaaagtgaggaatagcaaatgcaagagtacagcaagaaactttcagcaataagcaacagaaatgccaagtaaaatgactgagacataacagggtttattatctcacagaacaaaaatgctgcaagtccagtattggtcacttcagcggccaacaaggtcatcacaaagtctggtttttctgtttcgctcttgtaccttccttagctcatcctctctgactggcaccgctgctgagcccacattacgtgtctcagctccagacacggtcaccccatgcagccactaccagggccaggaaaggggatgtttccccttgtttatccttttcttgaagaaaagaaaatttcctcagatttttattctaatctcagtcgcaagaatgcatcactgatacctccctaaatcaatccctggcaaaaagaatggaaatataggagtggtttaggctgaacaagattcacgcctgaacatccaagcaactcaggactctgacagccaggaagaatggagagagggaggcaggaaataaatgtgcggaagtaactgacagtgtctactttaaggagttagaattttcatttgccctcttattaaaagaatttgatacaacaacgcctatttcctggctgggcgtggtggctcacgcctgtaatcacagcattttgggaggccaaccgggaggatcacctgaggtcaggagttcaaaaccagcctgaccaacatggagaaaccccatctctactaaaaatacaaaattagccaggcatggtgtcatatgcctgtaatcccagctactcgggaggctgaagcaggagactcgtttgaactcaggaggtggaggttgtggtgagctaagatcacaccgttatattccagcctgggcaacaagagcgaaactccatctcaaaaaaaaaaaaaagcaaaaaagcaaaactggcacctatttcctagtgacctatttgttttcattactgagatagactctatagagtataaatataagttatgagtataaatatagagtataaatataaggtatttaccctcaaaaagcatccaatctagtgtagaaagccaagcatattcagctcaacaacacagatttagcaccaactaggggtaaaaattgatactgatgcaatatcaatatattgtattgtatatgcgtagctcagtggagtctattcttctaccaacaattgatattgatattgatattgatgttgatattgacactgatatggaaagctaagttaagaccaactccaggaagtccaagtctgcaaaaatgcttacaatccactaagggaggtttacatcagtcaatgtcatacttctcagggccttaatatacaaagggctaagagattccaagagaaaagaaaacattttaaatcactattttttgaatgcttgcaacgtccaggtattgtgctaagggctgtaaatgtatgatcccattaatcctcacaagaattctcttatccacttactattattttccctcatttgaccaatgaggaaaagaatagcaggctcaattttacacatcaaatacatggtgtggccagaatttgaacccaaacctctctggcattgaagtccatgtgcttaactatcactcagtgctgccttcttgtacaattgagtattttttaaatcacaactttattgagatataattcacataccatacaaatcacccctaaaagtgtataattcacggtttttagtatattcacagagttatgcaaccattaccacaatcaatttcagaacattgtcatcaacctagaaagaaaccctatacccttttagctgttattcctactttttccatttcccccagccctaagcaaccactaatctactttctatccctgtagatttgctattcttggacatttcctataaatgggattatataaaatgtggtctttgagccaagcatggtggccatggtgcacacctctagtcccagctatcaggagcccaaggctggagaattgcttgagcccaggagttcaaggtcagcctgagcaacatagcaagaccctgtctctgaaaacaaaaacaaaacacataaaacaaaaaagacaaaacatgtttttttctgacagactttttgacttagcataatgttttccagcttcatccccagctgggtatttgagaaaaggcttgatggtccctagctcttgaaggattttgtcaagcagagagtggagaaagggtagcaaagggtcagagtaagagaacccaggtgagaagtcaggtttggaaactcccagtcctcctcccctatcaaccgagctccaccccagcaaactcagccaagtgttacaataaagcaaaggtgaaagagatttgcttaccagagtcagtcattgcttcctcagtggtaggattgaactggttgtcattattattgccttatttatttaatcattacctttttcaactctctcttggattctttgagtgttccaggaattgacaacacattaaaacaaggaagaaagagatgcattttgctttactcaagttagttgaccgcttaatgtattttacctcagagtctgggttgaaccattttcatggagcaatgggacactacgcagacatgcagcagtcaagatagtctgtatttcttgagcagtaggaaagctaccagcatggcctaggaatattgcagactatagaattgcaagcatatgccctcctgttatgggtagggtgatctgattatagcggaatccctcatctttgtgtttaaacacacaaaaaaaagaaaactaacaacagaagacacagagtctgaggaacacataatatccagtttatcttgggaagctttattgctgtttctgagaaatcacccttttgggtgtgatccatcctagaacagcaataagatttataacaggaacataacctgcaatgacacagcatccagatattcagagttatttataagttagcatttagtggcccctgctttttcaaatatagtacatgttcatgaaaaaaaaaagtgtttgttttttttgagaccaagtctctccctgttgcccaggctggagtgcaatggcgcgatctcggctcactgcaatctctgcctcccaggttcaagcaatcatcctgcctcagcctcccgagtagctgggattacaggcgcatgccaccacacctggcttatatttttttctatcttttgtagagatggggtttcaccgtgttggccaggctggtctcggaactcctgacctcgtgatccgaccaccgtggcctcccaaagtgctgggattacaggcatgagccgccacgctaggccaaaaataggttttaacagtaacgtatttttttttttctgagatggagtttcactcttgttgcccaggcaatggcgccatctcagctcactgcaacctctacctcccaggttgaagcaattctcctgcctcagcctcccaagtatctgggattacatgcatccatcaccacgcccagctaattttttgtatttttagtagagatggggtttcaccacgttggccaggctggtcttgaactcctgacctcaggtgatccacccaccctggcctttcagagtgctgggattacaggcatgagccactgtgacagtaacatatatcattacagtagttgtttaaaaagcaacagaaaacttaaggtggactcacattcaccaaatgtgaacagatttgaagctctgttgaagaaaaacagccttcctttaagtgctgctggtcactgtcttggtgtctgtgaaatggaggtgaaggcccaggaccacacagctttcacaggacatggatttatctgagctgaaagacttcaacattaagtactttgaatttaacgatttagtacatgcaaccatttcttttcaaaagaaatattcatcttcttaaataaaataattgtgaaataaagcactaagaaaaacagttttataaatgcagagacaggaaaggagaaccaactcccaggcagatctgtgtggagaagactactttttttttttttttttttttgagacagagtcttgctctggaatgcagtggtgcaatctcagctcactgcaatttctgcctcccaggttcaagcgattcttctgcctcagcctcctgagtagctgggattacaggcgcccaccatcaagctcgactaatttttgtatttttgtagagacagcatttcgccatgttggccaagctggtcttgaattcctgacctcaggtgatccacccatctgggcctcccaaagtgctaggattacaggcatgagccacttcaagggtttttttttttttttttttttttgctttttgcttgaatccatttctttcatttcagcatctcatccaacatccactgaacctcttctgagagggatctgaaaaagatttattcgtgttgcgtctttttagctctgtattagcattcatcatcttcagtgtccagaaactattctctgcaggtcttggccaggcctagcattgagattccctggaggtgggcctgatcttacaaagctcccctcctttaaacacagagtggatcattgtggcaagccagttcccaccttaagtttacaagatgtggctggccccactctgagtcatcccagtaccaactctcaggtgtggcaagagagacccatcatgaataacaaagacacccctaactcttaggaaattccaaaggttttgaggttagccgaagagaaagaccagacctctctttgggtgaggtcaaattctttactatgcttacaggaacaatgaatccatcaaattttcattcgattagaagatgtgattggtaaggtacacctgtaatcccagcactttgggatgccatggtgggcgcactgcttgaggccaggagtttgagaccagcttgggtaacatagtaagacccccatctctacaaaaaaaaaaagataaaaatttaaaaattagcccagtgtggcggcacacacctgtagtcctagctactcaggaggccaaagtgggaggatcacttgagcccagcaagtcgaggctgcagtgagccatgatcacaccactgcactctagcctgggcaacagagccagaccttgtctcaccaaaaaaaaaaaaaaaaaaaaaaagaatgtgatctatttaagaatgcactaaatttccttaatttcaaatttctcaaatctgatcaaactgctggtgggcatataacacattgcctgtcttgttcaattcatttttaagagatagactttgtttgagcaaagtagctgagtctttcttcttcaagtgttctctgtcatggtcaaaaaaaagctaagggtactactgtgtgaggaagctcaatcttagcttttatctggatgctatttctttctctctcttctacctagactgctttcttctccaatttttcttacctgaaactatatcagaaatatgactttttggctgggcacagtggctcacacatgtaactgggaggccaaggcaggcagatcacttgaggtcaggagtttgagaccagcctggccaacatggtaaagccccatctttactaaaaaaatacaaaaattagccaggcatggtggtgcatgcctgtagtcccagctactcaggaggctgaggcaggagaatcacttcaacccaggaggtagaggttgcagtgagttgagatcacgccactgcacttcagcctgggtgacagggcaagaccctgtctcagacaaaacaaaacaaagaaatgtgacttctgttcacccctgccctatttcttcctggaacactcaatatatttttgtttactgaatgcatacagtaaataaatgactgaaagaatgattaaacgtgtgagtgctgattaattaaaacaccaagtaaaaatgctgggtagcagcggatcccttcctggcttgtgatttaaagaggtctctggtagattgggttatttgttgcagttcttcgccactcctcgtattcatgcccactgcctgcaactttgcaccaactccactagaggtgaaatggacttccttgtcccttgactttggctgggttatgtgatttgttttggccaatgacatgttagcagaagaaaggtggaggcataaaatgtgcccgattgaacttgcccttctgcgcgtttgtcatggctgtgagaagaacgtcccctggtagtcccggtagccagggaaaatagaggaatgtgaaggcatggacccagtgtgtagcctggagtcaagcctgccaagcccagcctagatctgcttccccacacacatgagtgagagtaaatgattgttgttttaagccactgagttttgggttgggatggtttgtggcacagcaatattatggcgctaactcactaattgatcatgatagaaagcaattggaataggtacctatgacatcagaagtccattttctctaagccggcttatggttcttcctcttccgcgagttccagctcttccattcagcttttcccaccaaagaaacctcatctaagttcatgtcttttgcagggacatggacgaagctggaaaccttcattctcagcaaactaacacaggaacagaaaatcaaacactgcatgttctcactcataagtgggagttgaacaatgagaacacatggacacagggaggggaacatcacacaccagggcctgtcggagggtagggggcaaggggagggagagcattaggagaaatacctaatgtagatagatgatgagttgatgggtgcagcaaaccaccatggcacatgtatacctatgtaacaaacctgcacattctgcacatgtaccgcagaatttaaagtataaaaaaaaaagaaaaaagaaaaaaaagaaacctcatctatccatccctcatctcccaaatatatttgagaggattggggttgtatattttactgtgttcccccaccagtgagtgatttctacaatgggatagtttaatcactggggttctatatacacagacataagattccgcctggaagaaggtgatttgcacaaacacgctggtactcaaaatatgtttagtgctgtgtgcaaatgttcatatgtatgcatttgaaaaaagtcatcagaggttggttgacagcatccagtggttccaatcttacagggcattaacccttttgagtcttttggaaatttttattgtttattaaatgtttttaaaatttattaattgaataaaaaatattttccactttaaagttaggctctaacaaaaagaaaaaaataataaaacttgggtcacatagggaaaagagaagatgactaaactatacacaaattaacaacaattgttctcaaaccaatcaaattcacaagaatatgaaccccaaatatctgaggcaggtctcagtcaatttaggaagtttattttgccacagttgaggacacatgcccatgacagcctcaggagttcctgatgacatgtgcccaaggtggccagggcacagcttagttttatactttttagggagacatgagacatcaatcaatatatgtaagatgtacattgtaggccgggcgcggtggctcacgcctgtaatcccagcactttaggaggccaaggtgggcggatcacgaggtcaagagatcaagaccattgtgggcggaggattacctaggtgccgaggcaagagactgaaggcacaaactgtttcagtataataaagaaaatagttagaataagaatagtcataatacaaattagatatagagatgatcatggacaattatcaatcattattaatcattagcttttaatattactctttgttgcattactaatataacctaggaataaccggcaggtatagggtcaggtgctgaagggacattgtgagaagtgacctagaaggcaagaggtgagccctctgtcacgcccacataagggccgcttgagggctccttggtcgagcggtaacgccagtgtctgggaaggcacccgttacttagcagaccgcgaaagggagtctccttttcttgagggagtcagggaacactctgctccaccagcttcttgtgggaagctggatactatccagacctgcccgcagtcatccggaggcctaaacccctccctgtggtgctgtgcttcggtggtcacactccttgtccactttcatgctcctcctgcactcctggttcctctttgaacttcatagtagatagcggtagaagaaatagtgaaagtcttaaagtctttgatctttcttataagtgcagagaagaaaacgctgacgtacactgccttctttctctgcttcggctacctaaaagggaagggccccctatcctgtaatcacgcgacttgcttcaccttgtcaatcacttagaaggttcactctccttaccctgcccacttgtcttgtatgcgataaatatcggcgtgcccagccattcggggccactaccggtttccgcatcttgatggtagtggtcccccgagcccagctgttttctctttatctctttgtcttgtgtcttaatttattacaatctctcgtctccacacacggggagaacacctgctaataagcaccgtaggctggaccctacagaccatcctggctaacacggtgaaaccccgtatctactaaaaaaatacaaaaacaattagccaggcatggtggcacgcacctctagtcccagctactcaggaggctgaggcaggagaatcgcttgaacctgggaggcagaggttgtggtgagccaagatcgtgccatgcactccagcctgggtgacacagcaagactctgtctcaaaaaaaaaaaaagaaaaaaaaaaagtacattgtagctttttttttttttttttttttgagacagaatctcgctctgtnnnnnnnnnnnnnnnnnnnnccgagtagctgggactacaggcgcacgatcacacctggctaatttttatatttttagtagagactgggttttgccatgttggccaagccagtctcaaactcctgatctcaggtgatccacccacctcagcctcccaaagtgctgggattacaggcatgagccaccctacccaacccattgtagctttttaaaatcttagtaactatctggtttttggttttgtttttttttttttaagacagagtctcactctgtcaccaggttggagtgcagtggcatgatctcggctcactgcagcctctgcctcccgagttcaagtgattctcctgtctcagcctcccgagtagctgagactataggcgtgcaccaccacacccagctaatttttgtattttttagtagagacagtgtttcaccatgttggccagaatggtctcgatctcctgacctgatgacctgcccacctcggcctcccaaagtgctgggattacaagcgtgagccaccacacccggccagttagctatctttttaaggaatagcgtgggaggcaggtttaccctaagcagttcccagcttgatttttccctttggcttagtaatactggggtcccaagatttattttcctttcacaagaataatgcttgtccttttccttccatttttctgaatgttcttttcacttccttatgaatcccatggatgcctctcagctgacgacagcagcagcccttttgtttttagacctaattccttttccccaggaatgagtcacttctccagcaggtcagcttctccagttgcactctgtcttccttccacaggggctcttatgcagaagacggcatatgtgaacgctgtagctctccttgcagaacatgtgaaggaaacgccaccaactgccattcttgtgaaggaggccacgtcctgcaccacggagtgtgccaggaaaactgccccgagaggcacgtggctgtgaagggggtatgcaagcattgcccagagatgtgtcaggactgcatccatgagaaaacatgcaaaggtacctaggagcttcccacaggagagcaaggctctgctgagccaccagttgggggccgattatctgagggtggatggcaaagagctgtgggaaccagtctccctaccattcctgaaaggtatgtctctgtgcctgtcatcagagaaactgagggtgagatacacccttttcattatggatgctgcaagttaagacaagcaagagcccctttttgcatgatctcttacactcacccccatatgtacacacacagcagatgtgcaagtgctatcctaggtgctagaggtacagagaagaacccaatgttctcatcttttttttttccttgagatggagtttcactcttgttgcccaggctggagtgcaatggctcaatctcagctcactgcaacttctgccccccatgtttaagcgattctcctgcctcagcctccagagtagctgggattacaggcacgctccaccacgccgggctaattttaacatttttagtagagatgaggtttctccatgttggtcaggctggtctcaaactcctgacctcaggtgatccaccatcctcagcctcccaaagtgctgggattacaagcgtgaggcaccacgcccagctgttcccatcttttggaacacaaaatcttacagactgatagtaagccacaaaacacagaggtagctagaaaactgcagttgttaaaaaggataggaaagaaaagttcgggcaactatgactgagatgaccactctggctgtgaatgaattttgttgtttttttccctcaggaattatctcccccaaaaagctgttcaattttctctccagaataagacagactcatttaactggtgctgtcctatccaaagtattctcttggtgtgacctcaagtgtttcccaggattccccccaaagtaagaaaatgaacacaaaaaaaataaacccgcaatgtattcttcacactgatcaatcctgtattcattgttgtacctgatcaatgaatgaaaagttaactaatccaaccattcctaaactgctttctgtgttgaaaacagtgtgaggttctcaatataattttttaaatctgttaatgctcttcgggtttttcaaacaataccgccagcctctcagccatccctgtcttttgcagcattgcaaatttttgcactgcacctccaaagggcagaccatttcattgtgtaagtccagcaccatctaatacggtcaccatgtgtggcctccttgtcccaaggcagggcttgttagacatcaagtctatgccctggcagggtgggtaaagggcaagcatactctcaggtcaaatcaaccaaagtgctgagggaggagctagcctactgcagacaatgaattcctttctcctaccccccggggataacttgctgcttcctccttttcccagagtgcacgcctgagttcttcctgcacgatgatatgtgccaccagtcctgtccccgtggcttctatgcagactcgcgccactgtgtcccctgccataaagactgtctggagtgcagtggccccaaagccgacgactgcgagctctgtcttgagagttcctgggtcctctatgatggactgtgcttggaggagtgtccagcaggaacctattatgaaaaggagactaaggagtgcagaggtaaagacttctgggattcaaaataggctccggggtttgcatagttccagccccagccccagcgccagagctgtcatctcaatcttttttttgttgtgttttgtttttgttttgggacaaggtctccctctattgcccaggctcaagttcagtagcacgaacatggctcactgaagcctccgcctcctgggctcaagtgatcctcccacctcagcctccagagttgctgggaacatagagatgaggtctcagaatgttgcctaggctggtcttgaactcctggcttcaagcaatcctctgccttgggctcccaaagtgctgggattacaggtgtgagtcaccatgaccagtccatctcatcctttaccatctcactcaaggaggcatattttgaaccggttgtaaataatctttaaatgaatcgctcataagctttgtataggtaacttttattagtgacaaatcacgtggaccttcctcacaacagtggctatgaactgctggtcaaaagaagttatcatataaagatttacagcagagaggaggagccttcaaaagctacctgagacttttcttgataacacaagcaaattgtgacaccataagggactttcttggtgcctcttgtctcccttcttgggtgatttttttttttttttttttgagacagagtctcactctgttggctagagtgcggtggcacgatcttggcttactataacctctgcctcctgggttcaagcgatttgcctgcctcaggctcctgagtaactgggactacaggcgtgtgccaccacgcctggctaatttttctatttttagtagagagggggtttcaccatgttgaccaggctggtcttgaactcctgacctcaagtgatccacctgcctcgcccttccaaagtgctgggataataagcgtgagccatggcgctcggtccatattttgttattgttgttcttgagatggagtctcactctgttgcccaggttggagtgcagtggcatgatctcagctcatcgcagcctccacctcctgggttcaagtggttctcctgcctcagcctcctgagtagctgggattataggtggctgccaccacacctagctaatttttgcatttttagtagagacagggtttcaccatgttggccaggctggtcctgaatgcctgatctcaagtgatccgcccaccctggcctcccaaagtgctgggattacaggtgtgagccaccgcgcccagcctcccttcatggtttgctccctggaagctccccaccttcctcttcatatccttcaattcctgctccaaggtccccatttccactcccactcagtccctgcatgttcaagaaaggatctgctattatttatacctccttatgttttaactcggcatgaatcatttgcctcttattcattatcaaggaacagaaaaataaaataagttatgcactctagaattctctagcaagtgagagaaatgttgtggggcgggggcttttctagagcccaggattcactctgttgaggcagcctgaggtccttcacccccacatgtcgcccccaagcaaacacgacaagatagatgtccagaggcaattcccctaacaaccgcgagagcctgagagtgaccttccactgagaaaccctgggacacccacaccctaggacatactgaggggaaggtttttagtaggacacgaagatgtgtctcggtcctgaaggctttctgctccagccttgtgctgtggatatgtctttttgtgtgttttatataaagcactatttagtgttaatgtcctacctgcccatatgtgaaaaggcgtggatgtcaaggctgtgtccgcatgcagaagaggcgggtgttcgtgtgggaggcaggctgtggagctgggaatggcttctgggaggtgagagactcagcagcaggcctccagcgccatcttgcctctgcgagggcaggaactgaggttcaacttctggcctttctctggtgttgaataatgaaagtaatttaccatacagagagctttacaggtctcagagtatgttttcttaatttatctgatttaattatctccttgagaaaggcccctggttgcccattagaatcacctgggcagctcttaaaaccacagatgcctgcacccaacattctaattccttctcccaccaccagtaattctgatgcttagtgtgggttgagagccattgaggtaaatggcaattttctgcatttttctgagaaggaaacagatgctttgagaagttaagcacttgctcaatgtgaccccactagtgaggacagagttggaaactcacttgaggtgtctccctacaatgacattgcactttcttttttttgagacggagttttgctctcgttgctgccaggctggagtgcaatggcgcgatctggactcaccacaacctccgcctccctggttcaagagattctcctgcttcagcttcccgagtgactgggattacaggcatgtgccaccacacccagctaattttgtatttttagtagagacggagtttctccatattggtcagggtggtctcgaactcctgaccttaggtgatctgcccgtctctgcctcccaaagtgctgggattacaggcgtgagccaccatgcccggccgccattgcactttctaccagaccaaagggaggggaaggaatgtggtattggaagaaacagtgacaacctgactttccagagagataatacaaagaacctgatctgaaaattaagatttggggaagtgtagagaagcgtttagaatggagcaatctcagccggacacggtggctcacatctgtaatctcaacaacactttgggaggccaaggcaggaggatctcttgagtccaggaatttgagaccagcctgggcaacatagcaagaccctatttctaaaacaaaaataattatacaaaaattagccagatgtagtggtgtgtgcctgtagtcccagctactcaagaggctgagatggggggatcactttagcctgggaggtcaatgtttcagtgagccatgatcacaccactgcactctagcctgggtgacagagcaagaacctatagcaaaaaaaagaaaaaaaaaatctgtaagcaggatcttctctaagaaacacaaggactttggatccattccaatcacccagattatcctgtaatagatagtacagacacctctaaaagtcccatacctttcctgaagcactggagcagaagcagcaaggcagttgctaaggtcctgggctcaactcctgatactaattagcgtaagtgacttagcatctccagcctcaatttcctgatttagataaaatgagaggataatataaacaataataataccatgcatgtatccacccagggaatgcttacaggggggcctgctatgtgccgtgtgctctttcaggtctggggaacagcagggagtgagacagagtccctgccctcatggagctcacattctgttagggaagacaggtactaacgaccataagccaagagcaaaaataaggcagaggggcaggacagggagataggcaggatggagataaaacttgagagatgtcttagatttcattgagaaaggcaggaagcaaaccatgcatgcctctgggagaagagaattgcaggcagacagaatggcaactactaaatcccagagatggtcggcctggtgcagtggctcatgcctgtaatcccagccctttgggaggccaaggcaggaaaatcacttgaggccaggagttcaagaccagcctgggcagcaaagtgaaggcccatctctattttttttttttttttttttcctgagacagggtctcactctgtcacccaggctggagtgcagtggtgcaatcacagctcactgcagccttgacctcctgggctcaggagatccttccaccttagcctcctgagtagctgggactacaggcacccgccaccatgcccagctaatttttgtgttttttctagagacagtgtcttgccatgttgctcaggctggtctcgaactcctgggctcaagcaatccatccaccttggcctcccaaagtgctaggattacaggcgtaagccactgcacccagcccccgtctctagttaaatacagaaaaagaaaacctagaggtggaagataattgttattttctttttttaacaaatacttatcgattcctattacatgccaggccctctcataggcactatgtattcaaaaataaatgcaaaagggacctttatttgtcaacagacaattaaatacattccaacaattgctgtattcgtgataagctcaaggtactccggaggtgagtggaggaccataacagtaggtgttgtgacggtggaaaattcgatgccattacagaatggcttgttattattttgttgcagtttgggtaattatagtgagccttactaatatttctgagatggctattgcaggaaagccctctctggatacaacagagaaaataaaataataattttctctcattttgcaaaagaatggtccaccccagagctcaagggctgtactcaactcatggccccacaccattggcccagagctctggaaatctccggaagaaatgtgaaaggaatgtgaagaccctttcccaggggaagccattcccacgagggccaccctggctctcgctcactctgtctgctgcccctccacgcccacagattgccacaagtcctgcttgacctgctcatcatctgggacctgcaccacctgtcagaaaggcctgatcatgaaccctcgtgggagctgcatggccaacgagaagtgctcaccctccgagtactgggatgaggatgctcccgggtgcaagccctgccatgttaagtgcttccactgcatggggccggcggaggaccagtgtcaaacatgccccatgaacagccttcttctcagtgagttacttctccgaggacagctttgtgtttccatctctctgggaaactgccttgcacactgccttgtccagtagatactggcttctttctttttgattttttgctttgtgtttgggaaatgttcaaacctgcagaaaagatgcaagagtaagaactgtacaaagaacagcgcacggatgtgcttcatccagttcgcaaattgctcatcttctacaccatttgctttatcatttgttcgtgggctctctccccccttctcactcattctctctctctctatcgctctcttcctctcactctctcaatgtatacatgtacatcattcccaatacatatttttcgaagccatttgaaggcatacatcatggcccctttcccataaatattttagtgcctatttcctcagattagtgatattttcttacataaccgcaggatagttatcaactctaataaattgtacattcatacaatactttaatatactatccatattacaattttctcagtgcccctttaggattcaggctagagtcagttgtttcatttagcttccatgtcccttttttgtttgtttgtttgttgggaaggagtctcactcagttgctcagagtggagtgcagtggtatgatctcggctcactgcaacctctgactcctgggttcaagcaattgtcatgcctcagtcttctgagtagctgggattacaggtgggcaccatcgctcccggctaatttttttttttttttgtatttttggtagagacggggtttcaccatgttggccaggctggtcttgaactcctggcctcaagcagtctgccctcctcagcctcccaaagtgctgggattacaggtgtgagccactgcgcccggccacttttttgtttgtttgttttttgttttaagagacaagttggccaggcgcagtacccaggctgttggagtgcagtggcacgatcatggttcactgcagccttgaactcctgggctcaagagatcctcctgcctcagcctcccaagtagatgggatgggattacaggcatgaaccaccatgcctggcccttccatgtcatgtccagccatttttttttctttttagagacaagggtctcactgtgttccccaggctggtcttgaattcctgggctctagctattctcctgcctcagtctcccaaagtgctgggattacaggcatgaaccactatgccaggcccttccatgtccctttagcctcctttaatatgaaatgtttccacacactttctttttctttcacaatatcaatgctttagaaaaatacagtcttggctgggcacggtggctcacacctgtaatcccagcactttgggaggctgaggtgggcagatcatgaggtcaggagttcaagaccagcctgaccaacatgatgaaatcccatctctactaaaaatacaaaaattagccaggtgtggtggtgggcacctgtagtcccagctactcgggaggctgaggcaggggaatcgcttgaacccgggagacagaggttgcagtgatccaagatcgcaccactacactccagcctaggcaacagagcaagactctatctcagaaaaaaaagaaaagaaaggaaaaatacagtcttcatttttcctttcgggtgactgtgaagttgcccgtgatcagttgcagagtgtgcatgcttggccagcatacttcagaagtgatgttgtatcctccgagagtcacacctggaggaacgtgatctccacatgcctttcctcggtgatattaatgttgatcacctggccaagatgttcagtttccctactgcataattactatttattcccttgtaactaataagtagcctgtggggttacactttaagaacatgtagatattcagctcctcatcaaaatttcccctccatttagcatggttgattaagaaatccctcttgagcaaaaagtggcacaggtcaaggttggccacggtcccacagatcagagttgaaggttattgctaatatgaaacaatgtcctcaggttcccagggatactgtgactaggcttaaaacaagcatgggagaaagaaaatgaaacaaaacttaactaaaaaagaagtcataggagacagaagagagagatgaatatggtgaagaccaggaagtatgagcacttttctcccccaccaggagagtagacctgagaagcgtgaaactccaaatagacatgtgtggtaggctgggcgcagtggctcatgcctgtaatcccagcactttgggaggtcgaggcaggaggattgcttgagcccaggagttcaaggccagtctaggcaacatagtgagacttcatctctacaaaaaatggaaaaaaattaaaattttaaatttaaaaattttaaacattaaaaaaaaatgttttaaagacatgcatggcaagcttttcctcttcatattgagcgaggacaccatccccctgctaagacacagggagacctattctcaataccattcctgatcacttcacaatagaaaacactcaaagagaccagtcttctctatccatctaccttagctcctggtccacaaatctctgtgactctccttcccagcagttgctgcttcataaaagcattccctccagccacgtctcccaggtaatcccaccccgtcggaccttcttttctacttacgtccaatctagagtgccaccagtaatcatctcagatgccttcatatagagaagacagcttgcctccacaaagtggtcttcccctcatccgaggctgcagattagactagaattgaggcttcagtgctggtataggacacagagctgtagtccccctgggaaatgggtgcagatttgctcagcctggtatcctcacattctctctaccctgtcccacaccaccacaccaccagggtcaggctatttataaattagatactttttttggacatcgtggtagactgaataatggcccccctgaagatgacacatcctgatccccagatcctgtaaatgtattactctacttggtaaaggactttggggcagtgatttagttgaggatctcggcatagagagattatcctgcattatccacgtagacccaatgccatcacaagggtctgataagagagatgccgggggtgggccaggcatggtggctcacgcctgtaatcccagcactttgggaggccgaggtgggcggatcacaaggtcaggagatcgagaccatcctggctaaaacggtgaaaccccgtctctactaaaaatacaaaaaattagctgggtgtggtggcaggtgcctgtagtcccagctactcgggaggcttaggcaggagaatggtgtgaacccggaaggtggagcttgcagtgagccaagattgtgccactgcactccagcctgggcgacagagtgagactccatctcaaaaaaaaaaaaaaagagagatgccaggagatcagagtcagtaatagaaggtgatgtgatcagaagcagagggacagagagaagctactgcactgctgcctttgaagacagaggaaggggccatgagccaaggcatgcaggtggactctagcaagtggaaaaggaaaggaaacagattccctcctagagcctctaaaaggaacagagccctgtggatctattttggacttctgacctccagaacagtaagataataaattgttgtttcaaggccccaagttggggatacttcataggaacagcaataagagactaatacggcggtgtttttccttcaggaagctggggcttccccctagttaaccagatacatgagctggacaatgagccattgccaacatccacaggcgccggactgtagtttctgttctacccaccacagctaatccactgagaaatttgggtgggacacagatgagatttggatctctgatgagatgagatgggatcactgatgagatttgggtgggacacagagccaaaccatatcactgacttctgttttccttgtattcctcatggccttagggcaattctgtttcttggacactaatcttatttcccaaacatatccatcagctcacaggatcatcccattcctcctgcagccctctcctccctcccgccatggtacacaagagggaaaatacaggggagacatgtgtcatgctcgatgtccaaatagacattttttctcccatgacagacacaacctgtgtgaaggactgcccagagggctattatgccgatgaggacagcaaccggtgtgcccactgccacagctcttgcaggacatgtgaagggagacacagcaggcagtgccactcctgccgaccgggctggttccagctaggaaaagagtgcctgctccagtgcagggaagggtaagtgctcaatacattttcccccatgtaatttcacagccacagcagatatcaacccattttacaaatgaggaaactaagattcagaacacttataaaaccaggttgaagtctcagtgctagtaaggagcaaagatgaaccaattcacagtaacagaagagaaacaggagaggcagagtgaccgagtgagttaacacaaagggtcagattgtcaagccggactcacctgagcaattgatcttcctcaacgacagtccttactgaaaattcaaagcatattggcagctgggcactgtggctcatgcctgtaatcccaactacgtgggaggttgaggctggaggatcacttaaggcaggagtttgaaccagtatgggcaacatcttgagaccccatctgtaaaatattaaaataagattagctgggcatggtgccatcaggctatagtcccagcttctatagaagctgaggcaggggatgatcacttgaacccaggagttggaggctgcagtaagctatgattgcaccactgcactccagcctcagtgacagagcaagaccttgtttctaaaaattaaaacaatttggcaaagggtctcagcaatcacaaggcagaagcaaagcatcctttcctcagagaagcccaagatcattaatggaggttctttttcttcaccttcaggacttgttctgattcagatttaaaattcagggtctcacattctcccaacctgcttatgtgaggagagcagtgagtgtggaacattgatttacaaaggaaatagttccattaacatctccatttattccccattaattccccaacctgtcatgtcacctataaatccacaaattacaggttttgttatcataaacaacgtagacacacgcacttgatgtatccttctaaaagcatttcatggataaggactctattatttttctgctaggaagaactgttagtgttatcagaaggtctgattgccagcatatcctttttctcccccaggcattcccagtaaagagtaaaagattgatgataggcctgttgctgactctttctacccaatcaataacctagagcactgggagtttccagacccaaatcaagggctgtaaccttagaccttcctcaaatgctttcacccaaattgacacatctcttcggtcctatagcagttactgcttgtttcattcattttagtgctatatgctgccttgcattttgatttatctcattcattcacttatttatttaacacatttcatgatgagtactttgtatgtataaataagatgagtaaaagaaagactgactgtgtttgttttcacgcggctgataaagacatacccaaagactgggcaatttacaaactaaagaggtttaattcgacttacagttccatgtggatggggaggcctcacaatcatggcagaaggcaagtaggagcaagtcacatcttatgtggatagcggcaggcaaagagagagaatgagagccaggcgaaacgggtttctccttatcaaaccgtcagatctcgtaagacttattcacaacagcaagaacagcatgggggaaaccgcccctacaatccaaccatctcccacagggtccctcccacagcacatgggaattatgggagtacaattcaagatgagatttgggtgagacacagaaccaaaccatatcactgactttaagagtttattcttatttttatatgcctcttcccaagaaaattataaactcatggaagaaaaacacctcttacgtcttacatttgcttctacaacactcagcacagagccacacattggcagctcttgaaaaacaccagccaggctgggcagggtggctcacgcctataatcccagcactttgggaggccgaggtgggtgggaggtgaggttaggagtttgagaccagcctggccaacagggtgaaaccccatctctactaaaaatacaaaaactagccaggcatggtggcacgtgcctgtcatcccagctacttgggaggctgagggaggagaattgcttgaacccaggaggccaaggttgcagtgagccaagatcacaccactgcactccaacctggagcaagattctgtctcagaaaagaagaaaaacaccagtcatatagatcaaggaagaaagagccctgccagacaagaacagagatggatggccaggtgtggtggctcatgcctgtaattccagcactttcaaaggctgaggcgggcagatcacttgaggccaggagttcacgaccagccttgccaacatggtgagaccctgtctctattaacaatacaaaaattagcagggtgtgcaggcaggcacctgtgatcccagctactggggaatctgtggcatgagaattgcttgaaccttggaggtgaaggtttcagtgagccaagatcgcaccactgcactccagcctgggcaacagaacaagaccctgtcttaaaaacaaacaaacaaacaaacaaaaacaggaatgaagctacctggtttagcccttctgcatcaccctagtaagtgtctgaaaagatctggatcccatcttcctcaaatcaagtcagtaaacactctcaaacacaaaaagggtgcttgatcatcctgtgatctaagtagaatgcagaccatggaattaagaagacaattgttccacagcatgtaaagttccccagggctggtggggggaggcacaggttgccatagatctctttaataaagaagaaatggaatattcatgaggtataagagaactcttcctttagtaaaatcagtgttccacatgcttggcataacccttgtatgttaaatctctggcttggaaaagtaggcatacacttctctgcaccctatcccaacccacgtaattattttggtgtttaactcagagaagtttctttaaagcctaggttactgcttgtgcttatgctcttcaaggctgggaggctcaaaagatgagtcctcaaagcaagcagtggtgttgtactcttttaatctgttccaataaactcttcattgtctcttttagcattactccttgataattttaaaaacctacttagaattgataagctttctttcccacagttcctactgatgcttttcatctttataacaatctataataaaaacagtaggtaaaaaaacttttgtatgctgcttaagagttacaaagtatttccactcacaatatatctttacattatgatttgattctacaacaatctcatgacgttactgttagtctctccattttacagatgaagaaactgaggatcagaggggttaagtgacttgcccaaagtcacagagctactaatacatggcagagccaggattaaaaattctatcttctgactctaatcctgtgtattccctctgctctgtgtagatttcacttttccctgatggtttcttttcttgagtcttatgtgggctttgtcaaccattcagctcatcatcgccttgtctcttagatacctcagtcttacagattgacacatagtagtcattgttcttcacataactgcaaaaagtgaaggaagtctcaagttaccacaagctgggccactgaggttcaagtgtgctcactcagatcagtgacaggtggctaaacagaccaagcctcaacataacctaggcatggtgtgagttttcagcaagttcatggagctgaattagtctacaaaaaaaagcctattgggacctgtagtgttgcaccagagaaaacaaagatgaacctttaggtttctaggataggtttagtggtgctgatgtctagaaatacagagatgaatcagatgacctttagaagttcatccttagcaagaattttgttaccctcttttatcttgcttgcaaacctttgtttaccttcaattaatgcactattttgttgtagcgtttaacagttaagctcaaatcatattgtctcatttcactaactgactttaagcaagttgtctaaattctctaagcttcaatgtttgcttctgtaaaataaggataataatacctaaatcataagatttgctatgaggataaatcataaaatttataattatcactaatatacattaattatttataatgtgcccatcatggtccccacccctttctcagtaattacatgtttaattgtaggtactaacattagtcccatcttatagatgagaaacctgaggcacagagatgttgagtgactggcccaaggtcatacagcttgtaagtggtatgactgggatttaaaactgtagtcttgttccagagggcaagtgctaactaccacactctagtgtctcatttgtaggttcaataaggtgaaataatgtttatgaagtccctggaatactatcaggcatattagtagaaacttaatgaatagtggttatagttatcatatttaacttccaaaaatcttttcaaacaaggttatatctattatgtaaatgtcgatatcacacttgtcacctcctatttcaaaatttcttctttaattggcaaattagaagaataattcagaggtacatttatttattttatgttatcttttattgtattttatttatgacagtctcactctgtcacccaggctagagtgcagtggtgtgctctcagctcactctcctgggttcaaacaattctcatgcctcagccacccaagtagctgggactgcacaccacatctggctacttttgtttgtttgtttgtttgtatttttagtagagatgaggtttcaccatgttgattgaccaggctggtcttgaactcctggcttcaagtcatcctctcatcttggcctcccaaagtgctgggattacaggtgtaagccactgtacctggccagatggatctctttttttgagacggagtctcacattatcgcctaggatggagtgcagtggcatgatctcggctcactgcaacctccaccacccaggttcaaacgattctcctgcatcagcctcccaagtagctgggattacaggcacatgctaccatgtctggctaatttttgtatttttagtagagacagggtttcaccatgttggccaggctggtctcaaacttctgacctcaagtgatccacccatgtcggcctcccaaagtgctataattacaggtgtgagccactgcacccagcctggatggatcttttaaatgtatctctgaatggccaggccaacatagtgagacacccatctctattttaaaaaaaaaaaaaagatccttccattctctgatcccagccattaatcacaacttaaagcatgaacttggagagacacatggtagaaaaaggcaatggtagctagcaacgatggaggtgctactaggtgttataagcactaggtcttttcatatgtgttagttacccagtttaattttcacaaatagtaggggagggattggcccaatttacaggtaagaacactgggaatcattggattcattagtgttattagcaatgaatctaatgagtaaggtaaagaggctaaagtcactcagcttgtaaatgaaacctgaccaccatgtttttccactgcatccaatttaggagcaaagcttactattccatcttttcttctcctttggtttcagatattacgcagacaactccactggccggtgtgagaggtgcaacaggagctgcaaggggtgccagggcccacggcccacagactgcctgtcttgcgatagatttttctttctgctccgctccaaaggagagtgtcatcgctcctgcccagaccattactatgtagagcaaagcacacagacctgtgagagatgccatccgacttgtgatcaatgcaaaggtgagagtctacctgtcattttgcatgagtgcgtagaaaaatgaaaaggttttcttccttatttgcccctttctctcttctcaccacctgggaggttcctcttgcttccctacctcgtgtgtgatcctctccagcatcagcgccctctgttcgctcttaacttccacatcttccctctaacctgggctgctcctgcccatcccccatccttcaaggcccagagacaggcatcatctccttgaggaagtattgttcgttcactcatcattttcctactctacctgatgagtctgtctgggggaatttgtttattttcattactcccactattccctgagacttctgcctcaaactctcccaagctccatgcctcttttacagaaatctagttgtctgtcccagagatccttaaggctcaccatctaccaaggagtccaggctgatactttgaagttctccttgactcttctccttcccctgttgcctgcccaacccacccacctccaacaaagctaaacttcaagatctgttggtactctttcccaaatagttatctaatgagatctttttcattctcactaccctcatcttccattctcagtatctagtatcacaccttttgaagcagccagcaggtcaccccaactctcaatcttgcccccacaccaggtcatctggtatactaatgccagagtgattgccttaaaattcaaatttctcatttttctctacatcttgccataaatatatgagcaccatgaatgcttctcaatatttaagaatgaaatacttctatattttaattgttaaaactttctagaaaaatattattagctggtaggatacatacctgttcttttcaaaattatcttggctatttttagttcttttatataaatatgtaaccagtcaggtttaattttttaaaaatctttcatttttaaaaagtatttggatattgagtagcattgcattgaatttattttggagaaaaccccatctttatgatcctgagttatcatatttatgaatatgatataatggtatatctctccattctatgcatttacttactacacttcaataaacttttaataagtgtttttgtttgttttgagatggagtctcactctgtcgcccaggctggagtgcagtggcgcgatcttggctcactgcaacctccgcctcccaggatcaagcgattctcctgcctcagcctcctaagtagctgggattacagacgtgcaccaccacgcctggctaatttttgtatttttagtagaggcagggtttcaccatattgatcaggctggtctcgaactcctgacctcatgatccgcccgcctcaacctcccaaagtgctgggattacatgtgtgagccaccgcacccggccaataaatgtttttatatttaaaaggctattaagattttcccagcagtccccttaacttatgtcttaaggacttgtcttccatgtattctagaagctagaactacccagaaccactcagcagccaccaaatatgccatgttctttcattcctctattgactcaatgctctagggaactctcaacttaaagattcagcttgagtatcatctcatctcctccatgaagcttttgttagtcctcccaggagtattcttcctccttaattctgtaatacactgctttatcatggaaattttacactacattttaattaaacaagtccatccctcctactaattgtgagcccctcaagcaaaggcaaggattatactacattcattgtgtatcccttgtttctactctggagtgtaaaacataagttttcattcagtgtttgttcactgaatgaatgactgtataggtaacaaattcctaatgtctttttgcaaattaaaaaatgttcagctataagatcttcaaatagccaggcgcggtggctcacacctgtaatcccagcactttgggaggctgaggtgggcggatcacctgaggtcaggagttcgagaccagcctgaccaacatggtgaaaccccatctctactaaaatactaaaattagccaggcgtagtggcgggtgcctgtaatctcaactacttgggaggttgaggtgggagaatcgcttgaaacctggaggcagaggttgcagtgagccgagattgcgccattgcactccagcctggcaacagaacgagactgtcaaaaaaaaaaaaaaaaaaaaacttcaaatattgtttctccactctcccctccaatctcgttttatggaatttctattaaatgcaatttagagtttattgatctttcctttgtatcctacctactcttttatattttgcctctttgactctatgtgagttatactaggttaattcttcagcactccatttcattccctgacttgttttagactgtgttcagtctaaaatccaacccatctattttttttgttttcaatttaagtgactatatttttacttttgagagttctaattggccaggtgcagtggctaatacctgtaatcccaccactatggaaggctgaggtgggaggatcactagagcccaggagttcgagaccagcctgggcaacttggcgaaatcctgtttctacagaaaaaaaaaaaaaaatacaaaaattagtcaggagtggtggcacacaacagtaatcccagctactcaggaggctgaggtgggaagatcacttgggcaagggatgtcaagacagcagtgagccatgattgcgccactgcactccagcctaggtgacagagtgagaccatgcctcaaaaacaaaaaaaaaagatttcaaattgtttcttcttctcatccatttttattttagatctttctgtttgtgtcttataatttaacatatttatggatactatgtcttcatttatttatgagcatcttaaacataccaattttaaatactttgtcaaatgtttctatgaaatcagtattatctgatttaaattcatgttctaattattgatcatgtttgtcatcctttttttaaactttattttataattaatagagacgatgtctcgccatgttgcccaggctgatcttgaactcctgggctcaagcaatcctcccatcttggccacccaaagtgctggggttacaggcgtgagccactgcactggcctgtcatctttcttagcattcattttatctatatactttggaatgctggtcttaagctcactgtaaatgaaatattttggttttggttctttactccctctctctcttatctttacttctcacagtctagaaatttttccattaactctttccctgtcttcaacctgaaactcagtccagaacaagatgttccagtattcctggaagtgatattgatgacagcatagatcccatcagcaattcaatcagcagcttaggagagatcttgtcaggaggtgatgtctatgaaggcagagtcccaacatgactcctgatttaagcgctaagcctggattttggctctggtcttatgtaaaacacttttagttcctattttggtagaaaaggtgagctcacagtcaccattgcctacttctagtcctggagcagagaaggtggatggcttgaacctgactaccattttgcatttatatttcctttatgttccaaagagatttcattttctttgtaaggccatctatctttattttgttttcctctctttatatttattctataatttcattatgtttaaagtaaatgggatgtcagaacctgagcttataaaatatttttttaatgcatatgtgtcactaatggataatcagattcttagaagaggattgtaccctaaattattgcccagcctcactctactaatccaaatgcctggtgggatggcaggagggatacttaagacttgtggatgaaataagcaaaggccaacctgttagagcctgcctctaatcctctttttttttccccttccaaaatgattcatcttgaggcaatatgttgatgatatagaaacaccaagaattagggaaaacaagatgagaaatcaggtattcccccacactgggagaagaccatcagcacgtttgctgtctagctactgagctgaaattcctgaaaagtatcttgatgacattatattttaaaataacttcttcccaagtacatgtgaatatagccatctccaagtttaaggtggcttccaatattacctatgccttggtgtctccaaatctgcttcttttcccaaatggttttcctgagctccggttccatacatccagttgctgactgagtatctctgattggatgctcaacagacacctccaactcctcaccccactcccaaactacttgttctgtgctccctatctggataaatggccccaccattcacccagttgcctgagacagtaacctggccattaccctctgctcctccccctctctcaatccccacattcaatttgttcccaaatcctgccaaacctaccccttaaatatctcctaattccatctcccctctcttggtattctagtgtcactgtcttagttcagactcatcattcattgtctgaattgtttaccaattatttatttaattggtcttcctacctttagcattagtcaccctgtaataaaccagtcttccatatgctcttagactgatctctttatacaacaaatataatgatacatctccacttaaaaaacaactctctactgaccttaggatagaattttttttttttttttgagacagagcctcgctgtgtcacctaggctggcatgcggtggcatgatcttggctcactacaacctctgcttcctgggttcaaatgattatcctgaaccagcctcccaagtaactgggattacaggcacacaccaccgcacctgggtaatgtgtgtgtgtgtgtgtgtgtgtgtgtgtgtgtgtgtgtgtgtattttgagtagagatggggtttcaccatgttggccaggctgatcttgaactcctgacctcaagtgatctgcctgcctcagcctcccaaagtgctgggattacaggtgtgagccaccaggcctggccaggatagaattttaatttagtatgtttgcgtatgaggcccttcagcatagagctcttctcatattcagcctcatctcttaccatctcttctcccatcctctaatcagggcataattagtaactataaacctgaaccaacctcacccactttccctctctctggaatagtttctccagcctgctttgcatggctacctctttctgatccattagagtcatcacttcctccagaaaacctccccagacccttcattctatgttcccttagtactctgtgtcttcattcatccatttacttaaggcacaatgttctacaactgtgaacaagacagccaaggtccccgcagaccaggctagtttaatttgtgtaattgtacttagtggtgtagcagcactgtccagtagaaataaaatgtgattgaaaatttttagtagtcatgtttaaaaaaaaaaagtataattaattttaatcatacacttcatttatccaaaatattatcatttgaacatgtaatctacataaaattactgagatgttttacatgtgttgtactgtctttgaaagtccaatgtttattttacatgtacagcacaactcaagttgcactagccatatttcaactgctcagtggctacctgtggctagtggctgctgtattggacaccacagtaataacctagagcaatggtttcaaatgatattttagcagtggccaccttcctcagataaaatctgaggctgaatcctattaggtaaaccaatccaggcagagctgctcaggtgggagcagaggagccaccccagaaccccatctgatgcctctccatgctcccctcaccacctttcccaggaagcccctaaagcaactccataaaaactctaccatatcatggttcccagtctgtgcccattcacaattgactccagcacatgaaagaattagccttccaaacaaactgcattaactactcattaatctgttatcactttttcattccagagacatatatggttaccacttaaaacttctaactggaattagataacagatgagaaaatacactgaattgggggtgggatgggagtggtggaaagctgatattatcattggccatatggtggtaaatattggctttctatttggttttttgaaaagttgaacttacctctgttaccatcattactggatgtgtgggacctttattccaactagggttgtctgataaaatactgtatttgatttgcgaaatctgacaaccctaattccagcccactagtgttgtgcagtgggcggcgcagtgcagtgggggcacttgggtcctaattaacattagacaatcatcattaggtaagctaatgtctcttaccgtcaaccaatcaaaacaggacaacaccagcctttgaagatgattgcggggattagataaatgattcgtgatattgtaagcacagtttgaaaaacaacaaatttttttcaacttttattttagaattgggggtatatgtgcaggtttgttacaaaggtatagtgcatgatgctgaagtttggagtataaataactgtcacccaagtagtgagagtagtacccaataagtagtttttcaacccttgccccactccttctctccctgctcttgtatttcccagtgtctattgttcccttattttattttattattttattttattttattttattttattttactttattttatttttgcaacagagtcttactctgtcgcccaggctaaagttctgtcacccaggctaaagtgcagtgatgcaatcttggctcaccgcagtttccgcctgccgggttcaagggatattcatgcctcagcctctcaagtaactgaaactagaggtgcatgctaccacccctggcttattttcgtattctttgtttgtttgtttatttgttttttgagacggagtctcactctgtcgcccaggctggagtgcagtggcgcaatcttggtttacggcaagctctgcctcccgggttcacgctattctcctgactcagcctcctgagtagctgggactacaggcgcctgctgccacgacctgctaattttttttaaatatttttagtagagacggggtttcaccatgttagacaggatggtctcgatctcctgacctcgtgatacacccgcctcagcctcccaaagtgctgggattacagacgtgagccaccgcgcctggcctgtttgtttgttttttgagacagagtctcgctttgttgcccaggcttgagtgcagtggtgtgatctcggctcactgcaacctctgcctcctgggttcaagcaattctcctgtctcagcctcccgagtagctgggactacaggcgtgtgccaccacgcctggctaatttttgtatttttagtagagacacggtttcaccatgttggccaggctggtctcaaattcctggtctcaaatgatcagtgcacgttggcctcccaaagtgctgggattacaggcgtggaccaccacgcctggccaaagtcttacatttaaatctttaatccatcttgagttatcacctatatggtgacaggtagggatccagttttattcttctgcatatagctgtccagctatcccagcaccatttattgaccagagattatttttcccatcgtttatttttgccaactttgtcaaaaatcagatggttgtaggtgtgtggcattatttctgggttctctattcttttccattggtctatgtgtctgtctttgtaccagtaccatgctattttggttactgtggccttatagtatagaaatactatgaatgtctttagttgggtttgagatttcctgggtgaattaaggatgatgattttgggcattccgagtctcaaaagttcatccacatagtatccttgagattgtattcaagggatgactaggagttagtgggtaaatcctgaagctgtcctgagtgtttgtgcttcttcctcctgtatttgacatcaacccgtgaacttgcccagttgaagttttctgtctttggtgctcattttttctgctatcattatttttttaattttaattttttatttaatgttattttttcatataattctttgcagtgagcagtcctttctttactatggcacatatgtcccttgctggttaggaaaatgttgtgctatcatctggttttgcaacatacagatacaaaatctggagacaggtttttctcacgggatataaactaggtagaaaaaaagatgaattccttcctttttaagtcattagctctcatagtaagaaatgaggaggcatgaaagaatcagaaaaaatttagcaacctacataagaaattaccagctaaattatatttcgttcactttggactgcccaataattttaggatgttaaaaaagaaaaatatgtaaaagcatggaaggaggggtggagcaggaaaacatagcatactcaggcttaatatgtacctttctctgtaactgacacctccataattagctcattccttgccttcacacacctaactttttacttatcctctgcataaaattttattttttctatttttttttttcatttttgttttttgattttgtgttattgtttcttctcctcataaaatggtttggaatcaaaacccaggctgagtaaccaaagcctcttaactctcccaagctgcatctttctgtgtagactgaggcccatgaagagaccccagaagttgctctgcatttgttgaattcatcccatggggttcagtctgaaggagagcagatggtgaactgctctgagttttaaagaaatgacaaaatgcctatcttttaggtcccagagctcctgcagaaccttagaagcaatgatagatgtagggtgttaaactttaaaataatagaaagccttctggaaatcaacaaactgccttttgctaaagattctgggtaccctaagtgtgcaagttttgcaattaattggtgtaggagatgtaaatgaaggctgatttgtcacccaaagctgacatacagtgcccttgggtattgcctgggatctgggcctcagacaatttattgttggtcttctagaaaatgtaaccaaacttggccaggtgcagtggctcacgactgtaatcccagcactttgggaggccaaggtgggcagataacctgaggtcaggagatcaagaccagcctggccaacatggtgaaaccccatctctactaacaagagtaaaactccgtctccaaaaataaaaagaaaaaaaaaaacaaaagaaagaaaatgtaaccaaccttatggtaggaattttgtgacctaacctagttatggactgttccccctcttttagtgttttctactcttaatttattttattgtaaattgacaaattataattatatatatttatagggtacaaagggatgtcatgatatatgtatacaatgtggaataattaaatcaagctaattaacatgtccatcaggccaggcacagtggctcacacctgtaatcccagcactttgggaggccaaggtgggcagatcacttgaggtcaggaatttgagaccagcctaggcaacataatgagacctcatctctacaaaaaaataaacaaaatttggtcgggtgcagtggctcatgcctgtaatcccagcactttgggaggctaagacaggtggatcacttgaggttaggtgttcaagaccagcctagccaacatggtgaaacctcatgtctattgaaaatacaaaaaaattaggcaagtgtggtggtgcacacctgtagtcccagctactcaggaggctgaggtaggagaattgcttgaacctgggaggcgaagtttgcagtgagctgagattgcgccactgcactccagcctgggtgacaaagcaagactctgtctaaaaacaaaactaaagaatatatattagttgggtatggggtgtgtgcctgtaatcccagctactcaggaggctaaggtaggaggatcacctgagcccaggaggtcgaggctgcagtgagccataattacaccaagccatgattgcaccgttgcaatatagcctgggcaacagagcaagattccacctcaaaaaaaaaagaaatccatcacttcaaatacttaatcctttttgtggtaagaacatctgaaatttactctcttaccaattttgaaagtacaatacattattgttaattatagtcaccatgagatataatagatctcaaaaacatgttcttcctgtctaactagaactttataccctttgaccagcatctccccagtcccctcagccccccagcccccagcctctggtaaccaccattctactctttacttctatgagttcaattgttttagattccacattaaagtgagaacatgtatctacccttaatttctcttcatttaaaaaaaactctcttgtatgttaaaaattgaagtaagacatctaagctgtattttagaaaaatgtagaatgggctgggtgtggtggctcacgcctgtaatcccagcactttgggaggctgaggtgggaggatcaccaggtgatgagatcgagaccatcctggctaacacagtgaaaccccgtctctactaaaaacataaaaaaaaaattagctgggcgtggtggcgggctcctgtagtcccagctactcaggaggctaaggcaggagaatggcgtcaacccaggaggcggagtttgcagtgagccgagatcgcgccattgcactccagcctgggcgacagagccagactctgtctcaaaaaaaaaaaaaaaaaaagaaaaaagaaaaagaaaaatgtagaatgggaaaaaggaagaatggaaataggagaagattgattcttccatcagagaccacaataacgttccagaacatgtgggaaattctgtatgaagctagagctaagataaaaataaagtggttttgaatttatatcactacaggcagcttccaacctaagaagcagttcagtactaaaggtgtttattctctaagctgttgtttgaaactcagaatttatttttccacagaaacattataagtgattgagctcacagttcagccatgaaacgtcaatttaactatgtgaatgtaaatgacagatccatcgttctatttcaagttcaaaaaccaccctttacaggattgttctgatgggaagacctataccaagttccaacttacaataccaggcacattctatgtccattaatcttatgctcccatttaaaaattatcagcaaaaatgtccaggacttcctaacagaatgagatagatttaggtctcctgtccccaaactttccagaagttattccttgatacctgcatagaataaatgtttggatcagtcctttttggggtgtctgaattaggagataagagtactgtctccacaggaaacaggctgcagattcagacttcttctatttggtggctcatgtgctaaggcagatatgtggtggaaagagcacctcagcaaggtgcaattgaccttgcatgcctctataatcccagctacttggaggctgagacaagaggatcccttgagtccaggaatttgagatcagcctggacaacatagcaagaccccatctgaaaaaaaaaaaaagaaagaaagacagatcaacggattatgagtcaacaaacttgaatttgaatcttgaccatcactatgtaaccctggataggtgacattacatgtctgggccttagttttcatttatcaatatttttaaaatgagaaataaataagatgtcaaatttctgagaagagaacttacagctttcaagagaatttcaaagaaatgtatcaccatcatcaccaccccaaaattaagaaccaccaaacaaaatgatctgctgagtccttttagccctagcattttaagtgccaagtttagtgccgtttctcagttagaaactgtctattcatgatttatgcactgagtattgcagtcctccaaacacttggtaacatcctccacactagttaaacaataagcagaatagcgaataaaggttttataaactttctacatgatttctcattctctgaaaatctttcctcttgctgtaataaaagatctgtcatccccaaatcctcaattttcagactgagagtctacatagattgaactaattgtataatttctactttgtgtgggagacttttttctttttcgtatcctcaatcaattcacccttctgcttcaatttacttgacatattccttgttcctaagtgttccggaacaaagacagaagttgaaatctaaggtcaatctcataacttagaatgttttctctttcaggaaaaggagcgttgaattgtttatcctgtgtgtggagttaccacctcatgggagggatctgcacctcggactgtcttgtgggggaatacagagtgggagaggtatggagggctgggggtcctgggccttctgctctttctagagggaaacatgagcttacttcctgcatgtcattctgggcaatcaaaatgtcccaaaattctcatactatagaaatagtgtatgtttagtattttaaaaccttctaccattgcatcatggaataatggtgctacccacctgtagccttagctttactcaaaaggaactgagaagatctaagataatggggaagttaagtcgtgagggcctcggaatgaattctacatttgttattcatcaccatagaagtttcagtcaacataagaatactatgtcagaatacaaactaccttctctcttacttctgtctggtctaagcagaaatgtgtgagtaacataggaaccacacagctaatgttggtcttttgcttcctttaccactttacagtgtattaagaagaattcatttgcagtgttacagctctttagaatttctggtttctaccagaaaccgcccccccctgcaatgtgaaagaaagaaaggaaagaagaaagaaagaaagaaagaaagaaagaaagaaagaaagaaagaaagaaagaaagaaagaaagaaagaaagaaagaaggaaagaaagagaaagaagagagagagagaaggaagggaagggaggaaggagagatagaaagaaagagaagaaagaaaagaaagaaagagaaagaaagagagagaaagaagaaagaaagagagagagaaagaaagaaagaaagaaagaggtagggagggaggaaggaaggagattcatttgccaaggagattcatttgccatggattttctgaaaccatgaattttttttttttttctttgagacagggtctcactctgtcacccaggctggagtgcagtggcgcaattacagctcattgcagctttgacctcctgggctcaggtgatcctcccacctcagcctcctgaatagctgggactaccatgtcactggtctacaccacttacccaaagttagcctttgggttgggggttccctcgctattgtcacttctgtggtcaccagaaagatgctactggaaaggggtcccagtccagaccccaaaagagggttcttggatctcacacaagaaagaattcagggcaaatccatagagtaaagtgaaaacaagtttattaagaaagtagagggataaaaggatggctactgcatagacagagcagctgtgagggctgctgcttgcccatctttatggttatttcttaatgatacgctaaacaaaggatggattattcatgacttccctttttagaccatatagggtaacttcctgatgttgccatggcatttgtaaactgccacggcgctggtgggagtgtagcagtgagaaccatcagaggtcactctcattgccatcttggtttaggtgggttttggctggctctttactgcaagctgttttatcagcaaggcctttatgatctgtatcttgtgccaacctcctatctcatcctgtaacttagaatgcctaaccatctaggaatgtagctcagtaagtttcagccttattttacccagcccctattcaagatgaagttgctgtggttgaaatgcttctgaccacgatgcccagctaattttttgtatttttagtagagatggggtctcaccatgttgcccaggctggtctcaaactcctgggctcaagccatccacccacctcagcctcccaaagtgctaggattacaggtgtgagccactgcgcccggcaagaccacaaatttcttgattatgttttcgaactttagataataagtaaatctccccatgatgaaattaacacaaactaacatatttacatatgagcactctttaaattctggcaacagccgtcattacagtttagagaaactgaggctcaaagaggttaaacaatttgttaaagattacagcctgggcaacatggtgaaaccccatctctacaaaaaatacaaaaaaaaaaaatagctggaca

SEQ ID NO: 15498 - DNA, 221966 bp, Human
aatgtagggctcagttaagtattcaaagttccaaggaggcaattcaggcccccatttcacacctttcactgttagagagcggagctcctatccatcccaggcccttccactttgtagatcaattgctctatcttttggcagcttcaacaaagccctgtcttatgaaaatgctttattgttcagatcagggacctggtagtaaaaattaactataaaatacttttttttctattatgcaagtaatgggtagcctttttaaaaattggaaacatagagaaaaaagtttattcctaacaaccggagcctcagtggattaaaattactcaggtttctcactgatgctacatgcccattgaacgtcaggtggggactctgcactgctttagtctcactctggatactggctgacagaccacagctttctagaatattgcggccgaggaaaagaaagctttgcggcatctcatacatctcatattgctgctgcagaagtgacagtcacttttcctcttaaacctctagtcaaaacttgtaaccatgcctccacttaacaagaggtttggaaagtgcaattctgccatgtagggaaaggtatatgaacagtggtaagggctaccacactggagaatagctcctttcatctgcctccctttgcagcctgcgtccctagtccatgcgctctactgctccagtgcccaccactgcttgactctgcctttgtgtgtgtcagttcacattatcaagaaggaccatgactggtagctctacggatggaggacccttttgtagcaggtgttcaccctgtgcccaagccgcagtgcctagaagagtggggatgggtctgtggctcctatcaggctgcaggagttgcggagacagaaaaagtatttctaggactcccatttggccttgcagtctctacacatccttggcaatttctcccatcttggcttctccttcttatcactttggtccacatacggggacagcgtctaagttctttctgaccacctcctcagtcctagaaaaaccagacttggttaagtaccagagcacagaaggcatttagtgctgctctgctcccaagtcatctattagtttcactttagccagccatacctccttggttacatatgaagcatctgtatataacttagtatcatgctttttcacattatattttgatttttatcggaccggaaaccctaaatccacaagcataacaacaagatcacatttgggctttttcatttctgtaaccagaggattgaacgctagttttgtagtaagacttcaattctatttatctgtccaggcttaagggttcctgttcttctttttaagtcattaaattgtatcagacaagggggaaaacgcgtgtgtgactttccctaaggtaagatgggcttaagggatattgaaaccagggcagagaaatgttttctgtgacccaccagtcagggcaaggcatagaaggagcaatgacttattcattagcccagatagaaggccagtctttttcaggctgcggcgcagagacgccaggctcaaagggcaggagggccgtctgcaggcagcgccgccgcggctacctggaagcccagcaagtcacctgagtcctgcgggtgcctgggctgccaatctgcagcgacccgtccgcagcccccgggggcaggaacaccaaccccgggacaggaggacgtcctcggcccgctgactagggatccgccagcgggtgccgctgagccacatccccgcagttggcgccagcatccaggtaccgcgcgccacagcacctgcctgggcgttcccgcgcttggggcggggcttcccgcgtcccctttaagaggccgcatcacccgcccttgacgtcagagtgtttctccgcaagagcccgtgtcccgctaggctccgcgccctcgcgcccatagccccggcggcggcacgaccagaggcggccaggggagcgcgccgccccgctcggccctccagtcccgctccgccgcctccctcccgcacagcagccgccagcgcggcctcctgcaccatgtcggtggccggcctcaagaagcagttccataaagccactcaggtaaggcgcgcggcaggtgcgtcccggggcagtccggggcgaagctgcgaggggcgcgctcggcgctggccgtccggcggcagcttggggagttcggcaccgagcctcgcccgcgccggccgcgccccgcctcgcaagccaaggcggcggctcggggcatccccggtctgggcgtccaccctcggtcccccgcccccggcttggtgcgcgctgccttcccgcgggtccccggcgtcctgcctggtagcgctgctcgccgcccccgcatcatctcgcgcccgtgctgcaggaaggggaccgcggctgcactgctgccgcggcgcgcaggtgccttggcggcgcggtgggagattatgtaaagtcgcctcttcacgggtgaccttgcggagtcggtgcacccggctgtcccgggatgtgttggcatgagcggtggccgcactgggggtggcggggcggaggccggcggtttgcgctcttctcccttaccctgttgtcagaaccctccttccccgccgcccgcaggctccaggggaatggaaggctggggtcttcctttagggacccgcatacattaacttttacctggagaactcggtcgtgaaactcctttgaggccagggcatgacaaacagtctgcgggtcttaaatatttccctaaaacaaccaaattgttgaagacttaaaatcatcatgtattttaaattgtttttaataaatctttggcatcttggatgtgcccatttttctttatggggttaataagctgtgactgtaataaaactgattaatttagattctaataattaaaatcattggactcaaagaattttacataggggcaagtaagcgaatacttacgctgtgacctatttcttacataatgtgtgtgattactacttttttatccttctgaaataggttcaaatttatgggatctttaaggattttgatgacttaccgcgaaatgtttttcatgatttggtgttaaatagtttttcataggttagccttaattaacgagctttctcataatttctcggaagtagtgaggtttttcctaggctaccacagtggcagccttgttatgaaccacatccagaaaaggtgagggttgtgttttacagaaccttggttaacttagggtgacagatgcagcatgtaattcccgtcgtgtgtgtgtttgcacgcatctgcatcatcttcatcacacattcttgcctttatagaatcaattatacctgtcaacttaggaaatcaagaaaagtaagactatttctgtaaaaatgtttcttaatgtaattatttttgcttttctattataattggagttatctgtgacctctctgccagacatgtttatgaaagtaagtgatttgtttgttgatgtagtttggaaggcttctaataactttatactgcaagttctttcaggtttacagaaccaagcatatgtgctgcccaggaattctgtggcaggacttcttcgatattactaacctttttgattgctctactggtcacttctctatagcatatctcagcactgcgtttaccaacacatcttttttccacttggattctaaagatttcttttgcaaagcttagtgccctcaaaggcaattaagagtcttggctttggagtgggaaaggctaaggtttgaatcctgcctctgctgcttctgaccttgagagagtatttaacttctgaacctgtccatgctgaagtgatgataatttccgttgtctcttcagggttgaggtgaagagaaacgagtgtgtagaacacacgtataaagtgttcaataaattatagttattgacataaaggatatttttattagtataaaatactatcccttatgctatgaagaagttacccaaggtagaccttttagtttttccaacttaaaaaatagagcgctccatttccgctaaatcttgaagttctgtgtcgccctataaagtgtagaaaaaataatttaaactgcgttaggaaagaacttaaaaggttggagaaggtcggcatgtgatgcgatacggttaatgtttatcacaccgaatccaaatgcagaatcactgcgtcattgtcttccttttactgaaaagccttttatttgaaaggtgaagcagcacgtagtctcttatccataatttagtgtagcacactcttagaaagtctaaggcacaggtgactgttctgtgcatatgtatatttaggagagtatgtaaagcccatgttaatgtttgcatgtgacaaaaaaattagagaaatagtcctgtcctacttttgtagccatttttttccatcaggtccgtgaacctgatgttatctacagagaagctttagacctagaattacttccttttgagaactgatgtgctggataatatagcctgggtttgtttgtttgtttatttatttattcatttgagacaaagtttgactcttgtcgcccaggcaggagtgcaatggcgtgatctcagcatactgcaacctctgcctcctgtgttcaggcgattctcctgcctcagcctcctgagtagctgggattataggcatgcactaccacgctcagctaatttttgtatttttagtagagacagggtttagccatgttaaccaggctggtctcgaactcctgacctcaggtgatctgcccgcctcgattacaggctgagcccccgcacctggcctatagcctgggtttataagtggaaggagtctgttcacgcaaacgtttctttctatggaattgagcttttttgcttgtgttagtaagcgatgataaataaaacagtatattgtttgtacttggaatttctgattaaatgtgtcacaactgttgtcttatattagaattggttatttctaccttgttgctgacagttattttcaatatgtttacaatttggaggtaaaaaaatgcttttgccaagtaaaatttattagagaagaaaatcctttcagcatgaaaatatataatgataccaaaaattgatcatcttattttcatgtacttcattacttaattgctcataaagatataatttactgtataattagaataaagtattctttttttactgtaataaagggcagatgatcttgtgttgctcttttagtgagttttattcatattgagatttcattttacaaaagtcatgtcagtttttttacacttgttttaaactggcagcagcttagttaaaaatagctgtttccagtgaacatgaagctcctacaaaatctgtatttttaaaaattcactctatcatgcatatgatgtggacacattttgctttacaatatgtaaaagtctattataaagtaaaatatattaggtcattttatgagtttgctggagctgctgtaacaaagtactacaaactgagtcgtttcaacgacagaaatacattgtttcccacttcttgagacaagcacacttgaagtctgagaccaaggtgccagtagggccacgagctctctgaaggtatgagacaggatctattcgaggctgccttcttagctcttgtgctttgttgggaatctttgggcttccttggcttgtagatacatcaccttggtctctgccttcatgctcacatgacattctccctgtgtgtgtctcagtgtccaaatttccccattttgtaaggaccccagtcatataggattgggcaagcccatcctactccagtatgattttatcttaaataattaccatctgtaatgcccctatttccaaataaagttgcattctgagctattgtaattaggactttaatatgaattttgggaggggcacagttcaatccataacagtcgttatttgcataaaaggattaaccacagtattctatatttgattcaacatctaagaggacagttcagcctataaataacatataactttctattgcatcaaaaagatatactttctccttttttaatgagttggttagtatattgctaagttctgaatgtgtccctctaaaatacgtatgttgaagcttgactgccaatgtgacagtattaagaaatggggcctttaggaggtgactaagtcatgagggcactcatgattaagtcatgaatgggattagtgctctcttaaaagaagttgaaggggtcaccctgtccccttccaccgtgtgagggtttagcaacaaggcaccatctttgaagcaaagggtgggccctagccaggcacaaatctgttagtgccttcatcttggactgctagcctcccaaactgtgagaaataaattctattatttataaattaccccgtctaagatattttgttagtagcctgaacagactaagtcagaaatatacctattataaattgtgttttctgatttttttaaatgataaaattaatttgggtaggctgggttttatgatacagtctggtatatgtttatttgtcacactcagattccttaactgggaaaatttcatcatgtttgtgttctgtgtctttttgttttacctaatttcctctttcagaatgctgtattttatatggatgctttgctcaggagaccattacatgagtcttttcatgcatttgttgatttggtgagatgttaaacttactaagtattggattaaatatctaattagttatgactttatctcagtgagattttcagtttcttaattgcctctaagcagtcaactctctgctgcctttaaaatcttggctgtggcttgttgcttgacccaggatttctacacctgtaccctttcacattcttagccagtagtctctaataggctgcaaggggcctatatattttataaaattataagtaacattttatacatgcatttttctgagggagaatgcccttagcctgttaccagattcttaaataaattcctaattgctgccccttcctcccctcgaaaagtaaaaatagggtggggcgtggtggctcactcctgtaatcccaacactttgggaggccaaggcgggcggatcacttgaggtcaggagttcaaaaccggctttgccagtgcagtgaaacctcgtctctactaaaaatacaaaaagattagctgggcgaggtggcaggtgcctgtaatcccacctacccaggaggctgaggcaggagaattgcctgaacccaggaggccgaggttgcagtgagtcaagatggcgccactgcactccagcctgggcaacagagtgagattctgtttcaaataaataaataaataaattcatcatgtcatcaggagaaagtggatgtttcttacaataatcactccaacagttctgttactgggctttaggatgcctgatcaaaatgcagccttctctgcattaatttagcagcaatcaaatgtaaaaaacctttccagaggtgtcaggattgaatgaggtaatgcttgtgagagtgccatgcttgcataataaggatcacttgaaccatgtaaaacaaaatgttgttaatgcgcttgaagtcaacgatacgggcctgtggggtatatgaaaagaaagtggtgactgaaaatgatttctctgtagactgagagtcctcgtgattgaagtttgtgttgttgaaacagctatatttttgcaagcttttttccccatagtgattctttaatattttaaattgagtttatatgaattttggtttcagtctacttagaaaattttaaagtaacctgcaaattaattagaagtaccctagaaaatggcaagacttggttggggcaaatggtgactgttttgagacagatgtcattgtggaagggagaggtttaatattcaggggaagggagctgaagcttgcagagcagattccattctgccaagcctcttgtgctgcatacagagtctcagggcatcaagcaacccgagggctttcttcagaggagtagcttgaggcagcggcgagagaagggcaggacacactgacaaatgaataatgagaattaggtgaggagatggagtttaagaactgcttcaaactttaaggtggatacctgatggggctttctagagatgagcaattcttctcaatttaaggccagataggggagatgctaagtaggtaagaagtcagtggattttttggcctccttttttctctttttgttcttttaatccttcgtacccttgtcctgtgttcttttaggtaatgttcagtgaggtgtagccacaagaggggacataggagaggctcaagaaaacagagtttattatactcacatgtcttagaatgacaatcactgtacaggaggataggaggggggacacgtggggtggaggtgacagctctgagagcaggatcagctaagcaggtgggaaacaggtgggagcagagagagcaaggactgtgggcaagtgcctttactagtgatctcagtgcagttcacagctcagtgcagttcacagtgcgttgcattggtgcattggtaggtcgtggtcagaagaagacagagaggtgaacttgtggtaggggccaaccttatcaaacttgtgcacctggttacctgggtggggtgttcacagttagcgtatgtgggaatgaatgttgaggcagcaagaggcagcaggagacaacatgtgaagttttgaaactttgtaatacaacccttctcagtgtttttagtttagaatttattgtttccataatcacttaaggagcctaaaagcttaagaatgatgtacatggtatccgatggataataaagactaaagagagctataactatacttattaaaatgccatgattgtgagaccctgccaagtcttttgcattctaccaacaaaatattttcatgctatactaaatcattagctgatgacaaatgcttcaggaaataatttcactatttataaaggttttacatttagtacaacttctaaatgccaaatatgatgttgtagttgctctaccctaatctccctccgccatcccctgggtcaaattgtatatagtagtaatgaatatggagaagctgtctgtaatactcgtgaagaacccacagctccatggaggtttacttggatacttaggacactgaaggacctctaggcagtgttttctgcctttttttgaattatgatatatataaaaaatagaaatatcttttttataattcaaactaacctttccccatagatactaatggaagcagttttataatgctgagaaacatctcaatatcaagctatgtattagtctgttctcatgttgctaataaaggcatacccgagactgggtaatttataaaggaaagaggtgtaattgactcacagttctgcatggctagggagggctcaggaaacttacagtcatggcagaagggggatcaaaaatgtccttcacatgacggcagcaaggagaagtacagagcaaagtggggtaaaagccccttataaaaccgtcagatctcgtgagaattcactcactatcacgagaacagtgtggcggtaaccacccctatgattcaattacctcccaccaggtccctcccatgacacatggggattgtgggaactacagtttaagatgagatttgggtggggacacagccaaaccgtatcacagaataatgcttgaaagaaacataaagcagatagcctatgcttttaaacgtacaggaaatcggctgggtgcggtggctcatgcctgcaatcctagcactttgggaggtcgaggcaggcagatcacttgaggagtttgagaccagcttggccaacatggcaaaacctcgtctctactaaaaatgggaaaattagccaggcttggtgatgcacagctgtatttctggctactcaggaggctgaggcaggagaattgcttgcacctgggaggcggaggctacagtgagccaagatcacaccgttgcactccagcctgggcgacagagcgagactgtctcaaaaacaaaacaaaacaaaacaaaaagtacaggaaataatgtccacagtgaatgacaccagtgaggaaaggagagaaggggagtcaggacagttattgtccataacagtgatggcatcctgcagggggcattgtgaaatcccctgcctgccagtagaggaagttccttggttttacaatctggctctgcaatctgggaagaactcttgttctttcttatatatatttggccaggtctaaggagggttagaggaaatctgccctctttgggaacggcataacttttcagtcaacttcctgtttatttaaatttggggattgttttacagtcatagggttttcactatccatggtagatttgagtaatgaaatttcttcataaacttagtaggcttctggccaagtgcggtagctcatgcctgtaatccccgcactttgggaggccgaggtgggcgggtcacctgaggccaggggttcaagaccagcctggacaacatggtgaagccgcttctctactaaaactacaaaaattagccaggcatggtggcctacgcctgtagtcccagctactcgggaggctgaagcttgaacctgggagagttgcttgaacctgggaggcagaggttgcagtgagccagattgcaccactgcactccagcctgagcagtagagcaagtcactgtctcaaaaaaacaaaaaccaaaaaaaaaaaaccagaaaaacttcaacttaataggcttctgatgtgttttcttgtgagtttcatttgccaatttctatgatggaaattcttttttagacctaattttcatccagtagacttggttgtgttactctgaacttaacaagagggcctgatactttggcttaaccaagaagtcttaatggtactttgttgctcaaagtctttttcatttatatttcccgttatttgcttcagggactcaggatgaccctggatcggttctgccatctgtaacatatggttttcaaggttgccaaagggaaagaatatgtttgaacaagcatgggagatgttcataagccaggcctggaagaggaatatggtagacagaatgctacgattgttggtgactcttgctcttgtgtactctcctcccctttgagtgtgggtgcaatgttcaatttgaaaagatgttattcctgagacttttaactttgtaagacaaaagggagattatatgattggacttaatctaatctcatgagccctttaaaagcaggatattttctctggctggtagtggaaggaaaaatcagagagattggaagtatgagcaggactggacatgctgttgttggtttaaagagggaggggccatgtgagtagtaatgcaggcagcctctaggagcagaaatcagctctttggtgaccatcagcagggaaaatagggatcttagacccacagccttgaagaatctgagaggaagggaattcttcccccaagcttccagataagagcccagtctagccaacgccttcattttggccttgtgaggccctcaacagggagctcacttaagcaggcccagacttctaatttatagaattgtaagataataaatgggtattgttttaagctgctaaatttgtggtaatttgttatacaacagctgaaaatgaagagaaggaatagttccttctgtttatgtttggttggctggaacttgtaacatggcccctctgtggtacacctaagagaaatggaagaaggcaagtgtagcctagctatgtgcccaggatgtaaaagtgggtttttggttaaaaagctagcagttttgctattactggtgcctataattaattaattgtgtgtctgtatattaatctatttgtgagcttgtaagtgtatgtatatgtgcatatgtccatatgtacatacacaacatacatatgcacatatgaattttaagtctagtttgctgaataagtcttttcttaatacataaggctcagtatgttccatgtgccttttgaaactgtcgtccaggctggggtataatggggcgatcacagctcactacagcctcaatcctctgagcccaagcaatcctcccacctcagcctccagagtagtgggactataggcgtgtgccgctatgcctggcccatgtgcctttttaatatattttttattttatagatttttttctacagtgctttggctttttgatatttagatgtttttctctgatgaggcacaagtttatttctgtggctcctgatcagttttttttttaacagtggcaccgttaagtacttgctgagcagtaccttagcctggtgggctggtggaacagtgacaacttctctaaccttggaatagagagactacagatctgcaaagaagtttctgaattcttagtctctgacagtgtggcagggatttcagttagagtagaggagttgactgttaatcctgcatctgtttttgtgcttgggggaaggctgaggccaacacagacagtgaaatgccttacttagtgcaggcacatcggatggctacatggtactttgaagttgttcattaagttgttgaggattgcagatttgtgtagcacatttgaagtgtgttgtggtgtaagcagcagggttgagggtggttgtgggccccgtaacatgtgggccattgtctgtgatccgttagccccatgctctttgacgtgattcatggatccttagccctgaatggttttctaggtacatctggtagacggtgccagacataatttggaaggcatgcggtctggcaccctgagatatattttagggacttggtgtcagttgagcagcttggccagggagagaatagtgaggcctgattttgtatctgagtggtaagtaacctgaaggagaggtgtcctgtagaaattgcagggtggacacacctctcacttctgttattttctgcatatactggttgctgaggtgaccctaatgtgcttctttctattgagttaatgtgtgtacagtggcttgatggctgaatttataccattcattattttactgcttaagtggctgcatctgggcaagaaggacctacaaaccctttgccatggccattgcacatcatcatcatataatacactggctaaaggaagtgttttctggaggtgttcatcagtactgtagttaagagtttactgattaatattaatagcctgttatccagagatcttctacttctgatgatgaaccttgcacttaagttctgtctcccatttcactttttagttaagtttaacaaacagtaaaactgttttccattattctcttttccattcatctcatccattatgctctatgtattttgggccatttgaagctgataaacctaaaatctttggatttttcaccttttgatcattatattcaccttaaacccagtccaaattttgcagatatatttatagtgctcatcgtccctatgttctagacatggaaagctccttttccctagctccaagaaaagctggaagaatgtcattctttacacaacttaaattgttcagaagatatttttgtgatcacaaaggtgtatttaattcatttttgttttattttgtttttgagacagggtctcactctgtcgcagtggcgtgaccacgaatcactgcaacctcctcctcccaggcccaagcctccctcctcagccttccaggtagctgggactacaggctcacgtcaccactcctggctaatttttttgtatttttggtagagacagggtcttgctacattgcccaggctggtcttgcactcctactcaagtgatatgccttccttggcttcccaaagtgctgggattacaggcatgagccgccgcgcctggctaacatttaattcactttttacaagctctttcagctactttctgtgtctgaagacacagacatgtaaagcattttgatacattttcaccaaaaaaatcaccttacataaaaggacgtgtcttaaacagaaagcttatcataaaatctctatatcaattgttttcctaaattgatgactgttacgtcttccccttttgtgaaacagtgagttatactgatattttgtgatatgtactggcttgccctttataatatctaaattacctaaattcttagtgttgtcacccctccagtgccccccaaaaaaggtcaacaggtcagagttaaattagcatttactcaggaatggggtttgcaacctggctagcagtcagagattgtaccacccgagaagggcaagggggctatttaaaagaacttatttagattacataaattgcttgtcacattatttcattggtgtattaaacaagtctttaatcagtagtagaagggtacatttgtatcagttattcaggaaaaacctatatacagagtgtttgtaaagattaggaccagttttacttgtattgtgtagtgctgagagcacggttgtttgtgaaggaatgtttttcacagttccttttcgggtctcaaagttcatcagcagtttaatatggagtagtagcccaagatggagttactgatataaagcctggaacattgctaagctcatagtgtccagtaaaactgtgtctactggttgctgctgtgaatgattcaggtgaacgtaggcgttttctgtaggcgctttccacatgattatggtagaataatttgattgtttcctaagcgtatcattcagttgtatcttcatgacattttgtcaatctgtattcatgtttactgactatataagggttcaccagcaaaacagaaccaacatgatatgtagatacatgagagggatttattatgggaattggctcatgtgattatggagactaaatcctgcaatatgctttctgcaagctggagaatcaggaaacccggtggtgtaatacagtccaagtccaaaggcctgaggccccggggagctgctggtgtaagccccaaccccaaagtctcaagaatttggaattctgatgtccaagggcaggagaagatggaagtcttgcttaagaaaagagagcaaatttgctttttgctcttcccaggccctcaagcgattggatgtctgctgccctcagatcttctttgctcagtctactgattcagatgctaatgtcttctggaaacaccctggcagacacacacagaaatattttaccagctatctgggtatcccttaacccagttaagttgacacataaaattaatcatcacactgacttaatttaaaactgaatcagtgtaccattttcttaaatggaaaaatcactattaattatcatgcaaaacaaaattaagtcctggatactcttgcctgagtaaatctgtgagcttgaggtttattctgcctttgttaaaacaggagattaacagataagtagtagatattctaacaataccctgagatttcctccttcactaaattagaatggaagaagaataaaatggatattttaatttggggattcagtgttcttaaggaccatggtattgtgaaatatgtatttcgtctccctgtttcctcacagaaaaaaaacctctaaaacccatgggatcatcagggtggtaactgtcttttctctgctacgagatgaccagtggctggggactcctatagcttcaggttggggactgttcaccagaaagaccaatgtatgcttagagggttgggactttcagctccagcctccttagaggggaaagggggtgaaggttaagtggatcaccaaaggccggtgatttaatcagtcatgcctatgtaatgaagcctccataaaaacccaacatcacagggtttgggaggattttcagacagctgaacatgtggtggttcctgaaagaggatgtgcctggagagggtatggaagctccaggctgcttctcccatacctcgacctatgtgtctcttccatctggctgttcatctgtatccttttaatacctttctaataaatggctaaacataagtaagtgtttccctgagttccgtgtgctgctctggcaaattagttgaatcacaggagggagttgtgggaaccctgatttatagctggtaggttagaagcacaggactgtgcttgtgactggcatctgaagccagttgtgggaccgagccctcaacctgtgggatctgacgctatctccaggtagtgtcagaattgaattgaattagaggacacccagctggtgtccagtggagaatcatctgcagaatgggttgctggtagggagaaatccccacacattttggtaaccagaggtcacagaaatagtctgtgctgggtattttgaggtatatatataataggagaaactgtgtttgtttttttcctacatccttacaaggacacaagaatgtaccaactgtcttgttcaaaacatggcccttcccatacataatttgactatggaaatggttgacctttttctgagtaccaaggagttttctgcctgtaatggggtatttaattatattttagaaaaaggaaggtcatttgtttagagcagcactgagtcatctgttctgtgcccgatgttcggaaaggaggtagacatgttctttaagagaagcttttgaagtaatttagaaaatggtgcaataccatccgtcatcaggctgtgtggcacaagatcagtaggagcccagagacttcacatctcctagttttcccattctgagcacttgtgagaccccagaccagtcactagtcacttgatctcaacttcttcctcctcacacccacattttctcagttgcacagctgaggtaatatggtcctgggcatgattttaggttctgacgttctatgcttctggtctcgttcccctctggttcattatctactgtggctatagtgacttttctaaagagcaaatctagcattgttcttcttcttaaaactcttcagtggctccttatggctcccaggataggtccctctgaagtcctgttcaggagtctgaagtgtcatctgtgtcctgctcagtgatctgctttcactctcacactctaaatgtgctctgagttgtagctgtgctagttatcctgacaccttgcaattatgccatacgtttcttgcctttcaagccttcgcaccatgctcttccctctctgtggaaattcccttctttccacttggtatttgattaatcaccactttatcagcttcatattttctcagagaggttacccttccctcatttagtgtgggttaaatgtccttccatgtgcaatgaaaattgcatgttgtgggagaggaacaacacacaccagggtctatggggcgggggtgggagagcatcaggacaaatggctaatgcatgtggggcttaaaatctaggtgacaggttgataggtgcaccgaaccaccatggcacatgtatacctatgtaacaaacctgcacgttctgcacatgtatcctggaacttaaagtaaaataaaaattaaaaaaaaaattgtgtgttgtacctctgtgaagtgtagtgctcggctcactgctatacaggcaccagtctccttgatggtatcctctagggtgggtataaagagaaggaccctgccattctatacttcattctgttgccagttcctagcctgtagtgggcatttaattgataattgttgaatgaatacatagcttctgtttctgttgatccttatgtatatttaaaagggggtcctatgcatatatttttgatgtattcatttctgcttaaaatacatcaccgatttctaaaagttaatgtagaatttaaagcacaccctcataaaattgtaagattgtaagtttaaaataaacttccttcattgtacaaatggctagcctaggtactattttaactcatttattactcacagcaaccctatgaacattattatccccattttacagatgaggaagctgaaacacagaggtggttacacagcttcagtggcagagtcaggattgaaaccacaccacctggtttcaaagccagtaactgccagtagtttttaaccatgagtcctattgtcaccttatatatcaaaccaagacatacctaaaagctcttagtggtcaccaagaagacgcgaacactttagtagaaaaataagacaacaatatgaaaggcagtatttgaaagagcaagtggccaagatacgaatgcaaaaatcaaggaaatcagacagcaatatctgacatttttcattgtttagattggcagagatgaaaaggatagtaacattctgggttagcaagagtataagaacatgggtccccgtttatggtgggagtgtaaactgttaaaacacttctggagatcagtagttctcttccctgtaattctgtttttaggaaactattcacagaatataaatgtataagtatgtacaacttaggtacaagattgttcactgtagtagttattgtggtgaaaaattgtaaacaacctcaataagggatgaggaagtaaatctgtatgtcaatattatgaaatctctacagctattttatctatagggcaatatttattgcagtagggaaacattcatgattattgccaaaatgaaaaaagccagccataaagcagatatgtaatatgtagtaagcctgatattgtaaaaatatagctatgatggtagctaaaatgcactgagaatttatagaccaggcgttatgctgtattgttacagtaagattatttttttaatgaacatttgaacagtgattattcctggtcagtgggtttatgggtgagtagtgtttctatattttctttcttatctttggtaatttgatctattacaaaattttctttccacttcatcgtctttacttgtaaccccactttctcaggataagttgaaaacaaggaatcgaataattttaggagccatcacggggactaggaacaaacccagtttctagccaagttctagaactataaatatatgtcagtttgcttcattaggcatttagcttaaaactattggaacacctgccctgccctccatagagccctgaattaaattgtgctgcttgggtttcttctgaatgcatggctacttttctggtttcaccaagaagatgtgtacaaacattataagtaagcagctgctaatgacttttgctggcatttcttttaaatgaagatttttttttttcagttccctaagtcttatccctagtgtcatagcattgacactgttttttcgtaaagggaaagagggcagctaagacatgtatagggtattggagtgctcctgtaagatgttcttggtaatttggtgtgagctgttcagcctcattctccagcccttaggccacgagtctcctgggcatctgtcacttcttagcttctcagcaaaaagcctgtaggcagtgccattctagcaaaaaaagaatgaagtgagggagagatacctgagaagataggagacgttcccagtgatccctgttgaacttgaatgcggaacattgttaatagtctctggcaggcttctattttgaagacagaaaatacaaagtttaggaagccataaatggtaaaataatatattcttctcagcaacccaaacaaaatacataaaaatggaaaaaacactaccgtgaaacgtagcctcagtaatgagatgggcaggccacttttgcctttctcccaaagaggacacgtctagcaagatccactggactgctgacggtggtggattgctgggcacaagcatgcctttatggatggtctggctttctctggggcctgccactctttgatggcttcaatggcaagtgcttcgacctctgagataaataatttctgtgaaatcatttctagagtgaagctaacttttccaacctctgcagcatcttgtgatgtttctggggataatattaacttgtaagctgagaaacagttgagactgcttcaagagatttgttttcttgtgtagtaatctgctgaagcatataccaaattgatgtttttatttgctgcaaaacttcgggttttggtccttttaaagtagtttcagatttcagcatttaaaaataattgtcctggcacagtggctcacgcctgtaatcccagcactttgggaggctgaggcgggcagatcacttgagttcaggagttcaaagccagcctgaccaacatgccctgtctgtgctaaaatacaaaaaaattagctgggtatggtggcacatgcctgtaatgccagctactcgggaggccgaggcaggagaatcgctttaacccaggaggtggaggttgcagtgagccaagatcatgccactgcactccagcctgggcgacagagtgatactcagtctcaaaaaaaaaaaaaattactatataacaatgattttttgaatgaaggtagatgtagcataattgaactttgttacttatgtattctgtattatgtgcttgttaggtggttctcttaagagtaagggttttgcaagatgcttctttcataattggacacaacttgtagaaagtgaggtgtgagtttgtttgatttatatgtttttcttatcagattatggaactatccattaataagctactctagaaattatttggatttaaaaactctctttggagagttgcaagggcctgcctgatctgaccctggcctctccaccctgattgagggccagtttttcccctctttatgctctggtcctccatctttcttaacaaacagtaagcattcgcccattaaccgccaggctctgtgctgagttttaggtatagagagatggataaaatactcattccctgcccccgtggaactggcagtgcagtgtgggagacagaccaatgattatgcaaatatataattagaatttgtcacaggtgcagcaaagaacaatgctagggcactctcacgtggaggtcatacctgacattctgttgtggagagaggccatgttcttttcagtatgtagaaaggttaaggttgtctatgaggtgcagctggggaagctctcaccagctgacgtcattcaaaaagtgaacagggtactactatttgcacataaaaaagagcaggttatggtttcacagacactttagattcttattcagagaggatagctttgagggtaaagaactacttctcatgtcttactgaagctagggtcatggaacatctccagctggaatagtttctgttaaataagattgtatgatatgattttacatcattatctttcttaccaaagatcataactctgtctcacagaaatgtgtggtcatgcagtgtttccctgaggatgcgtctttaaactgagaaattgaggctgagaagaaaccaggcctttgcagagttgcgggccaaggggtttgagcccaccccccgacctgcccacttcatgtcatctgggagctagtccactcccactcatcctttaggccttgatccagatgatacttattggaatccctttctctgacctagtaggttggatcaggttccttttattacattcaccatggtttgtgattgtgcattaattttatggccattcgattaaatgcctgtctccttcagttggtctctaaattcctgaagggagggatcaagtttctgctgatctcttggggtagttaccattatgcccattttactgatgaggaaactaaggcacagggaagtgtagtgactcatccaaaataatacacggtattaatggtggaggcagagtttgacactggcagtccatcctttcaaagttggaatagactttaaatgaatcatttaattatttaattggtcaatggaacaaaatggaaagtccagcaataagtagtacattgtggtgatttggtatacaataaaggcagtatttaaaatcatcaaaaaagaatagattatttagtaaatggcatttggacaattagctattcgtttgagaaataaaatttaatcctttttgtcacatcttaaaataaattttaactagttggaaaatatgaaggtaaaagagtgtaaaaagaaaatatggtttcttttgaaatggagaatactttctaaacataacatatcatgcagagactgtgcactatggatgaaggctggtgaatttttgctacttgtaaaaatgaagaactgctgagtagcaaaggatcctaaagatggttgaagtgactaatgggattaagatttgcagcatacaattaaaaataaaatttacaaaacccagccttggcaagggtacactgccaaatggcactgtatttccagcaggttcttctttctgggatccagttaggcaatatgtgtcaatatgcagattccctttgattaaggtacttcttggaatttatcacaagtaggataattggggatgtgcaaagatgtatgttcaaaatttattgctgtgttaatggtagtgaaatattggtccagtcatatgatggagttttatgaggcaaatgatgtgatctacattcacgtggaaacctttctttgacgtgcttacggttgggggacagattctagccaggcatttgtagcatgaacccatatgtaaaattgtgggtgtggcctgtgtatgttcttttggatgggtggtgatttggaactagggtcacaatgttaattatctctagatgtgggctttcaaacgttttctttttcttaaaattttttttgatatttcctttaaaaaatataaacggtgaatatatacctattgataataaacccatccaggaaacgggaataaatatctaagactgcctatcttttttttttttctaatctgaacagttattttgcttatgaaatataaaattaggacactttgtcattttgtatttaaattcttatatcacttattttgggctcctatacatgctcttcctgcgtttggctttcctagccactgtagttgggatgtttgaaatattcagggtactgaacagcagtttagacacaaaaaggtacctgggtgcagaagcattttcattaaaattacatgaacgctggagtttattctacagcacaaagccttcctggatgaactggattaatgtttgatagaaacacagcctcttaagcatcaatgttcttaaactgtttgattattaattaaatgtcctatgttcttcagccttaaaaggtaggagaaactaagacaaaggagaaaaaaatcaagatgtcaaagacaggaatgtaatgtcgaagggagaatttcaaataacccacctccacacaagcctttctcagggagacggttaaacagcacagctggctccgattctgatgttttctcagttagatcttcagagaacagttttaataaagctttaattatggagcatccctacacacactgtagacagggatcattcagctgcataatgttgctgatgatatatttatggaatgctatttccatcctagtttaaggtatctgttgctcttagttactggagctatgctgatttcagaactacaaacagcttttaatattgaacatgctaactggttcaatgtatatgttgtactactttagtttttgtggggaatggactttaaagattagtttcatgctgatccacagtgtgggaacatgtttggtatttttaaaaactctttactcattgtctgaggtgagaaattgttggaagacagagcagaggggagaaagagatatgttatttatgtaggtgaaaaataccatgtgaatttagagtttagagtttagaatatggcaaccttaatgaattttggagctgcagtaggtaatggatctctaaatttttttctgcaatttttgttgttatccattagctcagtgacaatcactgtgatcccctcccttggtcagtgtgtccctcagcattcttaaccattgtgtatgtgcactaccaagcttttccctgggtgcctcatgtgtggtggtgtttctacagcttttttgcagtgctcaacgtcttcacctaataggtcacgtggtggctgtgcctgacctgcacatggtcatttctttttggttgctgaagcccaggttgtcttaagagataccgttgtttttctttttctttttttggaatcaatttttttttttactaaaggacatacagcaagatgggtgaaaggtggaaaaaataaacacagggcttaatgttgagagggtatttttagacttagaagcagcttgctgctttccatgaaatagttgagtgtaattcatgactcatgtttccgtttttggtggtttttctttaaaggatgaaggctggattaactgtgtgtttgtgcgtgcctctgcagtttggttctctggattcataggagtgggtttcttttatttagtaactatgtgcataatttccttttgtcctttgtaaaatatctttttagtcataaaaatcaaatcatcttcccatgtaagcttcagaaaaggtgaagttatatattgaaacaaaccatgacagtagttaaattttttgtagggatagcagaggaagccagtgagtggttcaataacattgttaattttcaagttctctggaatgcttaaatagagctgaagtacgttttaggtcattttgagttggtacacttttgttggtgacttgttgtgtcccaaaaacttggggtatggtcactggggaagagaatcctattggtgggaaatcttcatctgtctgtggtgggtttgatgctgccaaataggtaaaagtaattacaattctggtagtatgaaagagaaatggtcaagcttgggagtcatggattgtactttggggctgggaatcttatagattgttcatatatggaaagcattttaagggcatttcagaaagccttctggttgaacttcatgaaacttaactcttccttcccgactgtctctcccaccttctgaaaaccacagaaacagctctatttattgggttctatgacttaaaagaagaaaagactgaagagtgacaatcagacgtctttaaagttctcttttggacccaaggcaggatgctcgtggcatttcaacaccttcctcaggatcagagtagggagagacagaaatgatctttatttttgggatcacagcttgaaatggggctgctgggctgtattggatttgattctgtccaaaaggcgaaagtaatgatagctgctgggctcccatcctccatgaaaacccagtcagttcattgtcagtttaattgttgttttctgagctcttctgttttgaacatttttaaaaaagacttttgctttcctctttctaagtgttttgtatcataccccaatgcagaggccaccagccaccttgcctctttcacccccatctccaggagattggcaggtctaatggctgtcactgtagaacagaccttccaggtgactcttgacccctcaaatgaggagtaaccggatcccatgtagacctggcagtataaaaaaactttaatattattgatttgcaaaagaaggattataaacaaaacgctaacaagacagttgattgtcaaattttcctctttatttctccatttttggggaagatggagtgggaataaggtaggaaacatgcaccaaaatgaaaacatttcttgtaggtgagaataacaaggactctatcactgaaacattctctttttaatgtttaactgcaggatgcttaaagaaatcctacaattattgtagacattgatgtgctatcaagaaaaatccatcttaaatcccctgcaaagttcattaaaatcttcctcattgtggtactttacttgagattaatttctttaggtagcatgtttttactttagttgtagcaaagagccacatttacaacaggagcttgggcccagtcatggaacagtgctgtgtgtgcacattctgtgggactgattctgaggacatgccactgagtcttttggtctgtgttggagaggtcaccttaattccagagcagcaaagagttttatttatgagaaatatcctgatatgttaaaatatgtttttgaacatattttggatcaatttgtcttattaaaaagccagcattatttgtatgccaatgttcattgcagcattattgaccatagtcaagaggtgggagcaacccaagtgtctgtggagagataaatagataaacaaaatatggtagatcctgccacatgctacaccatggatgagctgtaaggacattaagctaagttaaataacacagaaataaaaagccaaagactctgtgatcccacttataaggtacctagagtagtcaaattcatagacagaaagtagaacagtggttgagaggggagggcaactggggagttgtgtaacgggtacagagtttcagatgggagagatggaaagagttctagagatggacggtggtgatggttgcataaaacatgaatacacggctgggcgtggtggctcactcctgtaatcccagcactttgggaggtcaaagcccatgggtcacctgaggtcaggggttcgagaccagcctggccaacatggagaaaccccatctctattagaaatacaaaattagccgagtgtggtggtgcatgcctgtaatcccagctactcgggaggctgagacaggagaatcatttgaacccgggaggcggaggttgtggtgtggtgagctgagatcgtgccattgcactccagcctgggcaacaagagcgaaactccgtgtcaaaaaagaaacaaacaaaagcaaccatgaataaacttatgccactgaattatatatacacttacaagttaagatggtaaattttatgttacatatattttactacaaataaaagttaaaaaatagaaaaaagggtgagtcagtctccgatatgttgtttttagtttctggtcatggtggggtttggctgccctggtcctacgcttgttacaaaactgctggtgggaagggtccttagacctgtcatctgctccaacactttcacttcatacgtgagaaaactgggtctcagaagtgaggtatttaccccctcctgcgtgggcttcttccttcagtttcctggagaggctgtgcaaagtgcagcaagagctggacactggactctgctgcctgggctccactctgctctgctgcttactcgccaagtccacacagaccgttaacttttctaaacctgtttctgaatgtataaaatgggaataatgtcagtatcctatgaggttgttatggggattaactgagtgaatgcattttaggtgcttagcatagtattttcacacagtaagtaacacatgaatcttagccgtttgttattgctttgttattgctgttgttactggcatgtgctgcaaagagcctttagggacagaggtttgggattgaggctcagtggcaattacttgttagttctctgtccttagccatgctgcttaatttctccttgttacccagtgcatgaagtaaggatgggtgaagcacttgtcttggtgtggtgcttgtgaagagagagagtggagtacctgacagagcacttggtgaatggtaatgacccaggtcagttttagtgggtaagaggatgtcactgcagcctggagggctggcatctactaaggcgtggtcttcaagggcggtgctgagaacaggcatgctcagctctgaccttgggttagggtggaggtgtgttcttctaggcccgctttctagggcctcctgagaaaggggtcaccggacttctctaggtcagttgtccctaaaagtaggtcgaggacctgcaggtagagcctggtatagcttgagtcagggacagaggtattagtgttctttcacaagtcatttttttttttttttgaaatggggtctttgtgtcccagactggagtgcagggggacagtcatggctcactgcaacctcaacttcctgggctcaagtgatcctctcaccttagcctcccgagtagctgggaatacaggcattcaccaccatgcccagctaacttttttagaaaaattttttgtagagatggggtctttctgtgttgcccaggcttgtcttgaacacctggcctcaaatgatcctcttgtcttggcctcccaaagtactggcattacagacaagagctactgcagtaggctacagttacttttgtttccaatcccaggtaatagacatcccctcactactgactcatcctcttcctgactgtttttcactagcttagccttacctacttccagaggaagacttcatccgaaattgagatgaccagggaggtcatttgtgctcaagaaaaattcatctagcaggcatgtattgagaaccagtatatgataggggtaagaggctagaaatataaagggtaatgaaatgctgctgacatgcaggggctcagcactttcagtatatagtcctagtacctgagagctagcaaaaaacaagcagagatgtttctcttagcccaggcagctcctcactgtgggggtctggtgccaacattgcaactgtattgtgtattatttaaatgtgtttgtatgtttgtgttcagtgtacatatgttttcagatttgtgaaaaatacataataaactgcatgtcataaaattcatggtgtgagatttgtcatagtctattacattcctaaagactctcaatattgtggacattcaaactaaatgattccagaatgactttaaaatgctagtgtcagagcaggcagtagggatgccttcctgtatgggtgtggccatattcacctgtatggggcccaggcagtaactgaactgatagtttcatcaaagtcaacacgttattttttgaactctgacactctatgcttggtatgcttgagcacatgatccctttcattaatggcttatttttttcaagtagtctcattctacccttgtcaaccttgacggcggggtcagcttcacttgcgtgaggtttgtttgtttgtttgtttgtttgtttttgagatggagtctcactctgttgcccaggctggagtgcaatggcgtgatctcagctcactgcaacctctgccgcctgggttcaagcgattctcctgccttagcctcccgagtagctgggattacaggcacccaccaccacatccagctaatttttggagttttaatagagacgaggtttcaccatctcggtcaggctggtcttgaactcctgacctcatgatccgcccgccttggcctcctaaagtgctgggattacaggcgtaagccaccatgcccgctcagaccccacaactcccaaggccaattaaaccagaagcttcccaagtgttaccaagctgcagcctggcttgggaatcattagcctatccaaaagtttgactagtatctcccttcccttttgattgatatgaatgatgctaatcttgcttcgatggtccatggctgtaccagttcagtttcttctttgtatccatcatgagagatctgatataggaaacaaggctaaaatcaattttaaaagtttctacagatttacttgatgttctctgatgaagtgaagctggatatcctttaactacctgagctgcctgccaccttctgttttctttctctttgctaaattaggggagtaaaggtgaaacttaatgttagttgttccatatcctgcagtgctgaaaactaccacaaccaagaaataaaattacaaaattcaagatgtattttggctagcttcactctttgtccaggcagcttcagtgaagtggcaatttagaaatagacggtcagcagtagaaagtaagaccccacttgtgatttacccaagttctttggaaagatgcaagccctcctgtaaacacacagtgattcagaggagcatgtttactagctgaagccctttttttctcctcttctcataaggccggttatcgagggagtttgtgtgtctggggaaaggactactttatgatagttccttaaaattatgacatacagtcatgcatcaggtaacaatgggatatattctgagaaatgcatcattaggtgatttcataattgtgtgaacatcctagagtgtaatcacacagacctagatggtggagcctgctgcaaacctaggctatatgatgtagtccattgctccaaggtaatgaacctgtacagcatattaccatactgaatgttgtaggtaattataacaccatcatagcatttgtgtatcgaaacatatttaaatgtagaaaagatacagtaaaaatatggtataaacgattaaaaatagtataactgtacagggcactttccatgaatggggcttgtaggactggaagttgcttctgggtgaattggtgagtgagtggtgatgaaatcatctaatcagttatgacatagctgagtttttcaggtcttataatcttacaggactaccatcatgtatttgagccatcgttgaccaaaatgtctatgcggcacgtggctgtatttagctgaacgattaagtagaaataacctattaagacctttttccaaagtattttttacatggttcattgttcacattctgtatatatttacatcatactgtatggtctgcaattgtatttttgactttttcttcaaattttgaatggctaaaaattccagcagggttcaagagcttgtcctttttgattgtgttttgtttcatccgtagcagaattgcctagattgaaatgaaatgaaaataatgaatggtatgacacttggtatcatcacaaactgatcattcaaatgaatgggttaaatactgttcatgtcatgatttatggaatgctttcctgtcccaaatacttgtgcttggtgctaggcatacaattatatgaaatgtttattatggtgaagaaattcaagattttccttcaccttacctcatctgttcaaatgaaaatgggatctttgtgtttggggggctgttttgcacttgtatatataaacaagtgaggaagctggatatttaggaataaaatctctttttgaatttagaatttgtaagctttcctcttttttttttttttttttttgagatggagtcttgctctgttgcccaggctggagtgcagtggcacaatctcagctcactgcaagctctgcctcccaggttcacgccattctcctgcctcagcctcccgagtatctgggactacaggcgcccaccaccacacctggctaaattttgtacttttagtagagacagggtttcaccgtgttagccaggatggtctcgatctcctgacctcgtgatctgcccgccttggcctcccaaagtgtaaactttcctcttaacggtcaaatcttactgaagaaatctgttaatggaaactttgataaatacaatgaacagatttggttcttcctcatccacataggttggaagcaacaagtattttgattgttgactcatacttctccagtgaagtgacaatgtgttgatggattaaacacagttatttttaagctgctttgacattctctaggcaaagtattatcaggaacagagccctgagatttgagagttgcagatgctttcatgattcttcactgtctgtctctccttacataagtgtttccagaaagctaataaaattattcctgaaggttaaaaacaaggaagttatgaaccggatttgaggttgaaattaggtagggggaacatgaattattttctgtaacgtacaagtggaaacaatttaatcaatcctttttatttttattgaatgtagacagaaaattcagtgcaggtggctgcattgcatttcatttacaataattaaaaaatgtttgagtaaaacagctctgttttggtggacagagatccaggacacccactttcacttacaggtgatccgctctttcactgatcccagcatctgctgcttctgtgtcacaccgctgggggaatgggagatccagagctgatgaaggcatggtcctggctctgctttgtccagctagtgacaatgttagtaacccgcattattgagcacttaataaacaataattctcacagcccgataaagtagttttttatggcatcctcatttttagatgaggaaatagaaatgcagagatgtgatagcttgcccaagatcagtctgtaagaggtataattagagtttgaagccaggtagtcagagtttttttttttctggatattttgcaaagaaagtttgagacttaaggaaagagcaaagatgctcttgtgtttaagcagatccattgagcactttttgggtcatggtctctgtacccataaaactctgaaaagtacaggggttgcaaatcatatgcgtgcgtaagccaagcaggtagaatagaggcatgaagttggccagatggtctgtggtgagcaggggagctctccgtggggccacctccctgcagctgtagccagtgagaaagtgagcccagtatggctgatctctagaagggaagctaatgaaaggtttaacaaaacatctctgggtcataaaaattgatctttacatcacatcaggtttgtgaatatacaacgtgaaacgtttagatatgtacttgatacggctttggggaatttattgagaatgtgggaaaacatttgttctctaaaagaaagttgcagatcatactgcaaagtgacagctgagcaaaggctcccccttgagaagggcatgtgctactcagctcatggcatctgggctctcattgataatggggggtaggttggaagattcttggaagccacagcaagacacaccacacctgggctctcataatcattttgccaccctagagagctccagacacacgattggccctctaacagaggaacattttaatacaagtgtgtactgctcaaggactcatttgctaagttaggggcagactccttggtaccaccaaatcctatttttcctaaatcggtcaatgtattgtcatatcccctgtgtgcagttttaactctgtgagtctggatttgaatggaggcccagctttattctagctgtgcaactgtgggcaagttccatcttctccaaagttagcttcctcagggtattgcaagaattaaatagcaaaatgcacataagtgtctggcgtagagtaagtgatagcttcctttcttttcctcattttaatcaattacccagttggtggatgtgataacaaatgaacttcctgaagatcagagctgtgtgttagtgtagggctcagatcctctttatgtattcagtgaacactatgttctgtctaacaggcacctgctctaggttattagggccattaaaggcatgttatattctcaaagagtatacaatttagtaagagacacagaaaaaactgatgttcgattgttaggttggtttaagttgttgatacatacttggaatgactaagatcattgtttaacattggtgagtgcacactgcaatgggaactttgtaatgctggagaaaccctcaactgttaaacatatacttaaaaaaatcagggtgtaaggatccctggctgaatagtgttgaatttttttcattttcctttttttgacgaagaagtttaacacaaaattattaagcaaagccattcaagaagtacagcaagttttctaaagtttttttttttaataaaagcgaatatcttctcctataaactagcttgctgacccagaaattgaactgtgattaaaaaatagggcagtgccccctcaaaatgagagttgtcttatgttatgggacgcttttttggtgaatactttatatttagtaatctcgtttttaaggttgtaggctctgtatggtaaaattaatacagtgaaaaattacagtctgaatatagagaagatgtgagtgccaaagtgttaaataaaacccttatttcttcttagtgaaggttctttcaattgacaattaactggatttttctatatttctctgagagttattcattgtgacagattttgtttcatgacagatgtaaagaacttctttaatttttgatgttcatagagtagacgtcatacaataataaccttgcaaataggaagtatcgatcattggttttttttatttcataaagcctaacaattattttactatagggaaatatacaggttgaataactttatagttttcatgatcatgaagtaacttccaagttatttcatagggtaaacgtgggtacgtgatagacatataggacattttggtttctttttttttcatttttgcttttggttgaaattgttcgtggaagctaaaatgcattctaaggtgaaataaattttcacttatccttgcggcattacaatttaatagaaagagaagctcatttagaactttattggcttcagttccttctggctacagcataatcagagaccttgactttccatgtcatcgcattggtgtgtttgagatgtgtgtgacctgtatatgggatgtatctgagactctgtgactggtaactgaggctccctgttactgagttcatgatcttacattactgttttcatgagaagccagtggatccctgagacatggactaaagcttttaatgcctctcagaatatgtctggttaactttggtcactgcagtcttcttactctgggggccttgcccttgctacaccccgtcaggaggagattagaggtgatcattgccttgggctctgtcttcagtgccaacagaaggagacatcaggacttgctggccccaggtctgcccaactcctcttgtctttggtgcccattatgggaatcgtaatgacaacttgcctatctcaacactctttcccaccataaagtaatagaatgctttatggttctgtaagctctttttgtgtgcatcatcttctttcaccctgaaaatgactttgtgaagtcagtagctaataatattgggactagttgtgcatatggggaaattctcagagagaggaggtgcctgggggaaggttgcctagcagcagagctggcatagaaggcaagcccgtgacctgtctgtatgggggaaagtccggctcttcaagggtggcattgcctgtctgtcctctctctctagttctgtgcacagaaggaacaggaacaggaacagaaggcacagaggaacagggaggaaaagcccttccgggagtgtgcctgagtgtggcttgtggtgaatttgtggtagtagctctggtcagattttacaacttagaatatgttttgaatccatatatgtggtacactctttttgtgtgggactgacacaaccctcttaaccttaccacatctggaaacttgcttgaactgctgaatctcagaccctatctcagacctaagagtcataattgctcttaatcaaggttgtcaggtgattcttatgtacattaagtttgcaaaatgcagctctattgaaatacagaggaccagaaattgtataattgagaataaggtgaggagaggaaggggtgcatgtgtgtatgtgtgagagactgggaggatgcatttcacttgtgtatgtaattgtgggagtgtgttctcattttacttgaaaaagcagctcactgagctataattcacataccatgcagttcacctattgaaagtgtactgtttaaaccacttattggttttaagtgtgttcacagccttgtgcacccataaccgcaatcaattttggaacgtttttacacctggaaagaaaccccatacctataagcagtcactcaccatttttccacagtgcctaccttgcttccgagaagcccctgattatcactaatgtacttctgcctctgtcttttggatttgtctattctggtcatttcttgtatgactgaaataatacaatatatggtctttagtgtctgaatttttttcacagtttatccatcttgtagcgtgtatcaatgcttcattccttttttactgctgtcattttgttgtcaagtttattttgagcaagaatacagagattcacctttatcctaagctttgatgaccttaggctgtctaaatacggtcttttattgtacaataacattcaataagagtaatttcttagtgtgaccattgcttttctgatgccacgtactctagaatctgaaaagtgacagtgagatagtagaagtattgttaaatgcattcaattaaagaagcaaaacattagtattttccatttgtaaagttttggttgttaattttcaaccactttctctgtaaaaagcagtggtatgccatccatgctctgctgaaaactatgcgtgcctttataaaatatggagctgatgttgctgaaaattaaaatgacaaaatattgtgtttagataaataacaacaatggcagtatttttggcaagaaatcacatattgtccctcccccaagcagtctgttccctgcaattctgaatgtttggtaattctaagcaccctagaggaaggtaacattcttcccttggtgtcagtgctaagctctgagattgttatttgtcaaataaagcacaaatgtgttttcctctagttacgtgaagaccttgtgtggaatgccttactgtttggagaaaatcttggtttggctcttgggctctctggtgatcattttataatgctcatcatgggaggtgacgggaagaatggccagcaagatgctctagcctgcagaaaagtcactttagcatttccctgctttgactatggcacacggacatttggaaattcttattctggttttggcaacacaaaaagctttcctttttccccttccctcctggctgactaagctcatcttaatgccactaaattaccaatgccttatttggcaagctgcctggtaaatcaaatgaatgacgacaatactggagatcttgtgtggtcactttctaaagggttttgtgcctcctttatactcttgtctccttctccttctttggcgggtccactcagttatttggctctgtttgggaaggctctgggaaaaatgccatttatctatcttttcaacttgaggggacatgctttcttcacagatttctttgggatggaaagttctttctttaacctgattactgtttctaggtgctgtaaattgctgatcattctcagtaaatcaccagcattctgttctttctcagtcttgacaaagttgccattgtgcatatgtgtatttgtgtgtgtgtgacagggaacatgcatggtttctgaaaaaaaaaaaaaaaaaaaaaaaaaaaatccttgccccttttagatttggaaattagcatagctaggctagccagatccctcttttggaggaaatgggaaagattggattgagcccttgtgtcaaggaaattgacttggctggatttcagggatccctgtggactggcccactaaagatctgtgtcagtatctttagtggcactggaattgggacagcgtagctattttctgtcatagggcaaactcagggggaaaagggcaggcacccaacattctatgagaacttccatgtgtcagagagtgttatgtaaatgctatgtatattcttgtgtagtatgacaaccttgtgagctgtatattactactgttgttattattaccatcactgcttcacgaatggagaaactgaggcccagggagatcgtatttcctaaagttctacagctgagaggtgggttgcggaggctgctgtccttttctaccaagtgaagtttgtctttgctctttctctgccatattctttaaaggggcagatgttacaaggttgatgcggctgatggaaacactagcataggacaaaaatacaaaatcccttcacagactcaagtttccccacacccaaaaggctccgcgacagcatttccaggtataggggcaagcttctgtagcctccagcaaccacagaggtgcccagatgccaatgacaccctgactagagtgagcatgtcctctctgctctcagagtcctctgtcattggacccctcccaactgctgtggacacttgggctgtgtgctgcctactcccaggtgttaagttactggtaggacccacggctgtgtgtttattgcacaatttggtgaatcaaaggctgacttcctggtgagcaccccctagcagggtgagatatggacctttctggagtctgttttacaagaagtgtttactgggatattttaggaattctcagataaatccatatgatagcctacctgtatttcctatgaataaattgggtatttaagatgtatattcttttcatttgtcatttttccttgattttaaaatttcccttcattggctgggtgcggtggctcatgcctataatcccagcactttgagaggccgaggtgggcggatcacgaggccgggagattgagactatcctggctaacacagtgaaaccccgtctctactaaaaatacaaaaattagccaggcgtggcagcgggcgcctgtaatcccagctactcgggaagctgaggcaggagaagttcttgaacccaggaggcagaggttgcagtgagccgagattgcgccactgcactccagcccgggtgaccgacagagcgagactccgtctcaaaaaaaaaaaaaaaaaaaaaaaaattcccctcgttaatatgtgtttattgttaaaaacttaggacgaaagttaaaaaaaaaaacccacactacttaattacagagatcttcattaacataattctgtatttattttctataggaaaatttttaatgctaactttctagaactcagtcaaaaactactgtaatcattttaatcagctgattaatttgctctagcagcttaaaatgtttttgctccattttactttttctactgcatgatagaaaaattgttgttctgtgaatgagaaagttaaaatttgtgctcaatggcaggaccccagagagatgtttctgggaattgagattcagaggcagcctgcattcagctttcttcaggttacctttattaatgatgcccttgatcagtaaggtggattacttacccattaacacttattctacatcagccttaatgttttagggaaaatatatttactaagctgtttgtgtacaggagtatcacacagtagatgaagcacttatgtttctggaaaaaaagagataaattaggaagctttcagatttgtttataaaagaaatatgaggctaggaaagaagcatgatgacttttgtgatacacacagtgagtcagcaacccattttccagaagttagcagctgcatttttttccattgagggcaaaacataatatatgggtataactttagtgctagctaattacttctattggtgcttaaaaaaattaaaatcaacaaggagaaatctacccaaactgatccaatatacactgagctaatgaaggaaggtggtgtactttttgtggggtggtatttttattttgattatgttgaagtggtagagaaagaaggggagagatctgggggtctgagagtcagaggaggctacaaatgatatagcaaagcaaataactagattatgaatcttttgaaatcatgcaggggaacaaaatattgttactgccttatcaaaaagtattttctcctgtataatttaaaaaatcaagaaggtgtcaaccttaaaaatcgtatcattgaatatagtaagtccctttttttttgttaatatagcctgttggtttagtagatttttgcatcttattgtctgatttttataccatacagactaataaaaattagtttatgcacttatttgttacttttatttctgaatagataatacagtcagcgtagtataaaaggttagacagtgatgtctgaattctactccttcccctagctagtttccttcccagaggcaaccattgttactgttaccatgttttcctaaagacagttcctgcaaatgttggcaaatctgtgtgtgttctctttccttgtctctgtgccttcctttcttttaggaatgctagcatacatactataatattctgggtctgtctggttgtttttacttcatgtgctctgtagattatttcagtacaccaagagcttccccattgtttcatagttgggtagtattctgttgtattattatgccatgatgtatttaaggaatatgctattggtggacatttaaaatgtttccagtttgctcctttgaacaatgctgcagtatataaagttgtacatatatgtaggtttgttaagaaataagtggaaacccatagctgaaagatggttttaggattgtccctgggaattagatctctatcattgtttcccagtgctccttggaaccctcctcagggaaataggcatcattggagtagaaggcaaatgggatttcatggccaaataaatttggaaaatgcagtgtccttgattattccttggagcttcctaaaataactagcatgttaaaggcttaacgtgctcatgtggttttaagaacaacaaaaaaactgccaaagataaattttcaggctcacttgagtatcacatatttgaagatgcctgttaacatctttcgagacagtttctgggaaaaaatagtttgggaaatgttgacctatgtgattactacctgtctcaccaattccatagatactggaaactagctaactgagttttcagctgacaaattgcttgcttttggagtcaagtgtcttgacatatgtagcttgttcacctctctggtcctattgcttaaagtgagaaatagcgtatttggaaggttgtatgtcaggaccatcttctgtttgtgagcgcgagagaaggtaggatcagatatcttgggtggagcccagtctccagctcaagacttgagttgtaaaaatcgtgttgtattgtgggacaaaaatcaagcagttcattttggctagggtttaggggatagaaatgggtggaggagagtcataaggctttctaaaataagctgcactacagcagaagttgcagttgggagttctgttgtagaaaatggagaggaaagcaatagatttttttccctccagtttgcattggttctcaaccggggatgattttgctttcctgctaaaggggatgtttggcaatgtctggagacatttttggttaccacgactggaaaggtgctaccagcatctggtaagtagagctcaaggatgctgctaaacatcctgcaatgcacaggacaaaaaaatacctcagtaaagaattatctagtccaaaatgtcagtagtacctccattgatatacccttctctaatgggattctaccagggttggagagttaggaaattgttactttcttcatacatggagaggagcataagtgagccatgtgccattctggactgaggtgccaccatggtgccagcatttgataatagtaaactcatgaccccttattcatagtttggaaatttaaaaaacgctggaaaatgtgacgtttcttcataattcagttagcagtaaaaccttgcctgtgttgatgtaaaggtatttatagtctttatttacctggttttgtgtgaatgttaatgcgcttgactgtagggtgctggcctagacctggcttggggctttatttagtaaatatgctgtatcactcttctaaagtttgtaacattctatacttggaaacactttggtccccaaaggtttcagagaagagattgtgaacttatatattgaactaaatttttgccaaatttggcttattttgtgtgtgtgtgtgtgtgtgtgtggtttaaggagttgaaagtttaatagaagaaaggagagaggagagcatctccttgcaagagagagagagaaagagagaaacgtctgaaaaagtccaaagttggcttatttttaaaaattcagcgcttttagtaacgtttattgatttttttaaattccaaaaatgacataagatcattttgaaaagtttaagtacaaaaaagtagtaatattatcaaccaactgtatggtacttaactgtgcgctagatacaattctcagcactttatgtgcagtaactaatttaatcttacgaatcccattatacctactttacaagtgcagaagccgtggcatagtaacttgctcaagatcccctagttgatggcagagctgggctttgaactctggcacagagaaggaagtgattcatcatctccacagctggagtgggctgctgtgtgtacatggatgtatttccttatagccttctttcagccttccctactcaactatatttgagaatttcccctgttgtcttaaatattttcaaaaaacctgattgttgaatggctgactacctatttaaaagaataggtgaggtggggcatggtggctcacgcctgtaatcccagcactttgggaggctgagccaggcagattacctgaggtcaggagttcaagaccagcctgaccaatatgatgacaccccgtctctactaaaaatacaaaaattagctgggcttggtggcatgcacctgtaatcccagctactcgggaggctgaggcaggagattcgtttgaacccgggaggcagaggttgcagtgagccaagagtcaccattgcgctctagcctgggcaacaagagtgaaactccatctcaaaaaaaaaataaaataaaataagtgagtgaaccataaattatttaaacattcttttgttgttgggcatttaggctctgtccattttttcacaatagaaaattgacatggacacatttatgtataaatacttatccatatctgattatttctttagagaatgttttaatggggctttttaatagactcttcatatatactgtgaaatgtaccagtttattctctcattagaattcattgtcatcagcctggagtgttaaatgcttttccctttgatttctgattctgtgatgtagtatcttgaagttttctgagaaaatcagacagatgattggaaatttagtatgattttttttaaattggtcaggaaacaagtagttggaataactgattttataaaattttatatttcaaaaaattcaattttagagccattttattttcagattaacccatgaagttaaatcaaggctccatttcacattgttatgaagagctggtagaaataaggatagtgcagcattaagagatactctgacctgaatcttactggtatgtgatcagtatatgcctaaaacaaccattcagtaaacatttatggaggatctgctacgcaccatacactgcattttgcactgggtatccagtgaggaacaagtgtataaaaggaaaaatagcaaatacttacacagtgctttttaggtgtcagacactgttttaacagcttacgcatgttacttaatttattactcccaacaaccctatgaggtagatactattattgtatccatttaactgatgagactgaagcacagagaagatgagtaatgggctcgcagacatgcaactactaaccaaggcaaaccactgactgtgctagtttggaagggcagacagaagagggttggtgcagtactctgggcatgagaaactggtggcttttgccaccagcaaattggtcaagcagtccagcaatgggattggagagaaatggaggcatcagaaagatttttcaagatagaatttatcagacatggtgattgaatgtggagggagagggagaagtcaagggtaaagcctaggtatcttggtatgagtgacctgctagatgatggagcccttcagtgagtccaggaacagtaggaaagaatgaggagcatgttttagattggtgatgtcagaggggtctgaaagggggaggtaagcagaggggcattatcttcaaaatatttggagtcagtagctttgaagctcaccaaatataccctggtagtttagttatcagaaaatgagtttttaaaaaatacttataatgtgtagttcatgagaaagttttccagcgtttaaagatgttgacagagtttcagttgattgctgtggttttcgtgtatgaaaaacatgtaaaatttgtgtcatattaatgcccttttgaagactaatttcaatgcctgtagacagctttctaatgtagttgtatcatgatttgggttatcaataatctgtgaatgtatagattgttgccattttccttcattgtagataattttacaatgaatgtctttatgcataaaacagttttgatatgcaggattatttctttggaggtatagctgaactacaatttccgaatcatacatatcacaaaattaacttctagaaagactgtgctaatttatgtccgcaactacgtgcaagacctgcctcttaatcagccattgggttgaattgtcctgatgatttttgtggcaccttcattcaattcctgctttttgtaacatatcccatgatcacaatcatatgatgactttgtatcctgtgtctttattttattggaatcaatgcctgattcatacagaatattgccaagaagttttacagatataatcagataagagaggagagatcaagatcatgttctttaactctgtttaaagtattgatgtcaggatgatacttcaagtttgaggtgaagtttttgtgccaaagcctggctcatggctgtgagggcacctaggactcactaaaagatgcgtgttcttcagtgtgcacattacctgccttcatgtggtaagtggtggagagttaaagccattacatggatcactcaggacaaaaacaaattttactgtaaaatttctggtgatttgggagcaaaactaggataactcttttgcacttgcagtatgccataagtgccgcagtttttgactttttctactttgcccaataaaaatgttgctctacaacccttaatttttataactgttctggcctcagttttccacagtgaatgttcctagtttgtgtaatgttctttaggttgctaatttctgcctccagagccaggagatctgtcttcttttgattattcccaaaggtaaattttgggaaaactagaatcaggctatttccctatttttcatttggaaatttctgcattcataaacagttgcttgtaaccttttaatgaatatgcattaggagttgttttgaaaatttattatttagggattatttattagcctggttacttgccagggtggtacattaaaaaaaagtttgtccacccatctgcttcatcccgtaatccccccaaacagtcatcaactaggagaatcgtaatatgcaaataagccatctgcagtgtctaaatgggaggatagcttccaatttttagtcagaaacctgccaggggcaggggaataatttcagtagcattcttccaagggggaggatctcttaagaggcagcatgattaaaaatgcttccatagtaaataaggacactagaattgggtgtccaggccacttgtgagcaaagaacctcctatttccagattcggcgccacctgtgggatactcatgtttcatcataggtgtccacaactttattcttttaatacctctacaaagaccaaaaaaaaagtgataccaattaaaaaatgtggaagaatattaattgggattgaacagtacctgtggttttctcatgtgaccctgggtttgtcttattctctgagaaagtgggctggtaggtaggtgctcttgatgtccttaatttcaaaatgaggaagtcagagcaggcacggtaagtaaagaataatggatcctgagcctcaccttttggtcactccgttggcagggtatgtgcttggggcatgaaaaccaagactcaaagactgccaatcctctgccgcagtttttgagagtaagaactatgcttgctgtaatatggcagaatgaaattatacctgctccttccttgcttcttccttcccttcctccctcccttttcctttcgtttcctttcgtttcctttcctttccgtttcctttcctttcctttcctttcctttcctttcctttcctttcctttcctttcctttcctttccttccccttccccttccccttccccttccccttccccttccccttcccctttcctatctttgcattcgttctgctttagttcactgtttggaagggtgaaataaagccctggttctgttctttccccttgtccttccatcggagtgggccctttagtggttaagggtgagggatgagaagttagtctctggtgtctaaggtccctacgatacgtctgaatgttgccaggtgtagaagatgtgtcctgtccataggaggagcttgtgggaagctagctggcgaggttcagaaagtagagttgtgggatatgtggccttaggtgttgtatacgtatgtagttcaaatggaattagattctatatagggtagtgtgtagactgagaacaaaatgacctatcaatcttagggaatgaattaagaagaaggttgcctgtgaaggacaagtcagagagaaatccagaagagattgatgttctgaaagttaagactggacaatgtttcatgaaaaatgtaatcggagaatgaaggttcaatatgttttttgtttgcattttctttttgcttggaaatcatttcaaatttacagaaaaaaattacaaagaatacctgtccatttatttatctaattcaccttttcttatatttaaccctatttataatttcctacacacacacacacacacacacacacacacacaccacccaccatatatttttctgaaccattttgaggatatgttactatatcatggtcctttacttctaattacctaagtatttatttcctaagaattgggatattctcttatactataaccgcagcactattatcaacttgagtaaatttaacattgatacaatttaaaaaatcagatctaatatttatattccaattaacaagttaacccaattacattttgaataatatttttctgtctcatacaggttctagtctggggtcaaatacttcattttatttcattcgttcgtttcttttaatctgaaacatttgcacagccttggtttatctcgtttttaagactgcatcctgcccgttaaaaatgcagtggctgtcagtttgaggttgttgctgcctcatgattagattcagggtgatgcaatctcagttggaatattgcatagtgatgtgtccttgccaggatgtccaacctgcaggcaccttatgcccatcggtggcgatgatttttaacatcctttcacagtgttgtctagtttcctgattatataattattgttttctctttcttcccttgcaataagtggtctgtggggagctactgtaaggtcatatagatatcctccttctcctcaaagtcagtgcaagatttagcatccattgatgattattactgggtccagtcttcacagtgataggtgcgcaaacatgattttccatctccatgctctttccatgtttaccatttagcctttgacattctgctctaagcaagagtctcatatcatttctatttatttattttttgtgtgcactcaagagttcccattttccgttggttcataatttaccactgtactcaatttgagccctcaatcaaatttgagttggctagtgggggccccttcaagatggctcctgtgtccatgtggcatgttcccatcacttacttttgacaaatttttcagtttctggcataacaatgtgatcaggctcatcttgtatatactctagccctggagccatctgttcctttgaggatcccagattccttttagtggagaaagggtataggcagtatggtctgtgttttccatttgcttctgtgctgtgtgaagtgttaggcccaggctttgggaactatccatttcttggtagatgttgggtcaagtggaaatgttggggtactgaggaagaacaattttgatttgcaattggtaaatgaggaatatctgttcagagtgtgagtgagatgaaaattgttcttctgtttaatttgtttgtaaaccttggctagagttggcctgacagattgtgtccctttccctctggccatactttttttgggagggggctggcctgcattttaatgaacatgcacattttggcactctctcatgcttgcatttttagttgtgttctcgtctcaccatgctctgtaggtgcccctttaacattggttcatcctgtgtgaatgggcagggggaggtggtgagtggatggtattctggttcccttggtgggagcagcctgcagaggccagatagtccacatctgttgttgattgaatcctggtccagaagccccactttatattgctgtgtggaatgagcagaattactactgtggcaacacacagttcgttttttacagtccacctcctttcattgcctcctaacttgcaagtcacctgataatttctgacactttcttaccagtatggagctatttaaaacgcattcctacttttctcatctcatgggatcctctggacaataccttgtgtgataatcaggcagagatcaattctattttacagacagggaaacaaggcaaagagagtacatttccaatggggaaagttagtctcttttccttagtagcaaagagctagtaagtggcagaaccagaacttcaacttggcacttctgcctctttgtgctttcttcttgtcttagttaaaaactgaagaagaaaagtaagccctgtggaagcagcttaggtacaggaattggcagggtaggaggtggggtagatttcttccttcttaatcagtttcctgtctgaagcttcacatactgggggtatcgtttttcagtgtgaaagggaggctgaggtcactttgtgtcttcatgggaaacctgtcccaggaggtatgtcttaaaccccatgcttacctcaaggcaattagagaaaaccatgtgacagcatcggtctcactgactgtggttgatgaagcagagcagaaaagctgttttcttctccttgtcctttacttcagtcttccccatctcatcttccctacctgagctgatggactgtcttgtgaggctggggaggtgtccacttggctctttggttttggttcccagagggaggctctggccgcaggacacagcagatggagcctgtgggagcccatgtttgtgcctcggcaggtgtgggtctgggacgggtctgacctccacctggcacctgcttcttttattgcctccatatgtcaaggggatatgagcccatgtgagtgctttcagattgctctggcctgaggccatggttgggaatggcaggagcatgttgcgggggacagggacctttgtgagggacagttgagccactctgaggttagaggaccacacagctgccccttctagaagcctcgctgggccagaggtgtggcttcattaaggtcctagttggactgtgtcctcatctctctcttatttcctgctctgtttttgattttattttcttaaaatcttcatgctcatggatttttaaaatggcagtaatgatttttatttttttaaagagtaaaacaatggcagtctagtgcagttactttaagacatatcaggtaacctttaccagtaaatcgaaggccattgaataaggaatgtgtaaggatctgtggactccctgaaattagatgcaaaatgttatatgtttgtatgaatgcattttttggaggaatggctcccatagctttctgcagattcttgtggacatttgacagtccctctccaaagtatggcctccaatatgtcttcttcacattcctttggagaactgcctttacctcccgtgtctctcatagatatctgagcactttaatttgtggaagagtcgaggaagaggaggccttgaaaatagtctcctttctaactaccaaatttgggggctggctcagcttcccctcccccattactggttccctgagcaggtctgagccaggataatcttctttaacctccactttctgtcaggccctggtcgtgtgctggatgtacctctcctcatgtaattgtcacaactaccctgtattggaggtgccaaagactgaataacatgtttaacttactaaatagaagaattgggactgccggtaaaaactgccagattccaaagccagagttttttcaatacactcaaggaataaaacgtcagctgctgtttttattagcactcaccaatgagacaccatcctgtcctgttccctgttttcatcctgcagcgccatatattgctccaaagcttagatagtgcccagagcccacctacagctcatcttcctatgaggcagagagctagcttgatctttggggaataatggcagagctctcagaaggtgctggatccctaaccgctttgctgggttcttcattcctggcccacccgagagctcttctggaagtaaaggcctgaaactgtgaccttcttggctatggtgaaaagtaacagacgtcaagtgttagcaagcagaccctatctgttatttgacttttaaaatcacaaacaataaagtaatcattattacaaggtatttttaatgtcacattggcatgaaaaattttaattctgagagtataatttctatgaattgctatgaatatagtaaattaaaaaataaattgctgtggcggtgctctgatggcatttcaaaaaggtgtttgtcatcctaccctgccccttcatccctctgtgataactgtgtagacaaaggataaaacccaggtgaacctcctgagatagaggttccagatggcactagctgaaaagacagctggcatccagagaggccgtgtggctctttgtacacaaaccatggggattgtttatttttactgctctagtgactcaatataacagtggtctgggaagacttggctttagcctcctctctgttgtgttttaacctcttcatgtctcgggcttcttacttttctcctggtgttgttgagtgtagagtggttgtgatgatgagttcacagagatttaagagctctaagttcttttgggtcagaggagtgatttctcttttttgcagtgtaaggtacaaaatattaaatatctgagacgtgactgtgagaccctggtgaagctacccggagtctcagtttcttctttaaaacacgattatatcattcaaaataatagactgtatcttaaatgagccagaatggatcagacgtttagcattgttactggcacgtgggcattcatgaagtatctaactcttctctgtaccccctcacttctgtatacatgccttctatctaaatacaatcttttgattggctggaagtagagtaggaacattaatctatttctcaaatgcagtgccaagcttaaaaatgcatctctagttctggggatgcccagataactatatcttgggtgtgtgtgtgtgtgtgtgtgtgtgtgtgtgtgtgtgtgtgtgtatgtgcatgcacatttatctatttgtgtaagtatgcataactgggtctaccagatgaaatgtggcttgccttgctgacttcagacattttgatttaaagatcttaaggtaagagaagtagagttaacagcatacatttagagctagatgccttagcagctggcttggaggcttttttttcttctttttaatgggtagctttttatttattcattttttttaaatgggtagctttaatttcaaccaaaaagttctgggtagatttttttctagctcaagggagaattgtatattgggcactaagtattaacgggtaaaatcctgccaactgcccttttatagatcttcagtgtgaagcaagactttgcataggttgccagccaaaaattgatattggatccaattccatcagagaagctttagtatttttagaagtaacactcactctagcacagcatgcggtgatacataataccaactgtttataaagatccatgttttagttaatttctagaaaattaaattacctttttttttttttgctgatgccttctgtctgtcaaacagaaggaaattgcattagagttcaagatgtggcctttgaagaggacttagatgaattgggatgttgacctttatagtaggaggattgcgtggagtttggttggctgggaggcaggagacctgggttctagccccagttctgccttccatgaagtgtgtgatctggattagtcacaaggcctttgtggccctcatattgtgtagtcattaaacaaaggggttgtatgaaattcccattgtgttttaattttgataagttattataatttcatgatagaaatgaaatatagtgtgcaagtatttttcctaaaattgtgagatcacgtctgtgagatccatgcagcttgggtggatccaccagtcttttttataatgaagtctctgaaatacttattgaatgaatgaatggtgctattaaggtgatggaaataattttccattcacaaattgctaacatactgcctttcatttcataacattcttccaaaaaacaatattcttgtgactattattgagtataaactggatacttctggatacagctctggttgtacataagtgttttcctaactaaaggattgtttggggaaaatgagatttaaagaaccaagatactgatttttggttatttagcactatatccttgccatttttcatggattcccttgtcttatattcagagaacattttcagattgccttaagcctgtttgtttcctgtttatccaggtttcacttttcattgatgggctactacaaggcctaacttttgcatatacctgtgtccaggtgtctcagtccaggaagttctgtagtcctgtttatgccatgtatttggactttcaaatattcagcaactatttttttctgtatatattttggggtctcttacaccactgtttaaaatgtggttcccaggccacctgtaatggaatcacatggagatgcttgaaaaagtggcacgtttctggttaatgtgccgttcttactggagcagaatatcttggggacagacataaaaagcctcatgttttgcaagtgactctcaaatttaagctggcctcagaatcactgcttttggaaatcagggttatagctttgttcatgttcttagaatctaacatataattagaattcaatgaatatttttgagcaataagtgagcacatgagttgctgggtttgtggtagttagaaagctatacaatacctttaccagtctttttgtaatgaaagctctgaaatatttattgaatgaatgaatggtgctaataataaggtgatgaaaataatttttcattcacaaattgctaacatactgcctttcgtttcataacagtcttccaaaaaacagtattcttgtgactgttactgagtataaactggatacttctggatacggctctggttgtacataagtgtttttcaccttgtgttacacacaaacacacaccctactccgtttgttggaagcctgcaagtgatcatgcgtatcaatgctaggagtgacgtcaagtagactggctgggaagggcagaatgtggtaggcggttaaaaagcaaaaggcacatgctatatgactttttgccttttcttgttgtctttaagacttttgtgatggttacataacaccagtgggaccagagactagggcaggccaaagatgcactgattaaggaaattactgctacctaacagttattctggagctcaagtatttcctgttcattatgcaataatgtagcctttcgagtctccaaatgccatttggaagaagagggtgggggagttggaggtagtaggttggatctgaggcttagtctcttgcctgctgttttatgggcaaggtggggcaggacctataaaaattccttcacccatggcccttttctcctacaatgactgtagaaaattagaaccctttaactgtttaggaatgtgagtgttcagcataaggatccaattaggatgatggggaggagagataagtagcaatagatttaatatgtgatgtttgatagcattaaaaatgtcccaagcctatgcatgcagtgattgcttgatactgtagttttaatttgagttatagcatagagatggtgatgctatagaggaaaaaacccgcaattatttttgcaccaacctaatattaagttttatatttcacatttgtgggcttgtttcatcaacggagcagtttccaaggcttcaaggaaacattgttctatgttttctctcatccatccccctgtggagggatgttgagaggagagtcggttttgaaggtgcagttcttgctttcatagcatgtagttaaaataaaaaccacagtgtagtgttctgacatcccctcttgctcaggcatagggcatatttggtgaaccttggccattctgacaactgttctggcagctgtttcttgtgtcattcttttctgggctttattgtaatgtaaacccaccaaacaagatttctggcagttctgtacatggaaaatataaggactcaatttgtaggtaagtggtttctatcctggagaaaacaaagcccatcatactggatgttcacatcagctgggctgtatgacaatgttggtgagtcagtgctttgaaggccctaaggttaaatgttttgaataccacccccatgcatagtattttgggttcagtggggctttaaaacatcctttattctccccacatcccatcatcttctgcaaacttaacaatttactatactttttctgaaaatgagccttttaatctcccaatccatagttggacgaggctcactttgaaaagtaaagaggttggcttattgataacttcaggcctgctccttgcttacatgctgatgtttactttttgaaatcgacctaaaaaatgtcaatactttgttatggttttgaaatgtatctgataattcctttctgggcatgttaaaagtcttaattttcttggcaacagaattttccttttagggttcagtatctgcttttcagggttatttctggaaagattttaagatagcttaagggctttcttaaccacataaaacataatttcctcaatacattttgggggaaaaatcaataattagtgttagtgtaacactaattagtgaatgccatttgctttaatgctgggttaaaattgtccttgaatttaaaaattagttaaatcttagtaccaaaaaaataaagtgaaatactacaaagaagttggtcttttgtcatacaacaacctatccatggcagtagagaaaaataattaaaaaatgcacaatctctaacacaactatttttagttttgcattttctttccatcttggccgacatagctacaaagcacaattattggaactacagtaattattttgatttttgatttttattatgtatctaatcactgttttcattttcccatatactatacaaatgtcactgtcaaagctacatattgggctgtccgggtgatttactgtgagcatgcccatattcttagaatttagattccatccagttatttgaaattgtagatgatgttatagggaacatatttttgcctatgtttttcttttaatgattacatcctttaattaaatttggactttaaatttggaatttctgggtcacagttgtttttatggccctgaaataacattctgttttatacttgtagaaatagtttttgttcttgtaaccaaccagagcacaagtgacaggcaagcttttagctttagggatgttcttaacacatcccgaagattttgtgctctcaatgtgtccctgctatttggagcttccctgaaaaagattctgtcaggagcttctgctaattaaattgaattggtccagctttgttgtaaacaggtaacggattgtggtgttttattacttgatacttattgctgaaacaagttttatgaaaaaaggagagtattagcctgaggacaaaagtagtttggagttctgtagaggagctgccagtattaatgaactatcacttggagcctgcaacctgtcagccttgacttttcctctcctgggtcagccatcattggtcctccacattgcttttcactttgccagctaaggcttttcagtggcttctgatataggtcttgtttctcaagtgagtgtgccctcaggaggggaactgggcaatctgggaagggagctttgatttcacaaccatgtgggaatgccagtagaatgagacgccatgatgagtgtgggtacctgcccttcttggcaggagtggactagaaatcagttggtgttactgcaagcccagtccattgatgtgcacatccattgtgggaggatactactctcaatggctgcactgctgccagtgacgttaaaaagtcatccatgtaaaagcatgggtaactgcttaacatgtattaaatgaaaaagcaaaatacgaaatgatctaggtactgcacaagtgtcctaaatgttttgcatatcgtcaaaataatattaatataagaaagtgtaaatagctgtaataagttatggtgagattaaaagccatttctttttcttttttgcaccaacgtgttctttagtgttttagcacatttgtagtagagttttgaagttatttttataaatcagatatgtaggattctaggtctgtgaaatgaaattgaatgaagaggatttgacagtcttcttaaacttctgggaaataaaggctgaaaacagcaggctttcatctgtgtatcttctgaagctgaaatgaacactatgcccattttgctgtatgtccatttgagtattttctaatacctttttggggagtaggtgtatcttcagctgaaagaatatttctaagtatccaagtccttaaggaagctaaaagttttgagttatgcaagtgtgccttcagtgtcctttggcaacccctttctgcactttctccactgctgtggtatgtttcttgaatgaccatgtccctcttcctgctcatgaaagccttgagcttagttgtgtataccttgcataaagcaatagagtgcagaagtaaagaatgctggttctggactcagactcttgatgtggagtcctggctggttttggaactttgggctcttgaagggagtatcctcatctgtacggtggagaccactggtaccctcaggtggctgtggaggttgcatcggttaacactagtgaagttctgagtgcaatgcttggtccatactaacccagaactgcagtggtgatgatacatatgatacatcttcttgggtagttacatattttcttcttgttaccagggtattccttttaactatgagaaatcagaaaaatacagaaaatcacaaagaagagactagaaataacccaaactccacaacaggttttgctttttgtcttctctgatgatgaagtaaaatatgttggccatttggagaagtaaagatgtttgtaagtggggtgtttccagaccctctgaaatatatgcctcttttcttgctatgcctagtataatacctcactcattgtcaaccactagagacttagcttcttgttcttggttctactactaaattttttgacttgggcaaatcatttaaatatttctaggtgttctttaaggcttaaaaaccaaggttagtttagctttgtcattctttcttctcttaacctgtgacttggtttatttatggtttgttcatttcctttatatgtcttcagtgaaagcagcacagaaaatgactttggccatgtcagtcagccaacagcttttgagcagacactcttctggccctgggaattacagaaccacacaatacacacatgatctgtggcttttggagcctgtggcagggccctggatggggaagggtaagcattctgatgctatagtgtgatggaaacttctgtggggaagcgtaggattcagtgccagtacttgtgatgcaagtagttatttgagcattccttttgtttgtttttaattttaaagttcaaggatacgtgggcaagatgtgcaggtttgttatgtaggtaaatgtgtgtcatgggagtttgttgtacagatgatttcatcacccaggtattaagcctagtacccattagttatttttcctggatcttctccctgcccacacctaccaccctcctataggccccagtgcatgtcattccctctgtgtgtccatgtgttttcatcatttagcacccacttacaagtaagaacatatagtatatggttttctgttcctgcattagtttgctaaggataatggtctctagcttcatccatgtccctgcaaaggacatggtctcattttttatggctgcatagtattccatgttgtatatgtaccacattttctttatccagtctatcattgatgggcatttagattgattccatgcaagttcttagagaccttcaaagaatatttgagcatttctaactggaaggaagtgaaaaagaaaggtgtggtgagttgagcacgtggctgactcattgaggagtcctgggtttgaactgctttatctgtaagagctcaatttaattcagagttaagtgcctaaaaggtatccagcacatgcctcctggggttcgggatgcactgttcttgacctcacagagcatttatttaagctgaaagtcatgtgcctgctgtgagattgggtgctctgagtgtacacaacagaggaaatctggctggtctatgttatttccttggaatgtctcttggagtcagctgtgatgcccccaggggttcaggcacaagggagaaaaatgagtggacatcctaaggctctctgaggatttcctggttgcttccaactcaagttgagtattacaggaaggtttggaaggataaaagccacaaaaatggcagtttctattttctctcacctccatttatcagcctggtcacagcagcaagtaaccaagaggtcctaaatgcagtgtccaaactgtatgtgggcccaagacctgccaaggtattcaagtacagccacactgaagctttgctttctaggcacaaagtttgattatcttatatctgcttgccatgctttttaatataactggagttagatgttggggtttctcagtctgtggacaaatatgcaggtgcttatgtatggaatattaatgatggagtttaaaaagagttacttaagaagaagtatctagcatgggataaccgtggattgaaaagcaccaagtgcatcttatgaatgcatttctaggccctagcacagaacttgccactgtgggcagcatgggaatgttaggtaaaggtaatggatgaatggtctgtgttctaataacctgcctgacctgtctggaatttccaacatttatcccacacccaaaactcccatctttccaaacaatattatattgcccttcctgctaaactgtttgtgtacggaaaccttatgatatataacagcatggcataacctgatccatctttgcattctccacgttgatcatagctttacaaaatgacctttttcactactggagtcatgtcacagtacaacttccagcagtgttgctgttttgataatgataagggaaattaggtatcattttcttttgactcaggaagattattttcccattgtgcaagtttactagccatagagttaataaccctcatcacccttatatgaactggaatttttatattattcttggaaatgattttaagtggatatttaattcaaatcttgttactcttgtgtccactgaacgtactacttacctagtccttggtttagtctttaatgcccaaaccaaaattaaggccagttctctacttattgttataacaattgcctgccctgtgtttcctgggtggttttctttattgtttaaaattcattacagtgatcctagtgtgttggatactagcataaaaagaagtcccttcatgtgtgatgtgttgttattgctaaattttcttacaatttgcttgtagtaggttacttgctctaacctgccagttgcctggaagggaaaggaatatcaaaggtgaacctagtgcatgaagtatttatgactcagatggtctcttctggtctgagaagaactgaagttgttgagtggagtttgcagtaaatggtggtatcttggtttgatagctttgggacaggagcacaaacatttaatggtgaattcacggtatgatgtatttcagcccaaagttaagaccaaagcacaactttagccatatatatcttattaatgaagcttattaagtgagtaaaggaatgaaaatggaaatggttggaatatgaccatcagattcaggcccaacgagagtattcttaaattcccagtcttacataagaggctgttttagaactctggggacattgaattcccataaacgtctggttatagctcccttgtagcacttgtgctgtttattattgcttttatgtctgtgttctttacttagtcgggaactcctatagctaggaactgtgtcataacatctttgaatgaataaattcatataaaagacagaattccaccctggccttcctcaggacaaggaaatagtggcaacaacattatctttggacacacaagtgtggtttgaatcctgtttcttttgtttactagccatgtgcctttaggcaaatgtcttgtcctttctgagccttagcctcctcaccagtaagagtgggataataacctcagaagttattaacatattcagaacaacctaagtgggtgctttatggagtcacagcacgtaatgaagtgcctagcataatgtcatgattactgataaactcagtcagacacttaatatctattcctccatccagcttaccttttgatcttaaaacactgatttcagccgggcgcggtggctcaagcctgtaatcccagcactttgggaggccgaggcgggcggatcacgaggtcaggagatcgagaccatcctggctaacacagtgaaaccccgtctctactaaaaatacagaaaaattagccgggcatggtggcaggcgcctgtagtcccagctattcgggaggctgaggcaggagaatggcatgaacccgggaggcggagcttgcagtgagccgagatcgcgccactgcactccagcctgggcgacagagcgagactccctctcaaaaaaaaaacaaaaaaacaaaaaaaccactgatttcatagcactgatgttttgcaagatatcctagaggggcccttaaaaatttatcatttctcattttcaagtcagtatcaaaaaagtcctatttcattagacattcatttatgtatctattatccagatatttattgggttcctgctgtattccaggccctctgctgagtgctagaggtatataaaccagcaaaacaggtaacgttttgggttgatctacctgtatcttacttacagtagagagagacaaaaaagtcaacaagtaaatgaaaacattgttgtgaaagtatcatgaggaaaaccaaatgatgaggtgaagactggttgggagtgatagaaaattattttggatagagtggtgagagaattcccctttgagaaatgatgtataagctgaggcttaaagaatgagacactgccaccagtactctcctctttgtgggcttgggggatgtgcagaacaaggacttcttgccttgtgggctaaggccataccaccagcctctactgtggttaccctgcccttggagctaatatcaacaggtaggtgggcctcccctcagctaagctgccaacctctcctcaacagagggtccttaccacccacccctccttgatgtcttataagctgatcccttcagactgggggagggggtggtggtgtgtgacttctctccatttccctggttctggaacttttaatggacatccgaattacaggggttttgtgagaattacattgttggatcccatatgtaaaaatggaggctaatctatcaattattaaccctggttgtactttaaaattctgattaagaaacgatttttggcaggagaggctattagccaagtgtaatgtatgtaacacttactttataaaggtatgttgaatgaatgtatgaattctaaattgtaagatttgaaatgaaaccattgccattttctctcatgacattagattatggaaagatttattttaaaagacatggaaggcatgaactgcaaaagaaaaaagtggtaaattttaatcaaaatttaaaacttttgttctttggaagatagatctgggggaacaaggcaagtcataaactgggagaaaatattgtaaagcaaaaatctaatgaaatgtgtgtgcttagaatatgtgaagaactcttacaccatacaaaacagacaacccaataaaaatatagacaaatggtttgtatagacctgtcttaaaagaagatgcataaatgatcaaaagtatgtgaaatttcaaggaaatgcatattaaagccacaatgcgatacaactgtatacccactggaatggccaaagttaaaaagagaataccaaatgctggtgacgatgtggagcaaccggcacctttatacatttttgttgggaatgcaagttggaaaacattatggttgtataagataacataaaattgccgtataattcatcagttcaactccttggtgttagtcgaagagaaaggagaacatgttcatacagactttatgtgaatattcatggcagtgctattcataatagtcttaaaaactggacgcaacctaattatggtatgtctgtactattgaatattatgtaacaacaaaaagaataaaatgttaatacatgaaaagacatgttgaatcttaatgaaacttttaaaagttatgctaagtgaaagatgtcaaacccaaaagaataaatactgttcaatttcattatatgaaaattgaaaattggcaaaactagtgatataaagcagattagtgattgcctgggctggtagttgagagatggcatttgactacagaaagtaccaggaaactttttagggtgacagtattattattaatatatcttgaatgtggtgggagttataaggttgtgtgcaattatgaacactcatcaaaatataaaattaaaatgagtgacttttcttacaatttattattttgtcattaatttgtaaaattataacttgtaccccagtaaaaacattttaaaaatatatagtctctgccagtttatcttatttgcttctactaatgaagcattctgcagtgtttcatcattaaatataataataaaggattatttttctaagcattttatattcttattctttcagtagtcattatatgactagagaatttggaaaaagtttccttttttcttttttttaaaccatattaatccaatttgcagaccttttatttatttttccaagggcattatttctactatgaaaagactggacaggtttatgggacacattttttttgttttgaatcaaagagcttgtcataatattaaagaaaaccaacaacgttggtatgattcaaaaggagctctctcaaccggctgtctctggtaagacaggcccagtaatgcccacctgcaaggctgttgtgaagatgaactgagaccacctatgtcagatgtagcagacagcatatgccctcagaaggctggtagctttactgtgtttctccataacacttctcatttctcggagacaaggtcagggaatgttttgaaatgtttatttgaaaagtatttattgtgcatatattatttattcatttacttactatgtccttgaaatggagactgtattatacagatattcaggtcagctttaacatatcctttaggcctaatcacttttttctttcaacatgcctaatgtagcataatagttaatagcatagtagtttgacttttaaaattgatttctagggaagaatgtaaatataggaaagcttcctgatagagattatctaaacttaggcataaataataagtaaaactctgaatttaggtatgtaattgtagaatccctttgattataagcaagttgaaaaaaattgttttttacctagatgagtttattttaaaaagttattaagcatttataaaggagccttttttggggtggctcctaattattaccaagtttccaatattataaactctgtgcttgagttgaatattatagtttaggcttctatctcctagtagtgtttccaagcaaacagtttttccagtctctcagaagttcatttcagttaccatctcctcactattcctggagtgtatgttgcttatggtagcagctcaagggacagatgtatgaatgagagcaatccataaatgtttgaattcaaattatagtttttttaaaataaattctgctataaaaagaaatgaaatatttgtccatgctaaaacatggagaaaccttgaaaactttacttatttatttttattatactttaagttctgggatacatgtggagaatgtgcaggtttgttacattgatatacatgtgccatggtagtttgctgcacccatcaacccgtcatctacattaggtatttcttctaatgctatcccttcccttgccccacattccctgacaggccccagtgtgtgatgttcccctccctgtgtccatgtgttctcattgttcaacacccatttatgagtgagaacatgtggtgtttggttttctgttcctctgtgagtttgctgagaatgatggtttccagcttcatccatgtccctgcaaaggatatgaacttatccttttttgtggctgcatagtattgcatggtttatttatgccacattttctttatccagtctatcactgatgggcatttgggttggttccaagtctttgctattgtgaataatgctgcaataaacatacgtgtgcatgtgtctttagagtagaatgttttataatcctttgggtatatacccactaatgggattgctgggtcaaatggtatttctagttctagatccttgaggaatcaccacactgtcttgcccaatagttgaactaatttacactcccaccaacagtgtaaaagcattcctgtttctccacatcctcgccagcatctgttatttcctgatgatgagcttttttcatatgtttattggctgcataaatggcttctcttgaaaagtgtctgttcatatcctttgcccatgtttctatggggctgtttgtttttttcttgtaaatttgtttaagttccttgttgattatggatattagccctttgtcagatggatagattgcaaaaattttctcccattctgtaggttgcctgttcactctgatgatagtttcttttgctgtgcagaagctctttaattagatcccatttgtcaattttggcttgtgttgccattgcttttggtgttttagtcatgaaggctgcccatgcctatgtcctgaatggtattacctaggttttcttctagggtttttatggttttaggtctgacgtttaaatatttaatccatcttgagttaatttttgtataagttgtaaggaaggggtccagtttcagttttctgcatatggccagccagttttcccaacaccattgattaaatagggaatctttttcccattacttgtttttgtcaggtttgtcaaagatcagattgttgcagatgtgcggtgctatttctgagggctctgttctgttccactggtccatatatctgttttggtatgagtaccatactgttttggttactgtagccttgtatagtttgaagtcaggtagcgtgatacctccagctttgttgtttttgcttaggattgtcttggctatatggacttttttggttccatatgacatttaaagtagttttttctaattctgtgaattttctaattctgtgaagtaggattttctaattttgtgaagaaagtcaatggtagtttgatggaaatagcattgaatctataaattactttgggcagtatggccattttcatgatattgattcttcctgtccacgagcatggaatgtttttccatttgtttgtgtcctctgttatttccttgagcagtggtttgtagttctccttgaagaggtccttcacatcccttgtaagttgggttcctaggtattttattctctttgtagcaattgtgaatgggagtttgctcatgatttggctctgtatttgtctatttttggtgtataggaatgcttgtgatttttgcacattgattttgtaccctgagactttgctgaagttgcttatcagcttaaggagtttttggactgagacgatggggttttctaaatatacaatcatgtcatctgcagacaatagtttgagttcttctcttcctatttgaatacctttatttctttctcttgccttattgccctggccagaacttccaatactatgttgaataggagtggtgagatgttgaataggagttttcaaagggaatgcttccagcttttgcccattcagtatgatattggctgtgggtttgtcataaaaagttcttattattttgagatatgttccatcaataccgaccttatggagtgttttagtcattggttctgtttatgtgttttttgtcattggttctgtttatgtgatggattacgcttattgatttgtatatgttgaagcagccttgcatcccacgggtgaagccgacttgatcgtggtggataagctttttgatgtgctgctggattcggtttgtcagtattttattgagcattttcacattggtgttcatcagggatgttggcctgaaattctcttttttgttgtgtttctgccaggttttggtatcaggatgatgctggcctcataaaatgagtaagagaggagtccctctttttctgttgtttggaatagtttcagaaggaatggcaccagctcctctttgtacctctggtagaattcagctgtgaattcgtctggtcctgggcttttctttggttggtaggctattaattactgcctcaatttcagaacttgttattggtctgttcagggatttgacttcttcctggtttagtcttgggagggtgtatgtgtccaggaatttatccatttcttctggattttctagtttatttgcatagagatgtttatagtattctctgatggtagtttatatttctgtggggtcagtggtggtatcccctttatatcattttttattgtgcctatttgattcttctctcttttcttctttattagtctggctagccatctatctagtttgtcaactctttcaaaaaaacagctcctagattcattgatttttcgaagggttttttatctccttcagttctgctctgatcttagttatttcttgttttctgctagcttttgaatttgtttgctcttgcttctgtagttcttctaattgtgatgttagggtgttgattttagatctttccctctttctcccgtgggcatttagtgctataaatttacctgtaaacacgctttggctgtgtcccagagattctggtacactgtgtgttcttattggtttcaaataacttatttgtttctgccttaattttgatatttaccttgtagtcattcaggagcaggttgttcagttttcatgtagtcgtgcggttttgagtgagtttcttcatcctgagttctaatttgattacactgtggcttgagaaactgtttgttatgatttccatttttttgcatttgctgaggagtgctttacttccaattatgtggtcagttttagaataagtgcgatgtggtgctgagaagaatgtatcttctgtttgtttggggtggagagttctgtagatgtctattaggtctgcttggtccagagctgagttcaagtcgtgaatatccttgttaattttctgtctcgttgatctgtctaatattgacagtggggtgttaaagtctcccactgttattgtgtgggagcctaagtttctttgtaggtctctaagaagttgctttattaatctgggtgctcctgtattgggtgcatctatatttaggatagttagctcttctcattgcattgattcctttaccattatgtaatgtccttctttgtcttttttgatctttgttggtttaaagtctgttttatcagagactaggattgcaaacgctgcttttttttttttttttttttttttttttgctttccattgcttggtaaatcttcctccatccctttattttgagcctgtgtgtgcttttgcacatgagatgggtctcctgaatacaacacactgatgggtctcctgaatacaacacaccgatgggtcttgaatctttatgcaatttgcaagtctgtgccttttaattggggcatttatcccatttacatttaaggttaatattcttatgtgtgaatttgatcctttcattatgatgctagctggttattttgcccattagtggatgaagtttgttcataatgttgacgttctttacaattttgtttgtttttgcagtggctggtactggtttttccttaccatatttagtgcttccttcaggagttcttgtaaggcaggcctgatggtgacataacctctcagcatttgcttgtctgtaaagggttttatttctccttcatttatgaagtttagtttggctggatatgaaattctgggttgaaaattcttgtctttaagaatgttgaatattggcccccactgtcttctggctcctagggtttctgctgagagatccgctgttagtctgatgggcttccctttgtgggtaacctgacctttctcactgcttgcacttaacattttttccttcatttcaaccttggtgaatctgacgattatgtgtcttggggttgctcttcttgaggagtatctttgtggtgttctctgtatttcctgaatttgaatgttggcctgtcttgctaggttggggaagttctcctgggtaatatcctgaaatatgtcttccaacttggttccgttttccccatcactttcagatacaccactcaaccataggtttggtcttttcacatagtcccatatttcttggaggcttcattcattccttttccttcttttttctctattcttgtcttcatgctttattttattaagctgatcttccatctctgatatcctttcttctgcttgatcgatttggctattgatgcttgtgtatgcttcaccaagttctcgtgctatgtttttccgctccatcaggtcatttatgttcttctctaaactgattattctagttagcaattcctctaaccttttatcaaagttcttagcttccttgcattgggttaggacatgcttctttagctcagaggagtttgttataacccaccttctgaagcctacttctgtcaatttgtgaaactccttctctgtccagttttgctcctttgctggcaaggagttgtgatcctttggaggagaagaggcgttctggtttttggacttttcagccttgttgcgctggttttccctcatctttgtggatttatctacctttggtctttggtgtcagtgacctttggatggaatttttgcgtggtcatgctttttgttgatgttgatactattgctttctgtttgtcagttttccttctaacagacctgtcttctgcaggcctgatggagtttgctggggggccactccaggccctgtttgcctcggtatcaccagcggagtctgcagaacagcaaagattgatgcctgctcctacctgtggaagcttcatcccacaggggcaactgccagatgccagccagagctctcctttatgagatgtctgtcgacccctgctgggagatgtctccccatcaggaggcacaggggtcagggaccccacttgaggaggcagtctgtccgttatcagaggtcgagcactgtgctgggtgatccactgctctcttcagagccggcaggcagagacgtttaaaactgctgaagctgtgcccacagccaccccttcccccagttgttctgtcccagggagatgggagttttatctataagcccctgaccggggctgttgcctttcctcagagatgccctgcccagagaggaggaatccagagaggcagtatggctacagtggctttgtggcgctcaaaattcttgtgttctaatgatgtgaagttaacaggatgcagatcacatatctaaattgacttgtaaacatttattttaggaaatgatagtatattctctcatcactaatatatttctgttgcttcaatgtgcaaaacactgtgctagatattgtggggaagactaaaatgaataatagctaacactaggcaagttcacattgtttgtcagatgctatgctaaatgctagatgtgggtgatttcatttagtgctgaaacagccctgtgacagagctcttgttagtttctctctctctctctctctctgtctctctctctaccgtttgaggaaactgatgctttaggaagacataaagatacaaatggtggaactggaattcaaattgagaccacaaagctgttgttcttaagtctgtaacatacaaagcctcacctttctcatctgaaagtgaggataacaagctagcttgttgcaaaggttaaataaagtaatactgtaaaacacttggtaccacagaatactactattacttcttaatggtagtaattattatggccaccgtagaggagggattataaagattaaaataaatgatacacataaaggatttagcatggagcatggcatgtaagcactcaccaactcaaagaggcatcctttaaattggactgtgaaagttgacagcatttttacagttgaactttgaacaacacacgtttgaactgtgtgggtccacttatatgcagattttcttccacctctgccacccttgagacagtgaggccagtccccccaccttcctcttccacctcagcctactcaacatgaagatgaagatgaagacctttgtgatgatgcacttctatttaatggacagtaaatatatattctcttccttgtgatttattaatattttctttctgtagcttactttattgtaaaaatacagtatataatacatataacatacaaaatgtgttcataactgtttgtgttattggcaagtcttccagttaacagtaggctattagtagttaagctttggagaggtcaaaagttatatgtggattttcaactacacaaggggattgatgtccctaatctccatgttgttcaaggattccacttgtatatagagagatctgtgcttgagggaaaagaacatgatcaagattaggggaatgcatgtacaaaggtgctgtacaaagatgagattaacgctgttaggtagccagtttatatctacacaaaggtacataggaagagtaaaatgttgggttggaaaggaatttggggccaaatcttacagatcttcaaggcctggcaaagaagtttggctttgtctatcttttggaaagccattgttctgagttaactcactcaaaaacatccagggtttatttcttagcattggtaaatgaattctttagacactgaaaaaggagggttgcctttgaatattttcttgttgtcattattattataataaatttattttctaaaatgtactgaggtagtgacttgacagaatcaaagcatctcagaaaatgagtcattggcttctttctaatagctgcttaggattctaaatgtttgtgttggcagatctcacataattttcttaagtctgtgtgaaatgttcaaaagagtttcctatgataatgtttggttcattcaggttgaaaatgatgaaaacaacttctagaaagagatgacagtgtaagttacatctggcaacccagaaacaaagttctgtagactactcatcatatcaatcattttttcccaaattattatggtgaaacctagatacaaagagcactgttccatcagggatcttatctatctctgaatagaactgtgtttcctgtatgatgttgtgtgtgagtgcatgtgtataaaaataagtctgtcaatgtgggctttttttcctttttctcttaactcaaggattaatcgtaaggttctctagtgtacatttttcattattgttttgagaaagagtcttaccctgtcacccacagtggacagtgacatgatctcagctcactgcaacctgcgcctcctgagtagctggaattacaggcatgtgccacaacacccagctaattttttgtatttttagtagaggcagggttttgccgtgttggctaggctggtctcgaacttgtgaccttaagcgaaccacctgccttggcctcccaaagtgctgggattacaggcgtgagccaccatacctgccctatcgcgtacatttttaaaggcacaattgaaaccagtgttctgaattaaaccactcacattagcttacaaatactacattctgatttggttggatctctgttttcagtataatttaagtgaaaaaaatcataattgtatgataaagataaatcgatgttaccaaagtatatttaaaagggcattggtaaataccacaaaacttattttctgttttaaatggaaaaaatagtttactatgtgcctatttaacttacacaagggagtttgctttattagagtaactgcaaatgaggcaacaaaatttttcttttggcaaatacacgtattaggtctcatttcaggtttgaggaaaatagtgaatatttttagttattttgaatacaaatatgtaatattctttttctgagaagcctaagtagtttttcttgctatgcctgaattttggcagataaacgtgtcaaaccaatttgttatacacctgttgtaacagaagtgacaaagaaaaatcacagttcagagatttgacaggtttgtactgaaatggtgtttagtatatctaggtgttctatctagaaaaaaagtatagaatggctcaactttaaattgattaatctaaaaagaaaagccttcataaccaccagcttttatttagtgttccacatatttctaatattccaacaaggatatcttccctggagagagtagagttgagatcataccaactctgattagaattttcacttaagaacagcagttgagatgatgttatctacattcagattctcaacttagttatggaataaaatattgcacatgctgtgtttgataaaaagtaagtgaaatgtgagtattgtcaggattttacttaaactagaaataaatgatatccttgtaacagtttgaagtacacaaaagaacgtgatatatcctctttctcaagccttaataatcatggtatggattggttgaagattatttgaggtgatatccacttgaagtttttttgtttgtttgttttttttaagacggagtctcgctctgtcacccaggctggagtgcagtggcgcaatcttggctcatggagacctctgccttccgggttcaagcgattctcctgcctcagcctcttgagtagctgggattacaggcgtgtgccaccacgcctggctaatttttgtatttttagtagagacagggtttcaccatgttggccactgctgacctcctgatccgcccgcttcagcctcccaaagtgctgggattacaggcgtgagtcaccacgctcggccttctcttgaggtttttatggctgaagcatatttttgtaaatcatgttattggtgatatgatggctaaagccgacctgaatacattatacagtctttcctattgtgaacatattaattaacttgtgagattgctcatgataattctttttagggcatcttgagactgccttctgctgcattaggagagtttattgttttatgaaatacatgttttctgcccatcactggtcatcttatgtccttaatgctagaacaataggaattttcccagggctgaattctggcaccatttcatactagaccttttctctgtttctccccttttccttgtgtgtgtgtgtttgcacgtgtgcacacatgtatgtgtggtgtgtgtgtgtgagagagacatagaacacctattttgtttcttggctttgctttttattgttttttcattagtttttactgttcttaattcctaagacataatgaattttaatatctggcagggtaaactttcagcttttgctttattttcttgaaaaaaatgtctaagccatttttttctccatgtatatttttagatttactttgttaagcttcctcaaattcctgatgggatgtaataggaaatcctctgagactataaattaattttacagggatttgacatctttaaaatgttgactcatctcatccacgagcatcttctttctgcatttatttagggaattttaaatgtcctttaaagttttgacattttctccttgagaatcttgtgtgatctttgttagattaattccaagatgtattgtttttgttgctcttataattaatgctgtgtttgccttttttctggttattgcagaggaatactcttcactttgtgtatattggttttatatttgacagctttgcagaattgtgtagttagttctccattaccttattagctgtatatctttgttttagcagtttgtgggtgataaattctttctgcttttgtctgtttaaggaagtctttattttgctttttattttgaaagagatttgtgttggctaaagaattctaggatgacatttttttccttttagcactttaaagatgttgttttcatatttccaatatttcctcatctttagtattgatattgcttaacttgttttaaattcttattttgtctgttttctcactcattacttcagtagttatttttcctctatttttattctgtctttaaactgcccagggtttacttttacttatggtgtgagtcggggatctttgccaaatcattgcctcctctctcttgtcagtcctgcctgagactcttccaaattattagccttttcaaaataccacttagtggttcattaatcagtctgagtgatgaattgattgactggattttttttagttcattgatttctgcttacatctttattttctgctttcacatttctggctttattctcttggatttgtcccctttggtggatttagttatcagctaattgtaaatcattattattttctattgaaggcatttaaagctcataatttactgttgttactgttttaggtgcatgccgtaaattttggcatgagttcttcccttctcattatactttaaggattttatagtttccctcatttcttctttaaatcattattattcattattatttttacatatatgtgtttttattttatatttcagatatgtgcagtctcttctagtcatcttttttattgtttctacctttattatattgaggtaagaatataatctggtggagtttttgtaattttttgaggcttcagttttggtctatgaggtgatcaagttctgtgactgctccatgagtgcttcagaagagcagctagtctatgtcacaacactattaattagtgtatttacattttctctgccatttctgagatgggtgtcttaatactatatattatatagagtgagtatccctaatccaaaaatgtaaaatccagaatgctctgaaatctgaacctttttgagcaccaacatgacactcaaaggaaatgctcattggagcattagagttcagattttcagattacagatgctcaacctgtattattaattgatttaaattttctatcagttgctatgggaaacatactgaattatccaatgaaaatagttgaatttgttattctagtagatctgttacttacttccttctatattttgtggtcatattttcaggtacatatacctctgtgattgttgtatttttgttctacagcatttcctgtaggtaaatttcctcttggtcctttataatgtttttggctgcaattctattctgtctgataataaaattgcttcatggggtttcttccattttatccctctgtgacataatactttccatacacttaacattgactggttgaatcatggttttctcaaaaatccaatctgaaaagtctttcttttggtatttagtttcatccatttatattttcatcatgattacttttctatcaggcttattttcactgtcttgttttctgtcttctatttattataactgttttgtgtcttgctcgcattgctgttttcttttctaccttccagtggaaactctttaaatcagatgtcttatttttttccctcagttctgggaaatatttgactgttatttcttcaatactttctcccatctgtttactttcctctattcttttgagattcctaatacttctagcctccagattttttatcttatatctcattctttttacctttaagatgccatctggagagatttttggccaggttttctaagatactgtgtaggttgtttgagctgttgtcttttattgatggtgcttctgctcctcatttgcctcataattttctctggactcatctttaattcctctggagttattacctgcttctgtggttggaatgtgtcccttcccaagtccaagtgctgccaatgtgatagtacaaagaggtagggcctttaaaaggtgattaggccatgagagctcctcgccttgtgaatgagaccattcctttgtgtacttaaatgatttattgctcagaggaacttaacttttacatggaagcctgaagggtgaaagcagttcaatttgagggtggctgaattgggctagtcttatcaaagaagaagacagatactgccttggtgaacattcatggagacattaacaaggggctgatgcagaaggtatgtgatgacctatcttcaaacaggtagaaaacatcacatctgtaacaaaagaaatgactaggcagatcttcttttaaactctgggaagagcagttgtgtgctgtattcacacagcagctatcctgtcattatcccttcagcattttaagctttgactttacccccctctctcattagcagctagcttctagaaggtgtcaagacacggagagagctgcagactgggggagggcaagaaatctggagtcagatgatcatctttcccagttggaagaaaaccagattggaaaaactgatactttggctgctcctgtttctctccactgaccactcctgtgctgccgaagactgaatcatcctttctctgtctatgctcatgtatcattcataatatcgctttactgtggtgattataacatattaccctctggttttctgtgctgcttcccctgaataaatggactcctctagggaagggggattgtcgtattgttttgtgtgttcactgaagatttgttaatgaaataaatgaattagcagtcattgaaaatgtagccatagatatgaatcctgcctgttggctagaccattgagagttttgatttatttataggagaactctgttctgagccaatatgcctgtcagtaagactagtctgtgaaagcgtagattagggcttggaatgaatagaatttaaagatgaaagttaatctttatcatctatctatatcatgtctaggagtcttagaaaatcaatgcttataaaaaattatgaaaataaatttgtagataaaaatgagtttaattatcactgactgtatgaaccagtagctagtgtgaacaagaaatagcatgctggcaggaatgagaacacattatcacgtgacagaagtgtaatacccaactgcaaaggtgctataggatcaaaatgcatagaggaaattaggtaatagtacaaaataaaaataaccaacatctggtaacatgtagacattttccatctaaattgttgcttttaatgacaaagtcatgctcctcctggaggatgtgatgggagctgtgcagtgagattaaataggtactggaagaaaccatagtttggtgttttgcagttgttcatagatcaaatagttctttgctttgtgtgaaaaatccctcagcagcgagagatgaggaggatgaattagatcagcatgaattttccttttcctctagaaatgcttcagacacctaagggccttaagccagggtccataagtggaaagctgtaagggaaaaaagaaacttcacagtccaacaggtgagaagactgtaatttctgatcaaataaatacctaggtgtttcattgtcttgtctttttgaattcatgtagtacttcctttctcaaataaccccagaaggatggcaaggggtgtacgtgctgtgttttgtccctccctcttcctgtgcccaactggtaaggaaattggatgttttactacgatctctggctccccacccctgccccctgctcatatagcttgggaagtgatgatatgcgctgagtccattctaataaaacacacaacatgacttactgcttcatgatatgttttataagatggattgatttatgcacctatataagttgagtctgaatagtcagttttcgaagtgaattaagaataaatttttgttacattgcatcttatcaataagcattttaaaaccccaagcatatttatttaaacatataatttaaaaataaatgttttgaaatggtggttgaagaaccttttctttatttttcacattttctgatgtacttgctgttctcatcttctgatttcatgccctctggccttctagccccgtgcatcgtttttgagcacatttgaacatgtctgatccatgtagtctgaacctgttgctctctgagggttaccctactcatccctgcatgcttgccttcatctggaaccagcctgatgcattccaagaggaggatagaggtgggtccaggtcactttgcacagggatctgcacttcatgatccagaagaaaagtgcttttaaagcccaacttggcacattttaagtcaaaattaggtttgtggcagttggcacatctcttaaattctctatttttttagtcccctgaaatcatatttggagtgaaagaactgaaaaagttaaaactcagtctcttagactggcttagattggctttctataattgatttatcgtctacttaggcaatactccaatttctttattttctatgtaaattgtgttgatggatcagtacacaatattgtatcatttatcatttctattggaatgtttttattttaattactttggtagaccgatttgcattaagaaagttacccatggatagatatattagaggatgttttaatattctttaatatataatattcttcagaagattaaccaactaatgtatcataaaatcggtagagtaactgactagctttatgaaattgtaaatttgttgaaaattgattttttttttactggagacgagagttccataattgaaaaaatatcctatgccagtgctttgtagattgcaagtaacgtagataatcttgcctgtagttccttgatgaaaatgatctgttgcatttacaatatcacaagtaattaattattaaagtatatgcctgtgattggtatgttttatcttaattctacttattctcttagtcatgcaaagaagaaataactgccagtggtagctgttgaaattatattcagatctattgaggagcatgttttgaacatcttttatgcttatttaaaaagaggcggagcttgtagtgagccgagttagtgccactgcactgcaagcctgggcgacagagtgagactacatctcaaaaaaaaaaaaaaaaacaaaaaaggcttttctatgggattctcatttgtttaaattatacatgtgattacttgacacgttaaagtgtacacaatttaggaaaatgggattaaaaatccagaaacacttaagaagttcttatagtgaagattaaaaaagtgatttcatttaatgactttcagaaaaaaaaatcactgggtggaacataaatgtttgaagtattcttgaacaaaagtgctctctgatactatagacataaaaattcttaaattacccgtgaaatatgctgttcctagggaatggttgtgaagtactttttagtcactcacctgatagagaaaagtagtctgaaaagctcatacacactgaattacttcttcagtttaactttttttgtgcctgctagttagttgccaggcactttacattgagtagtgaataacagacacctgcttttcaagggctgcttctgtagtatgagaaagagatacatgaacagacaatttttaatatactgtagtgaatgctgtcatagatgtacatgcacatgacctgttgtaaaatctggagcatgataggagagagagagatttgtgggcaggttgtcttctaggtcacccttccctcaacaccatgtagatgtgacctctctggtcttggcagtagtgtggttgtaccacaaacagaggcaggctgatgaggttgacggattttggtgttattctaattattcctttaagcaagtcatttacgtttctaagtctgtttcctctctgtgaattaaggaaagtagtaaaactaccctgcctcccaaggcagttatgaggactagctggggtaatgtgcctgaatgagctttgtatatagggaaaatgtatacaaattaatcgttagtatttgtggcactcactctgtgatttggcctatttcacctccctatgctctggatttattatctgtaacgggaacaataatggttgttcttacaaatggtagttgtgaggattaaatgagttaaaatatgtgaagcccttaaaacagtttctggcatacagtaaatattagctctcattttgatattcttatagcagaagaagttgaccctacctctctgttaccctggcagaaggttttcaagatactcattttgtggtaccctggacattaagattccatgtaattttgatggcataatgaaaactttctattgttggacagttgttgtagatgagcatccagaactggattaactgatccactgcagataggaacttatgaggtgagcaggtgctcccctttagctcacactatttgctgaatagtttggaaatgcctctttctggcattcaaataatatactcttctttagttgcagaaagtcagtttaatgaacagtgattaagatgctgccttttggacagtcattaataaatgttaattaaaaaccccagtctagagcatctgccgttgtcccctcagatgggtacctactatttcagatctgttttgtttagagaactacagcaagcttagtagccatttctgatacctgttttagtagcaaattatactgcttcctgttcgtttgatttcttccagggacatattttattttcctgcctccttagaatgtctggcaaaaagctttatttcatctgaattctgctgggtcatcacattggacttgtggaagaaaatggatttataatagcaattaataaaaaatagtaacaaataatattgcttaatagtaaatgtgtactgtatgtgccagccacagtgctaagcattttaatacaaaagcataaaataacattgtgagatttcctctagcaattttaaacttaaactagatgtttattcgagggcagctttaagctgcatttgcatagcaggctttttgctgtgtatttattgggaggagagctgttggaaattacagagctgttggaaataaaccctagctaattctcagggtttcttccagtattgaacttgtctgaaaagctgttggaaattagtgtgcactgactcccccaagatgcccctggaaatcaccactgcttgctctaccaaggtaccagaaaatctgccctggaaaatgagtcctttggattaaatctttccatcttcaggacctgcttgaagtgcaggtgtccctggagagggagctaattaaatcatttaacacttaaatagggattcagttatgaaattatcttctgagaaagaaaggagctgaaggctcaagtaacttttaatgggagaagaaaatggtgatggaagatttcttgctagtggtacttcctagggaattaactggagatagaactgggaagccagggagagaatatagagtgcagaaaaagaacgggaaagggcagatgggagtgagttaagcggccactaaggtcccttcctgtatttacactgggatcccatattatagagaaagtccatttggctctcttccccatctcagacaaagctttggttccctttggtctgcagcattgtctgtgttcctgggagaactcttcagttccatttattggctcagaagtagatgctgttgctataggatgatggctggcagagccattcctgagaatggctcattctatgagccagtgtcatagaattgtccttggaatgtcagccattgaagtaagtggtgtgtgtgtgtgtgtgttttctcacgccattgtgtcttgtattcctgggttggagagatattaatgaatttgtggagactaggaaaatagttaaactctagattgtctcatttaggttcagggagagaagtcttcatccttgtaacacagtgttgtacttacacgctctctggaatttgagttagaaactggtggtataacccagaaatgcgtttactctcagagtttactgattatttcatcagatgtggctcagaattagtgttgttccataaaagttgaaattggttcactttagaggcaaaagaatcttgactttcaagctgaacaaaaaataattgggaagttaggaaatatcttctagtttaagactcactgcttgagagcgcttcatcaccattaaaatgggaagacaaaaatatttcaattttcataaaactgggttcttgatatgacttttggctggaatttactaatatctgagattactttccccagtctgtaaacatggataatggtaactgcctgtaagagtagttgtaagtatagtggaagtattaagtaaacaggcttggattatgactctaccacctattgggctatgtggacaactttatttagtgtctttgagttagagttgcctcatccagtaaaaccctggcagggtaagaatttaataagatgtatgctaaatgcctggcatgcattaagttggtttgccattcacgtgtgctttctttggccagggctgtgttaaatttgaaatagtttctaacacttaagcatcagatgattccactgtaataatctggatttcagaaatcagaagatctggcagccttgtgtctgtccctctggctgcctgactcctcaagctgtgtgtctgtggacctctttgggtaggatgtgttctccagttttccacagaactgctgctgcctacagcgttctaccctgactgttcatgcccatatgttctgtagctgagccggtagacatttattgttctgccagtaaatgaatgttttggttgaaaagtatgttgcactaggtgtgatatttggtacacaatagatggtcattaaatatttccctttttctctattaggctgctgatgatgtagtgaagagaaagtttaaatccaaatgatttcagccctgaactagaaagttctgtctcagtgggctgtatgatctcagaaaatcacttaatttctccattgctcagtgtttttctagggacactagagaatttggactagctgattctcagggtttcttccagtactgaacttgcctgaaaagtgatacataaccacacgcaaacttccatggggtgtttgaataaaaacttatatcctaaaaataaaataatgaagtatggattgtaagaacaattaggttaattacaaagtggcttaaaattaatgttcaggctgggcacagtggctcacgcctgtaatcccagcactttgggaggcttaggtgggcggatcacttgaggccaggagttcgagaccagcctgaccaacgtggtgaaaccctgtctctactaaaaatacaaaaattagctgggcacgatggcaggcacctgtaattccagttactcgggaggctgaggcaggagaatcgcttgaacctgggaggcagaggttgcagtgagccgagattgtaccactgcactccagtctgggcaacagagtaagactccgtctcaaaaaacaaaaacaaaaacaaaaacaaaattaatgttcagcgttgttggttagtaccaatctagaaaactgaagaatttaatcttttagccctgtgctgttgatttggataaagctatggggggcagggatatcaatataggagctattgtgaagctgggtgtgacagtcatatgatggatgacaggcccaggatggagagacatcttgatagcatggagcagtggacacaaaattgaacaaagatgtgtacacagtggtgtaatttggtttgaataaaaccaaccgaaaaagtaaagatgaagaaggaaataacaggtaaaacagagctagggttttagatgaaatgttcaatctcaagtgatatatatacatggccatcaatgtgtcatataaagagaatattaggatttccatttatgtttatttaaataagcaacttttcaatttgtgtgtgtgttgaattacataacaggatggtactacataaataaaacaaaacatgcccttggggtattgatgtaatcttttttttaactaataggagagtgtgatcaaaagtttgcaggctgctggattggaagttctgtttgttgaaaggtagcatagtatagtggaaactacagtctttaaaatcagatagtcctgaatataaactttaactttaacacgtaatacttatgtaacataacttaatgagcctcactttcattgaatgtaaaatgtgtgttataatacttctctcataggtatgttggatggttgcaatgggatgattttactgctgtcttttggttaatttctctgttttttgtctttcatgtttgattctttagggctggagaatatacccagtataattttactcttttaaatttgttgggttttaaaaatgacccttaactgtccaatacaaagtgtatcttgctgaatattccatgagtgcttgataagaatgtgcattctttgtgttctgtaaatgtcagttagatcctgttggttgatgtcttattcagttcttctgtatctttgctaattttctatttaatagttctatcagttgctgagaatgggatgtttggtccccatgatgagatgagtttttaccattaatttttaaaaatgtacatctgtgtctggccttgtgtgacccagagtggtcagcatagtatagaaggaatgcaaagaagctgtagtgagagaatagccagcttcatataggagaaaatgttctcatgctatgatttcccatgaattcagtagcagagtctgtcatcattagctttccggggtttgtagaaatactatcatgcctttggcctcgttgttattattgagcaaccttgcatactggaagctccagtgccttctgtatacaatgagctggattaggttagttttctagtatttagtgactctttcagtcagatacagactcatgtttgaccccgtcttttggcatgttagcatgcagaattaacctgttttcacattttgcagcagcacatgtaaaaatacatgctttcagttttttggccaagtctttttttttttttttttttttttgagacagagtcttgctcttgtcacccaggctggagtgcagtggcacgacctcagctcactgcaacctctgcctgccgggttcaagcaattctgctgcctcagcctcccaagtagctgggattacaggcatccgccaccacgcccagctcatttttgtattttttagtagagacagggttttgccatgttggccaggctggtctccaactcctgacctcgtgatctgcccgcctcccaaagtgctgggattagaggcgtgagccaccgtgcccagctggctaagtcctttttaaataaacctcttggggaagatatattctagtggaaaaggaaggacattaagtaacaaaaaatatcctcaggctttgggtcttaacaaagcagtcattcttgaaaagccactttttatttctctattcctcattttctagagtaactcatcaagttcttttaaataaatgtgtctgttttaaataacagatggctggaaaaataccccagctgagaattgatcttttagttgttgattttagtataaaacagttacattgactgtgatgattgttatgttgggatttatatccttcagtttttttgtattagatttgcttttttactgtttattaatgctttccttttgtctgctttcctcctattaaaattttttaaaattattttccctctactggtttggccattatgcattctgttagactgaaattttaacacacatactctgattaattttacaaaagatgtatctgggttttagtaattttgtgaatcaaagaactgggaatttattatcatatcaaaaaacgtgaccactcagggttctgaaatacggatttattgttgttctgtgactctagtccgtttcgtagctacctgctaattgcattattattaatggttctggagaatgatccatcatagagatgtcaaggctggtataaatttactgaggaacaatttaatccatgcttcagcaccgcagactttttgttaacagatccacaattaaagtgaagctgctgccagttgttgaacttgagttagaaactgcaataagccacaggaaaagaagcaaaaataaacctcttttcagatgaaattgaaaaatatctattggaataacatgaattaaagacttgtcacttcatgaacttattgttctttttttcttttttgttatggagagagacacttctctagtctccatttcttggttactgtcaccaacagtggcagttttagataaaataatgtcgagggagaagaatactgaaacgtaaaaatgtggtggtggtagttttatttttaaaaaatatatatcctgtggaaatagttttcagttttagcttcactgtatccaccctcctagcattaattcagtacgcctaagtgaagttgctagctgctaaagaaatagttggagtgctattcagctgtgaggctaaaaatctcgaactaaaacatggaaattgtttttctaatttcatttgggtaaaaatgaattcccgtgaatacatgttagcaaagcaagcttccttttattatttctcataccacagatacaatatccagaaatgtgttgatgtgaaataaaatcaaatcaaggtgattatcatgtggacattggatcaggattctggaatgttcagtttgtgggttgctttgcatttctcacttggagatgcactcacaactttatacctctttgccttagttttttgcactttaaaaatgagaagtataatgatcttgagctcacatggttgtcagacagtgaagaattttgaaaaaggcaagtttttcatttaagtgcattacatattaagaaattcatatcaaacttttgaaaaacaagtttgacaaaaaagcaagtgatagtggctctacaaaatgtacttctgaactttctatatgatgtatttctataatatatagaagtatatagaaatattctataatatagaaatatataatcatatagaaaattcaaaagtacattttggagggagtctggggatatttttcagccactttcatgtataatctttctttcctagcccttcttttttccccttttaattcactcaactgtcctagaggacagtgacattttagaggaaatttattcaaaccacaagggaatatttacgaagagtttctttgcttgaaaaaaaaattatttctttgctttgatattttaaagaaattgatacttttaaagtttcttttaattttaaaatgatgtcaaacttacataaaagttccacaggtagtgtgagatacttccatgtgtactctttaccttgattcaccagtgttcatcttttgcttcattgactttatcattagttctgtctccctcgtacacaaactattttttctctgaaccgtttaagagttcctgtagactaacccttaactgtttcaacgcatacctcctaagaataaggacattttcttatataaccatagtacagtgataagaaacaaaactttttatatccagtccacaatctgaacttaaattttgtcagttgtcccaataataacttttgtagcatttctctcctccactgggtccaggatccatccacttgtattgtgtttaattattatgtcttaagtttcttttaatcttgaatcattcttcatccttttttctttcgtgaccttgatgtttttgatgagtacaggcaaattattttgtagaatgtgtcttaacagatttgtctgctgtttcttcataatagtattcaggtgtttatttgcttatttattcattaacgtttattatgtcctcttggattctcatacagtgttataaactattactgtcaacatttattctgatgctcaaattgttacaaatctggccagtaagagccccgtcagcttaaagaatgatgtcatcatcgttctttacatcatacatcatcttgtactttttctgctgcatccttggaatcagccagtactctaaggacccctggttctttttactggagagtggtgttcaggtcttggtgctagatgtgcttattgctaccagaatgtcataacttttaggtcttcttggagatcaaagtgaggggaaaatacacacaaataaatatgcatctgtctgttcatccatccatccatccatctagttgtccgtctatccatgaaaaaccatgactttatactgatatgttcaatttcagtctagtaccacagggttcattgcagtagtcctcctttccatatttgtaactccaccgcctaagaaacatggctttattattcttaatatacctacttatttgctcacttttaacaaaaaatatttaaaatttctaccctacagcaccatgaaaaagtaacctaatgactagagtttagtgtttgcttatggttctttgtgtcttaggctgggggtatgtagtcaaagtactgcattcagaagttacttgggatagttccttttttcctctcttcaatgttactgtgttctttatttgaaatacagtaaagttcatatgtttctgttgtattccttttaccattccttcaccaatgcttgttgattttatttatttggatatatgaaacagtatggtttcaaaaatgaaagatgtccccagaaacattatgactctaattctttcagtttctctgctctgtttatgcagctcccaccctagttcctgttacctataggtaactggtatcattagtttttggtttatccttcttgtatttcttttgcaaaaacaagcagattcatgtgttttcttttcccactctttcatacacaaaggtaacgtgtgtgtgtgtgtgtgtgtgtgtgtgtgtgtgtgtatatacattaagtttgcttttttcatcagttcataggaagcattctcattcatcctaacagcttattcagccagttttctaaatattggcatttcacttgtttccagtagtttgcgattcggaaacactgtagtggataacctagtgtatatatatgtttataatattggaggtgaatattttgggtaacttcctggaagtaatattgctagatcaaaaggtaaatgtaagtacttttgttagatttgtcaaattcccatccataaaggctgtaccagttttcatttgcacaagccaagttgtgagaggacctatttctccacagttttgtcaacagaatgtgttgtcaaatgttttaatttttgctgatctgaaacatgagaaatggtattgcagcgtagttgtcatttgcttttattatgtgttaagttgaagagttttcatgtgataaatacaatttttagatcttcatttgtgaattgtctgtgtcttttggctgttttttacatggtgtttatcttgtcttttaaacatatttggtatatatttttagtgttattggctttttaactgtgatacatgttgcagcaaatacttttttctagcttgtcgtgtattcttttttgattgggatataattcacataccataacattaatcctttaaaagtgtacaattcagtgatatttagcatattcacaagattgtacagcatcaccactagaaaatgttctaattctagagcattttcatcttcctaaaaagaaaccccatgcccactggcacccactctcctcaacccacaaatcccctgacagtcaccatactttcagtctctagggatttgactactgttttttatgtctggcttctttctcttagcatagtgttttcaacatatatgaatatgttacagatgcatcagtacaacatttgtttttatggcagaataatattatatggatataaaacattttctcatcagttggacatttataatgtttccactttttggctattaagaatgatgctgtcatgaacccttgtgtgcacgtttttgtgggacaaaattttcttttttttgcatataccttgaggtggaactatcgagtcatatgataaatttatgtttaaccttttgaggtactgccagactgttttccaaagcagttgtaccattttacaattttggcagtgcttgagagtttccatttctccacatctctaccaatacttgctgttgtctgtccttttgactataaccatcttattgggtgtgaaatggtatcttattgtgatttgatttgtgtttctcttaagactaaggatgttgagcatctcttcatgtgcatattggtcatttgtatgttttatttagagaaacgtcttctttaaatcctttgcccattttaaatattgagttgtttttattaagtttatatgttctggacactagactcttgtcagatatatgagctgcaaatattttctcccattctatgggttgtcttttcatgttcttgatgatgttctttgaaacacaaagttttgatgaggtccagcttaccagggtttttgtttttgcttttcttcatatctgagaagccactgcttaatccaagtttacaaagactaatgacgatgttttcttttaagagctttatagttttagcttttacatttaggttttaaatttactttgagttaattttgtgtaaagtgtgtggtaggtgtccagcttcattcttttgcatgtggatatccagagtcccatcactagtttttgaaacgactgttctttcctcattcaatattcttggcatccttgtccgtcaacaatcagatgcccaaaaatttatggatttgtcatttgtcttttgagattgcttatgattttttttggccatgctcaagtttgaatatttgtgtagctaaatttatcaacattttgcttatcttaattttgagctaaagaaagttttttcctacacttaagttatgggggaattcacccatgttttccccttataattctgtcattttcaaaatggctgttcttttgtctcagaaccatttattttattttattactttagaagcagggtctcattttgttgcccaggctggagtgcagtggcacaatcgtagctcactgcaacctcaaagtcctggactctggtgatcctcctacctcagcctcctgagtagccaggactacaggtgcatgccaccatgcccaagtagtttttaaaatttttaatagagatgaggttttgctatgttgcctaggctggtctcaaactcctgggctcaagcagtacccctgccttggcatccgagagggctgggattacacaggtgagtcaccatgcctggccagaatcatttattaaaaatccatttcactcagtgatttcaggtgccacctgtagcatatactaaatttgcatatgtatatgagtctatttttggacttcaaagtccgtttctctgtttatgtaataccatgatttttttaattaaaaattttattttgtgttagttttagattcatatgcagttgtaagaaataatacagagattttctgtagtctgtatccagttttccccagtggtaacatcttgaaaaacggtagtatggtatcaaaaccaggatattgacattgataacagtctacaggttttttgcagtttacttgaactcatttatgtatatatgtgtgtatttacttcggtgccattctgtcacatatataggttcaagtgttcaccaccgcagtcaaaacatagagcagtttcatcactgcaaggatcacttatgttgctcttttataaccgtacccacttcctctttcatcttccctagcctctggcaaccacagaaatgttctccatttctgtaattttgtcattttagtggcattagaaaagcagaattatacagtatacaatccttagggattggcttaaaacatcttttctcagtgcagtttcttggagatttactcaaattattgcatgtttattgttgagtagtagtgtatggtatggatggaccagtttgtataattgtttagtttttgaaggacaccggggttggttctgggtttatactcataaataaagctgctatgatcacaggtttttgtgtgaacataagtcttccacattcctctgagataaatgcttatgagggtgattgtattgaagtggccttgttttctggggtgacgctcagaattcttggtctcatagccaaggaaatcaaggacatggatacaccaagggtgaagtttagagcagaaatttaataggagaaagaaaaagaacagctctctgctgcagaaaggggtcccagaaaaagggttgccatcctgtagtgaaatacaggaatttttacagacaagctagtggggaggcagtatctgaacatagggtgtgaaaaaccagttaggatcaggtgtgtcatctgcatagggtgcaaatctctggaagcccctaccccaatcttttatcatacaggcaggtcctcagcctgagctactccatgttgcttatttctttcttactgtgcatgtgctcaaaaaggggaggtagaatccccatggtggacatgcctggccccagctagccctttctgtccatgcaactgctggcatcccccagtgcaagcttccaggttccttatctatgtttgcagtctgatcttccaggctactctttgttagaaaataagtaatttcttgggctgctttttgttagaagggaagttctgcgaaggatgctgtgccctcactatctgcctcaatagttttttctacctcctgtatcatgataatggcatgtttagttatataagaaactgcgaaagtgttttaattataggggcttttcagcatgttttaatatctggtagggccaatagctcctaatagcttttcaagtattttccaagtttttacacaaaacagttgtattatgccagtgatatgtctttgtctaatttatcctacttataggattgcagatggaacaagtagcattttctttgttttcccaactttagctcttgactatctttagtccaacttggctggcaaattgtcatttaagtatgtcgcatttgcttgcaccttttctgaatttctcaattattctttttaagaaactaaaattatgaaagtttttttcctctttttattcatttcttatctacttgaaataatgggacttacatatacatcagtgattctcaaatgttagtgggtaacagattcacctggaaggcttattaaagcacagattgctaggccttgccccagagactttaattcactaagtatggggtggggcctgactatttgcatttctgaagcaccaggtgatgctgaggctgctggcctgggaccacattttgaggactactaggctatattagtagaatggcttatggagtgtctctgagaagattgctgggtcttatgattgacattatatttgaatgattgtgtaggacagatgtcattatatctgtactgctaaagaaacaagatatatgatgctggtatctaacagacttttaaatcttagtactgaaaggagatagaaaagttcagcttttaagtcattcatttatttaatctttaatttattcatcagattttattgcttccaactacatttgctaggcagtgaaatggtttctgttttacacaatgaggaattttttttttaagaagagttaaatatattttctaaaattctatatttaagaatcagaaagttactggagattaggaagggtagtgtgtggcagggtgaggggaaggttatgaggcgataacacgacaaggtgactgtagtcaataataacttaattgtacattgaaaaataactaaaacagtataattagattgattgtatcacagaggataaatgcttgagtggatggatattctattttccatggtacgattatcactcattgcatgcttgtatcaaaacatctcatgtaccccatacatatacccatctattatgtacctacaaaactaaaaaaaattataaaagcaaaaaacaaaaacgaaaaaagcccttgactttcagaagcctctgactaacctttgcagtattgtgcctctgttctacacataattaactgtgttgaaactgagaattaaagctgaaatgtaatttcacaaacttaataaatggcctttataactgataatgacatcttcgttgccttgagacaacaaccaaggacttgatttccttgagataaggactttggttgaatcagtatgtctttaagtatttaatcttgtctcataataattgtgttacctcaacaaagattgtactcataccttgacaaatgaaaccataccagtaaattaattctatttaagtcagagtagaatcaactagcagttacccactgactaatatcagagcccagtgtgttacatgaaactaaattggaaaccgacctctggaactcaatgttttgttttgacctaaatctactctgcagtgtgaggtaaatacaattgtttaaagattcttaagctgtcgatgttgaatttgcttattttgtatttaattaaaaaggtgcatacagatatgtatgtagtgtggtttggcaatagttaaaattgggagcaggaaaggaaaattttagaaatcttggtttccaggcaaccaaacacacaatatcatatctgtgtaccacttgcttcatgttaagatgccctaaatgtaaataattgatggagcagagactaaaagaaccattatagtcagctgaattccaaggtccttgacctgagctcattaagctcaggttagagaatagggtggctgaattttcttagaaaaagagcccagataatatctggcatgtacatagatcttgaaaattagctggacttaagtaggcatttagttttcaagctttagtttagtgaatgtggggatcctgatctgtaatccttcaggaggcaaatgagctgcaacagagccatggtttctctccctctttctgggagccacccacccccttcacccaatacagaggacctaaggagtgattgattttataaaagatacagagtaacacactctgtatattcatcagaccgtgtaaataactaacttctagacctctcagatataaatacatctctttttacttcagaagctttccatgggtgatttcatccatgttcgtggttttaactcttgtgcttatatgaatgacttccaaatgcatacctccagcctcattctgtttcagaattagattttcgtacattcataggcccaactcaaaatgtctaaagtgaattaatctcttagctgtcttctcctccagagaagactactgcctgctctgctctgtcatgtcttgggtagtatttggcagtatcactcggctctttgatttcttgccctgttacccttacacgtggctgtttgccatggtctgtcaattctgcttcaatagtcctccctaataaatcttccctctcttctactcttagagtctctcaccttgactttttttttgtttgtttgtttgtttttgagacagtctcactttgtcacccaggctggaatgcagtggtgcgattatggctcactgcagccttgacctcctgggctcaagcaatcctcccacttcaaccttccaagtagctgggactacaggcacgcaccaccatgcctagtttttaattttttttttttttttatagaggcggggtttcatcatgttgccgaggctggtcccgaatgcaggctcaagcgatctgcctgcctcccaaagtgctgggattataggcatgagccaccacgcctggccttcactttgatcttgactcatctccctgtccctgatctttgcctgctcaagtccatcttctatacgcaaccatgattttctttagaaacacatttctgaccacattgttcccctttaaacacttggatgatgctttgtcaccagcaggataaagtctgagctctttgacttgacctactagccagccatgatctccttctccatcttgatgtcttgccattccccaaacataactttagaatacagcaattcagaactgcttttagttccctgaaaccaccataatgcttcacacaccctcacctgtgattgtgctgttctttcttactcacccttgagtctttattaattcttttgctttcaagactttgctctggcttttctagggtgcctcccttgatttcttttgctcacccatctgctgccatcccagattatgtcaattgactctaccctaaggtctccatagggcatcctgtgtctatctctatgatagatccttgcccactttattgaattcatctttaagctccttgaatggagggtctgtgttttatttctctttgtttccctctttccttgtgtggctcttgaaatcattatgaattgatctgagcacttccttatggaggcatgcagaattaacagcataattgtggcaagaaatgtctttgccttttctttttaatgcaaatgagagttagtaacatgttctttgtatttatcttgggtatccattgctgactaccagatcaccagatcaccccaaaactaagcagcttaaaacaataaacattttgtgtgtatgtgtgtgattttatttatttatttatttttttaagacggagtctctctctgttgcccaggctggagtgcagtggtgtgatctcagctcactgaaacctccgcctcacgagttcaagcgattcttttgcctgaacctccttagtagctgggactacaggtgtggcccaccatgcctggctaatttttgtttttttagtagggacagggtttcaccatatcgcccaggctgtgtcaaattcctgacctcaaacaatctgcccaccttggcctcccaaagtgctgggattacaggtgtgagcctgcccaaagcaatgaacatgttatttgttcatgattttgttggaaaatcatgggctcatgattgagttgggctcagctggatgtttcttctttttgtctttttaggggtcactcatgggtcctcattcatctggtcgcccagctgaaggtagaaggtctagaatgaccttactcacatctctggcaatttgttgctggctgtcagctctgcctccctctctcatccttaaggggactggccagggtttctttccatggcagtctcagagcagcaagagactaagggtgaaagttgcaaggtctttagaggcccaggcccgggaagtgtacagtggcagttcattaacattgtcttggccagtgcaagtgaccagaccagcccagattcaagggatggggagtagacttcatctagataggaggagccaccaggttacattgccaaggggtgtgcatacagggatgggaggaatgtgattgtttgttgctgtcagcacagtataccttactagaactgaattgacgtctctactttttgagcattttttgtacattgttgtggtatttctttgtggtagtcatctcacatgctttaaacttcgtatgtcttatttccttccttagtaggtcacattgggagctcatcttccccttcacttaggagacagtgcaataaacatttgtatctctcatagcacataccagatttttaaaatttggcgggttttaattcaggacttaaggggtgaattatcttattaaataaataactcaagtatacagggaagtgaaagacagtcatttacctaatgctctgaacatctttcttgagataaagtagtgctgtgaactgataaagttcacataaagctaaagaaattcctttatgtattaatattacaggcatttatgtaatatcagtatctgtctgaaaagaatgcattgattacaaaactctttaagttgtacagaagttatttttccctagaacttcaaaagtctttgctctgcaagggaggggagagtaaaaaaggtgccttaaggatgtagacatgctgtatccagcactgttatttgttgtcagaaatatactgataaacatgctaatgccaggccgggtgcagtggctcacgcctgtaatctcagcactctgagaggccgaggcgggaggatcacgaggtcaggagattgagaccatcctggctcacatggtgaaaccctgtgtctactaaaaatacaaaaattagctgggtgtggtggcgggtgcctgtaatcccagctactggggaggctgaggcaggagaatcacgtgaacccgggaggtggaggttgcagtgagctgagatcgcgccactgcactccagcctgggcgacagagcgagactccgtctcaaaaaaataaaaaaataaaaaaaatgctaatgcctttcttgcatattggatttggtctactgatgactttttttcctggagttcttagaagctgtgtgtaaccaaagggggctggagagtgagagaaagcaaaagatttggctagaagaagggagagaaatacattctggtttaggggctatgggtagacctaagtttttaccctgcattgtatctgaaaaacataaatccctgctgttaatcttaatatctaatcttagtctttagtgtctcttccttttcttttttccttcccttctcctcaacttttctacaaaaatatttatgcatctaaaatgggaagaattatttttgctcagactgtaaaaagtatatcacaggctgggcacggtggctcacgcatgtaatcccagcactttgggaggccaaggtgggtagatcatatgaggttaggagttcaagaccagcctagccaacagggtgaaaccctgtctctactgaaaatactaaaattagctgggcatggtagtgggcacctgtaatcccagctactctggaggctgaggcaggagaatcacttgaacccaggagttggaggttgcaatgagctgagattgcaccactgcactccagcctgggtgacagagcaagactctgtctcaaacaaagaaacaaacaaaaagtatatcacaaatattgttacatattcttctttaatacataattatgcatccctgaaagtggcattttgctacatagcctcaatatagttttcacaactcagttttgccctcttaaaacaagattgctggcaccatcttcactgatgaaagacttgtgtctaagaaggtctgagtcataacagatgcttctccatcttgctttctcatctttctctagtttctttttgtcctttttatctttttatattatttttctcttctccataatactgctttctaccctcttattggggtgtctgctctatgtgccaaatatgccataaattccttcatcttggcttccctcgggagagactaagagaagacactgcagaactaggtctgctcagaggagatcatggcctgccctcatgggaccatttggcgatgtcttcctccatcacgcctgcagtcactcctgtggacttagaggttgagcaagattttctgtcctgagagaacccacgttcatattctgacttggtctctgtgaagatttgaaaaacatttttttttcctgaaaagatacagctgtacccattgaagcaaacgtggaactctgttcattattttctcctttttattcattctcatgttcacattcactgtataatcttgtttgtggcttatctttgacttttatacatactacatagattggacaattttcctggtgatacggtactctcacattgtgaagggatggctcaatattaattttagagtggatgctttgaaatattatcaatgacaagattttagcattttataaccttcaaccaagcacttatttgggggtctgcaacattccccttatgcattaaatgaatgaatgattattttatacaactcacaccaaatctctttttttaaactcatgttttcacttttattttttgattacttgtaaaagaatgctattcttgatctactgttacctactgtttaaattgtatggtatatatatatatatatatttatactttaagttttagggtacatgtgcacaacgtgcaggtttgttacatatgtatacatgtgccatgttggtgtgctgcacccattaactcgtcatttgcattaggtatatctcctaatgctatccctcctacctccccccaccccacaacaggcccccgtgtgtgatgttccccttcctgtgtccaagtgttctcattgttcaattcccacctttgagtgagaaaatgcggtgtttggtttttgtccttgcgatagtttgctgagaatgatggtttccagcttcatccatgtccctacaaaggacatgaactcatcattttttatggctgcatagtattccatggtgtgtacgtgccacattttcttaatccagtctatcattattggacatttgggttggttccaagtctttgctattgtgaatagtgccgcagtaaacatatgtgtatgtgtgcatgtgtctttatagcagcatgatttatagtcctttgggtatatacccagtaatgggattgctgggtcaaatggtatttctagttctagatccctgaggaatcgccacactgacttccacaatggttgaactagtttacagtcccaccaacagtgtaaaagcgttcctatttctccacatcctctccagcacctgttgtttcctgactttttaatgatcgccattgtaactggtatgagatggtatctcattgtggttttgatttgcatttctctgatggtcagtgatgatgagcattttttcatgtgttttttggctgcataaatgtcttcttttgagaagtgtctgttcatatccttcgcccactttttgatggggttgtttttttcttgtaaatttgcttgagttcattgtagattgtggatattagccctttgtcagatgagtagattgcaaaaatgttctcccattctgtaggttgcctgttcactctgatggtattttcttttgctgtgcagaagctctttagtttaattagatcccatttgtcaattttgtcttttgttgccattgcttttggtgttttagacatgaagtccttgcccatgcccatgtcctgaatggtaaagcctgggttttcttctagggtttttatggttttaggtctaacatttaagtctttaatccatcttgaattgatttttgtataaggtgtaaggaagggatctagtttcggctttctccatatggctagccagttttcccagcaccatttattaaatagggaatcctttccccatttcttgtttttgtcagatttgtcaaagatcagactgttgtagatgtgtgatattatttctgaggcctctgttctgttccattggtctatatctctattttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatccataaattaccttgggcagtatggctattttcatgatattgattcttcctatccatgagcatggaatgttcttccatttgtttgtttcctcttttatttcgttgagcactggtttgtagttctccttgaagaggtccttcacatcccttgtaagttggattcctaggtattttattctctttgaagcaactttgaatgggagttcactcatgatttggctgtttgtctgtttttgctgtataagaatgcttgtgatttttgcacattgattttgtatcctgagactttgctgaacttgcttatcagcttaaggagattttgggctgaggcgatggggttttctagatatacaatcatgtcatctgcaaacagggacaatttgacttcctcttttcctaattgaataccctttatttctttctcctgcctgattgccctggccagaactttcaacactatgttgaataggagtggtgagagagggcatccttgtcttgtgcgagttttcaaagggaatgcttccaggttttgcccattcagtatgatattggctgtgggtttgtgataaatagctcttattattttgagatatgtcccatcaatacctaatttattgagagtttttagcatgaagggctgttgaattttgtcaaaggccttttctgcatctcttgagataatcatgtggtttttgtctttggttctgtttatatgctggattacgtttattgatttgcatatgttgaaccagccttgcatccctgggatgaagcccacttgatcgtggtggataagctttttgatgtgctgctggattcggtttgccagtattttattgaggatttttgcatcgatgttcatcagggatattggtctaaaattctctttttttgttgtgtctctgcccggctttggtatcaggatgatgctggcctcataaaatgagttagggaggattccctctttttctattgattcgaatagtttcagatggaatggtaccagctcctctttgtacctctggtagaattcggctgtgaatctgtctggtcctgggatttttttggttggcaagctattaattattgcctcaatttcagagcctgctattagtctgttcagggattcaacttcttcctggtttagtcttgggagggtgtatgtgtccaggaatttattcatttcttctagattttctagtttatttgtgtagaggtgtttatagtattctctgatggtagtttgtatttctgtgggattggtggtgatatcccctttatcattttttattgcgtctatttgattcttctctcttttcttctttattagtcttcctggtggtctatcaattttgttgatcttttcaaaaaaccagctcctggattcattgattttttgaagggttttttgtgtctctatctccttcagttcttctctgatcttagttatttcttgccttctgctagcttttgagtgtgtttgctgttgcttctctagttcttttaattgtgatgttagggtgtgaattttagatctttcctgctttctcttgtgggcatttagtgctataaatttccctgtacacactgctttaaatgtgtcccagagattctggtatgttgtgtctttgttctcgttggtttgaaagaacatctttatttctgccttcatttcgttatgtacccagtagtcattcaggagcaggttgttcagtttccgtgtagttgagcagttttgagtgagtttcttaatcctgagttctagtttgattttactgtggtctgagagacagtttgttgtaatttctgttcttttacatttgctgaggagagctttacttccaactatgtggtcaattttggaataagtacagaactcacaccaaatcttttaactacccatgcttctagaagctttcaaggaatcaaaaaggggctatattaaaatgggaaaaaataggaagaagcttagaaataattttaggaaaggtattacgtttaagcatagaactaagtaggaagaggtaagtggcaaaacaacaataacaacaacaaaagagtctaatcagtatgtggtggaagactactacagtgagtagtactttacagtgttaccaattaatgcttgtccttttttgttctctttttctttgttgtcattgtattttccgctgtctcttgatttatcagcaaaaatacaggcacatttctaaatttgtgttagggtttcctgtagcatggtcatatgtcaccagtgagtcctctgactctgaattaagaaaacatgggcttaatatgcagaacactgaaactggaccccttccttacaccttatacaaaagttaactcaagatgggttaaagacttaaatgtaaaaccccaaatcatgaaaaacctagaagaaaacctaggcagtgccattcaagacataggcatgggaaaagacttcatgacaaaaatgccaaaagcagttgcaacaaaagtcaaaattggcaaatggaggatctcattaaactaaagagctcttgcacagcaaaagaaactacagtcagagtgaataggcaaccaaagaataggagaaaatttttgtaatctacccatctgccaaaggtataatatccagaatttacaagaaatttaaacaaatttacaagaaaaaaccccatcaaaaagtaggcaaaggatatgaacagacacttctcaaaagaagacatgtggccaacaaacatatgaaaaaaagctcaacatcactgaaaaaaagctgaacatcagtgatcattagagaaatgcaaatcaaaactgcaatgagataccatctcacgccagtcagaatggcgattattaaaaagtcaagaaacaatagatgtgagcctgtggagaaatgggaacactttcacactgttggtgggaatgtaaattagttcaaccattttggaagacagtgtggcgattcctcaaggatctacaaccagaactaccgtttgacccagcaatcccattactagatatatacccaaaggattataaatcattctaccctaaagacacatgcatgcatatgttttttgcgtattattttcaatagcaaagtcatggaaccaacccaaatgcccatcagtggtagactggataaagcaaatgtggtacatgtacaccatggaatactatgcagctatgtgaaggaatgagatcagatcctttgcaggggcatggatgaagccagaagccatcatcctcagcaaactcacacaggaacagaaaatcaaacactacgtgttctcgtaagtgcgagttgaacatagagaacacctggacacagggaggggaaccaacatgcaccagggcctgttgtggagggaggcaaggggagggaacttagaggatgggtcaataggtgcagcagaccaccatggtacacatatacctatgtaacaaacctgcatattctgcgtatgtatcctggaagttaaagcaaaattaaaaaaaaaaaaaaggaaaacatgggcttaaataggacacaagatctattcctcctttgaaaaacccattaagtttggataaattctaagaggtagcattttaactagcatcctaagcacttcctcacatgctcatagtttgcaagttaacatgatgtatgtgtatttgtgtatttcaaactccggaagcttttgtattattgaaaccaaaactgacaagaaaccttctgtgaacatgcttctgctggggtgtagaaagctcacagagtgttgccttcatgcttacaatagtaaaaaatccagatagtatacaaaatgacttttcttggtctcatcagagaatttcggtcatagagcaactaactagcctgaaatctaaggaaaaggtatgagtttccaagtagacaggacaagacatttgcttaactggagtaaatgctgatgctgatgtcacataagctagtaagaaaaagactgagttatgttttaagtactaaaagctgaatgtatctcagcatgggacctgcagctgcaaggagaattcagttacatgcaggcagttctctacagacctcaccttgtgctcatggggaacactgggggcaaggcaagtgatggaagaatggcattcttatggaggcaagcagcaaccactgcaagaaaggcatgaagccctctggatccttctctaaccctgtttctcttgtggaacaaaagccttaagctcctgggggaagggcggcaaactctaggctcaggggacaggtggagacctatttcagctaggggaaaggaacaggaaaattgctgtacctttggaggagggtcaaagaaatattatccactgggactattagagatctcctaacattgtgggaggaggtagatcacttggaacgtcctacccctatacccaggcaaacggatcctgcctaagactgaggttgaaccagaacaagagaatacttcctctctacatacaccaggatgctaagctcagagtaagaaatgctgatggtctactgctaggggagtggggagaacatggagaaagacctccctaaggtacaggcacaaagggaagacctaaagctgagggtgaagcagacattgagaaaaacactgtggcaaaccagccccaactgaagaacagggtgacgccaaggacacatgaaacctgtgatgtgcagaggctaataagcctaaattcagctctcaactcctgactcctgactaaattgaatcaactccccacacttaagattagcaggatgcgagacatgttcatttccaggcacaaatactacatacctcagtctctatagttctgcacaagatggctggcttttaaccaaaaattactgagatgcacaaaaagtgaggtaaaacaacacacataaaagaaacaaagcaatcaatagaaccagactcagatatgaaccagatgttagaactatcagagaattttaaataactatgatcaatatgttaaaggttctaagtgggaaaagtgggtaatatgcatgtacagatggggaatttcagtagaaaaggtgagattacaaaaaagagtgaaatgaaaatgctagaaatgaaaaacttagtaacagagatgaacgatgcttttgatacctccttggtagaattgatgcagttaaagaaataatcagtatatttgaagattggtcagaagagatttatgggaaatctgaaacacaaagaaaaaagagggtgtgacaaaagacccaaaaatgttagagcccctaagagctttagtacaatatcaaaagttccagtgtatatgtaattagaatcccagaatgagaagtgagtcaatagtgtggtataaaatagtgcaatacaaaaaatatttgaagagatgatagtacagttttcccaaactaatgacacataccacataagaaatccaataagctcactaagcagaatgaataccctgcaacacacatacagtcagacatattgtattcacactgagaaaaaacaaaatttcaaagtcaaccagagaaaaagacacattatatacagaagaagaaagatgagtcaaagcagacttctcatcagaattaggtaaggttacagtgttaacagaataaactgtcaacccagattcctatgtccttcaaaatatccttcaaaatgaaagaaagcaaatataagtgatcttattactcttcatttcactgccaacatttaaaaatcaatggaaatgaagataaggctctggtctcaaccacattgatctgaactgacaactgcgataaataagcagtgtgtcttgatttatgaatttgtctgtgatgtttgagttttgtttaatcctaatacatggtatagctttggtggtttttaagggtggtgtacttggtacctatatcagccaaggttttctagagaaacagaaccagtggaatggacaggtgtgtgtgtgtttatgtctgtgggtatatgtatatttatgagtggatggaatcaagagatttatttcaaggaattggatcctgtgatcttgggaactgacaagtgcaaaattcataggacatgtttgcatgaaaacccctcaggcaggaattggtgctgcattcttgaggcagtttctacttcttcagggaaaatattaattcttgcttttgaggactttcggttgattggatgaggtccccccacattactgacaataatcttcttaaagttgctgaatgtagattttaagcatatctacaaaataccttcacaacagtacctagattaatgcttaattgaataactggatactattgcctagccaggttgacatataaaactaaccatcacaggatccattattagaattgtgggaagacctaggttttcttctagggtttttatggttttaggtctaacgtttaagtctttaatccatcttgaattgatttttgtataaggtgtgaggaagggatccagtttcagctttctacatatggctagccagttttcccagcaccatttattaaacagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagttcaggacgtaggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcggtgtggcgattcctcagggatctagaactagaaataccatttgacccagccatcccattactgggtatatacccaaaggactataaatcatgctgctataaagacacatgcacacgtatgtttattgcggcattatccacaatagcaaagacttggaaccaacccaaatgtccaacaatgatagactggattgagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacagtgaaatcacatggacacaggaaggggaatatcacactctggggactgttgtggggtggggggaggggggagggttagcactgggagatatacctaatgctagatgacgagttagtgggtgcagcgcaccagcatggcacatgtatacatatgtaactaacctgcacaatgtgcacatgtaccctaaaacttaaagtataattaaaaaaaaaaagaattgtgggaagatcgacagtggaatctttgcaaaacaatggaattgcaactgtgaactacattttgattgtttgtatttttagcggagtgataagaatgatcccagactgaagatgcacattaaataagctggtaatagtaagaatttaagatgtaaactagcattaaaaaattctaagcctttaaatatgctctctcacattaagtgtatgctttgatttttcttataatcatttcatcatctagaaccatttaaattttgagtttttttcaatccaatttcacttaagcagttacgttttcattgaaatcattggattagcagaattggtacaaggtattgaaagtttgcagttcactgtgacttcatctgcaagtgaacaagtattattttgggattttgtgagaacaggagagccttaaaagtcattgaagtacagtattgttgcagatattggaggaggagtatgctgaatggtaacactgagactgtttttgactctgtaacagggtacataggttcaatacaaacttttttaagtgcagcaaaaaaaatttcaattgtaaatacaattgtcaacatacagcatagtggagttaaaaaagcatgttcttcatagtatagtcctgaagttctaatgataaaaatcagaatgttaaaaacaaactataacatacatatagttgaactgaaaatcatgttccctatagaaaataatggtatttctttgtcctggtgataaagtttaagtcgaggatttgtctttgccccccgaaaacattattttgctgactctgataatcatacttgttaaaccagagagaaacaatgatggatgtgaatctcaaggcagtatggggaaagggtctcaaagaccacttattatctgaggcatacaatttagaaagtaattatcatatttgttaccatggcgaggattgctgcctacagccagttctgttatgtaacaaaattcatttaagagatgcctgacagtatgtttctgtaatgctctagtatttaaaaagtaagggcaaagattgtgtctcatagttcagtatcatagtagctctttttctagtatacaagttagccttctgctccctgctttcacctaagttcatcttttccagtctctgtctacttataaaattaaaatacctctgaacttgttttgaatttgttatgctacttagcaatgggtgcctcatgtcgaggtgtaccaagattatctggttctaaccattgagttcaattttatgggagactcagcatcacaatgtggcagcctttttggccaaattttcaaccactggaattgccttttggggagttattttctgtttacgtagtattttctatagcttgctttgatcaacggtgaaaaaaaatgtagtttgggatggaaaatgggtgaaaggagaatattagatataagagaagtaacgtactgtttaacaggtgaagctctggatacattatttataagcaggagaagacaaacgaaaataagacccagtgtgaaaaaaataacagagatcgtgagcacacctagtgctcagctctggtttccaataccatccttcagtaaaaggaaccagggcacctcggagaaatggctgattctagtatgggggcaggaagcatgcaagatgagcctggagcattttgtagtgcgagagaggaaaggggtgctaaagaataaaaactccagagaacatgctgatgggagtatgtcaaagggatacagaagccagctcaaagagctcctaatggccaaagacagaaaaatttgaacagaaaaataacatagtattggatcataacctgacgtatcaaataaatatctatgagttcatactgatggaagtaaatgatgggataaattaataaatgggggagaagacacatacttcctgtgcagaggaattgcaaattatgcactctgttctagcatacctgcccactctttaagtgtgacatgctcatagagacttcctcttgaagcatacagaatggagagggggtgcagtgggagagtcactttacagtggagaaacccacacacactaccccagccaggtgatcaaggtgtacgtcatcaacagtgataaatcatgttgatagtgtgttcccttaatatgatgtgatgaaaatggcacttcacctctgtggtcttcctcccttaaactcccacctctagtctcatcatgagaaagaaacaccagaaaacccccaacagagggtcatcctataatatacctgatcagtactcctcaaaactttcagggtcatcaaaaacaaagaaaagtctgagaaactgtcaaaccaagaggagtctaatgagatacgaaaactaaatatgtggcaccctgaatgagttcctgtaacagaaaaaaatggccactaggtaataaagaagcaaatctgaataaactgtgcactttagttcataataatatatcaatattgactcgtcaattgtaacaaatatgccatattaatgtacagtgctaataagaggggacatacacattttaaagcccagtgcagatgacccctccttttgagtgtcctcaccatagcctacaaggccccatgtgatttggccctttcatctctctttaattgcatgtcttagcccctcctccttagcactgtccctgctactctggcctggttgctgtcccttgaatatgcaaggttattcctgcctttcatttgccatttcctctgcctgaatcttcatgtatatcgtttatttcatttaggtctttgggcaaataccacctcattagaaaagcctcttctgaccttcctgattataatagtatctcctgcagtctataaccacaaaacttgtgttctttgtcttcataatactcagttactgaaattatttatttattttaacttcttatcccactagaattaggcacatgaattcggggactttgttaattctgtttgttcctctgtctgtagcaactagaacaactccaggcaagtggtaggtagcactgagtaaatatcatgtgaatgaaagaattctcaaattgtgccccttagtttcctctgaatgcttaaccgcacattctgtgtgactcttggaaagattgttctctgctgtgtgttatctttttgtgcctgtatgagactttgtttcccttctggattgccaaaactgcagcagttgtatacctctgatttatgtctacacccccacaatatctagctaggtgcctggcaaaaagaagtgactgctcagtagcgtttatgggataaacatgtgtttctgctttggacctgtccttttactgcattcagcattcccccgggcgaggcctcaggcactgcataaaaagttgaatatgtctgactttgtttttatggactcctccaagctttatctccctatccactatctgaacttcgtgctgcagctcccttgattttgacctctttggctttggtcttggtttcccccacatcacatgtcctctttagacttgacaacatcactcccatttttaaaaacaaggccctgacctagacatcccataggatctcgcctcattctgctcaaaaattatgttgatgaggcccaccaagctcctgtggccagctaagcccaagacaggtgttaggacctgtgagtggaagcccagtggtagaaatgtgcactgtggcttgcatgtggcaatctacctaatgggagaattactctctctccattctttcctagcccgtcacatttattaagaataacatgaaaagtgccgggtactaggggcacctatgtgaataaaatacaaaggctgaagaactcatagtggaaacacatggtctccatatcatgagaatcattatttatcctctagaaggccagggaatttgttcatgaagcttaacccagagtcctcttgtctacttagaagatcttgccagaatgggttacagacatagtgattagctggaagtaaacagacttctgcaacctagccttcaaaaaccttactaccgaagtgtggcaaatattatacttttaaataatttcttccagtggagaaaagggcatgctttgtgaaacagagacttctgaaacctcttattaccaataagaaccttagcatgctagggtaaagttaatgatgaattggtctcggcaggtgccacaggctagattttctgccatttagtttttgtgtttctcacttgccaaggggtgactgagtgtttttcattgtttatttcctgttccagttgttgctttatagctttttccagttttcttctttctctttgagacataaattggtcttttaattcctactaaccctaattctacttttattttatctatcagaaaatattgccacagttatcaataaaaacattggaaagatgtgttttgtgtgtctcttttaaatttgttggacagataatagaaaattagatagtaatatattgcttagaaaaacgtacttaggacatttcttgctaaccttaattttttgggcggcctacaaacaaatccctatctaattgatttttgtcagggtttataacgttctaagcctgatcttcagttgatttgcgtatgactcccacatgttgaaaccaaaacactcagtttattgaacatatgaaataagactggatttttaaaaatctgcaaattgagttgctttcttctagctctcaaaaaattgatgggatttgcagtcagagaagattttacactaacatagttggtattttattaaaagctaatttgtactattcactaacaatatagattatagatttccttatttttcctggaactttgctctttatcttgtcagtatttgatttggactttaaaattagtggttttgtacacttttgacagttattacaaagtactatatattccacataaactgcctgatgttctttgagagtacatactgaaaagtttttttcagccaacagaagaaatggaagacgaggacctaatttgacaatatctataaaaattacaaatgcaatctatttctcagaattcatttctgaagtattctttcatatgtgtggcatgacctgtgtgcacatttattaaatacaacatttttgaaatcgtaaagtgttggaaagagaccaaacaagtatatattaatagaagatagactaagggatggtacatctatatagtggaatatgcagatgttaaaaaagtagagggtgcttgctatgtatggatatgggggacagcaaggtgcagaatatgcttatctgagcttttgagtaagaaggagtggtatacaatggtattcttatttgcttttttttttttgcctgaagaaaccctataaagatatttaagaaactattacatgtgcttgcttgtaaatattacttggagaagccaggtgtggtgactcacacctgtaatttcagcacttttgagaggccaaggtgggtggatcatttgaggtcaagagttcgagaccagcctggccaatatggtaaaaccccatctctactaaaaatacaaaaattagctgggtctggtggtgcatgcctgtagtcccagctactgggaggctgaggcaggagaatagcttaaagacaagagacggaggttacagtgagctgagattgtgccaccgacctctagcctgggcaacagaggagactccatctcaaaaaaaaaaattacttggagaaagtagggcagctaggaggggcagaggtggataagaaatatttttcactgtatactttttattactgtattagttggttttcacactgctgataaagacatgcttgaaactaggaacaaagagaggtttaattggacttacggttccacttggctggggaggccccagaatcatggtgggaggtaaaaggcacttctaacatggtggtggcaagagaaaaatgaggaagaagcaaaagtggaaacccctgataaacccatcagatctcatgagacttattcactatcatgagaatagcaaggggagagaccagctattcagttacctccccctgggtccctcccacaacacatgggaattctgagagataaattcaagttgagatttggatggggacacagccaaaccatatcaaatagtgttttggttttttagccatgccactgtattgtccattgaaaataaaactttttttaagtattggaaacttgcatgtatactaatattgatagtgggttttggaaatttactgagtgtctgtttttgagcagaaaacgttatgtttggacacatggatcagggtcctccttttgagacttttggttgctggtgattttttctccagtggcaagtacttgagcatttcttctgcaacagaaaccctaccatttaggaggcttaatggatgctcttttggttgcattagatggatgaagaaacaaagatgaactaaatatccaacttctactttctaggagttgccattacttctgtgtaaaatagggatagaaagtttttgttttattttgtttacttctgtgtaaaatagggatagaatgtttttgttttattttgtttgcagaaatgcgaatggtgtaaagcttcttcaaatatggacacacacatacacacacacatataaaaagaaaggctgcctttattctgccattttatacaagaatctttctacacataaaactggacagcaaaattgctacctgaaaatttgtaattcttttcctagatgatatttttcaagaaccaaagttgctaagaactccagttctctgctggatgaatcaagcgagcagtgaacgaaatgcctggcaaggcttttgatgggagaggagtctcattttgctttcaggatagacactgaacatcagtacatttgtaatcgtggtaaccacccctgtcttggttagagctttcatggtaataatttaatttctattgataaaagaatttattactgaatgtatagtggagaagaggaagcttattaatgatctgaatttatgtgaagtgtacgctatattttattttcctactttcttccatgcctaataatatttttcaagatttttagtggcagtgcttctctcgtttttctagttggaaactttcatattattcagaaagaaaaaatcctggtaaggaaattggagaccaattttctgtattagtctgttcttatactgctataaagaagtacctgagactggtaatttatgaagaaaagaggcttaattgactcacagttccacaggctgtccaggaagcttgtcttggggggccttaggaaacttaaaaccatggcagaaggtgaaccggaagcaagcacatcttcacaatggcggagcaggagagagagaaagagagagcaaatcttggaatatactaagagtctggtgttgattgcctattttttaatgctaataagtaagtgttctttttctctgggggatttcttaactgttctattgtaaaagcaactactataattgccttttataatacccagatcgctggatttgctatatactagacttgatgtacctgaagctgctaacaggattgcctgtcatttagctttcagaattcaatttataaaatgtcattatttttccccttccactgcaatactagagctgaagacagacagggaaaagcaagcaaatatttgagagtgtgaatggtataagttgagggtatgaatgttggaaatgaacatattcacctctaaataaagtgagagaaaccgctattctttctaaattttccatgtgccagtaaaatgggaatggtgatttccttaaggtattgctctggagaatttaaataattgagttaaatgtcaaacttcacatttagagagcttactaaaaccttcacaagtgggggcttacagactagagttttatttttatttttattttttctgtagggaatggagtaggggaggcagtggcacacttaggtgataccttgcacagcagtcacaatgttgaaatttgaagaaatctagtgaaaattataaaattttcactagacatgaataaatcattatgaaagaatataaaaatagccagagatcactagaggggaaagaggcactgcaaaagttactggagggaatacaagagaagaaaataattagaaaacagtcagtaagaaatgtcatcccattctgtcccctggctgctttttgtggctttgttcagtgggtgaaaattctggagtgtttattggtgtcttgtagcataagatgaaatatcttatcaagatattttcattttctcaaagtgaaatgcgatccctttaacttcttaggatgacaggtacatgtggaagcatcagagaggaacttgggatcccacgagctagcctctgcttcatacacagtggagtagatgcctgaggttgtcagcaaatattgaagatttttatttccagggggttagaaacttcacgtagcttctctgctctgcacacataaggagtaagtggattattttccctgagtcagtaaggttttcggtgtcacataatctcaggggaacaaatgcaattgcttagatctcaatatactcctcagatggcaactttgaggaggtaaccaggaggtatctgcactccctctgtgctcgcctggggccttctgactttctctgtaaaaagccctttctgtattgatgctcccgggtggtagtgggttggatggccattacataatcacaacctctttttttcagtcagggtagctattatgcagagagctaggagtggattacttcttggcaggaataagcacagaaaaatctatccagatttttttaaaaatggaaacattgtgaaaaaaatcttgatgtctctgaaattggaggatggtattttatctgaggaacatgggtagggaatgttggggtcatttcttagctctgaccttagtaagtcatagaggcctttttatactgatgttgcatttttaaaaggcatcttgacatgatgggagaaaaacagcagaccaaaagaaggcagacctgatagttctagttcaggctgtgttgttgtctgagttgtcctgcaagctgatacaaatcacaacttccccgagcctctcttttctcatcccttcagtgaaggccctctgtaatacccaagtcctttccagttctgaagtctgttcaaagtgggggcagctggaggactcagggaggtccacactaaagaggactttttttttccttttttaaagagaacatttttaaaatctagctttataactcaaggatattttaaatacagataactattacatttgtattttgtaatgaatatttcagatttatgtttgtgccttgaagctaattgactgtgaagaaaacggttttataaacaaagccaaagagaaagtattcctggatgtattacagcagacaaataatcactttactactatggtatattagtccattctcacactgctatgaagaaatacctgagatggagtaatttatgaacagaagaggtttaattgactcacagttccacatggctggggaggtctcaggaaacttacaggcctggcaaaaggtgaaggggaagaaaggcaccttcttcacagggcggtaggaaggagaagtgccgagcaaagggggaaaagccccttaaaaaaccatcagatctcatgaaaactcactcactataatgaaaacagcatgggggaactgcccacatgattccattacctcctactgggtccctcccgtgacacatggggattatgggaactacaattgaagatgagatttgggtggggacacagccaaaccatatcacatagctttggattatcccttccttttttcgatttttcatagcccattttttgtggatgctaaaaccaaaattgctctccacatgcatagcatatccataaccctcttaccttccatcactttctgggacttgttcttattttagagtgacttttaaagactgaacatgcagaagcctcattgcctcttagaaataaaggatgcccttctgggaggatgtactaagtccagtgttggaaccttgatactgtcctgggctgacatttcctctttaagaatcagctccctcacaccacagggtattagagaggccacatgggctgtgaaaaccgggcactcagggctggatagattgattgctaacaaacatatagtctgctttcttcagaattagtagctggctttgcaccttcaacttgagcatgagctcaaatgcatttcttttttttttttttaaggcggagtctcactttttcacccaggctggagtgcagtgacatgatctcggctcactgcaaactccgcctcccgggttcaagggattcttctgcctcagccacctgagtagttgggattacaggtgcacgccaccatgcctggctaatttttgtatttttagtagagacagggtttcaccatgctggtcaggctgatctccaactcctgacctcgtgatccgcccaccttggcctcccaaagtgctggtattacaggtgtgagccaccgtgcctggcctcaaatgcatttctatacaggtccagtcagagtagtggccagtcccactcatgtgttcaaaatataacctgaggaatgcaaagcaacatgtttagtcttttgtcttaataattcctctattagcaacttcattagacatccactagtacataactttgtcactgaaaccatatcattgccccccgaatagccttctagactcctaaccttggaatgcaccaaggaatatttaaactgtctcatagttttgcagaagcagaaaatgctaggattgtaaccctgatgatcagttctccctgatgacttggcctgtgttgcgcctactaaattcttcttgtcttctcctttgctctattgtcatgatattggttgaagggaattagtaaatcagactggcattgaatctctgggagctagaaaatgggctaagatttagatggcatattcactttctgcgttccgtttgtctgtgtgcttgttcttattcattcctaattttttcctgtagctagtcttttaggattttggtgtcaaccttacatataattgcctgggtacttcctgaggtgatcctgctgattttagaagaagtgaaagggaatattacatatggtagtagaaggagtcctggataggaagactttgcagtcctggcttcaagtccagatgcaggcagtcacttgtcactttggtcaacatcttaaggcctccaggcttcagttaccttgtctaaaacaaggcaccttctgcctctgaatttctgactcataaaatggtccaagccatattgtcagtgattagtgcttttaatatcagcttcatacagaggtagctttccaggctgctctaacttttggattacataacagagatagagtgcctgatggatggatatctcggtatctggcatgttatggtgagtgggagacagccagaagaaaatccttggaaagtatttttttaaatctgtgtgaatatgtttatattgggatggttctgaattctaggttttagataaactaagaaaattggatgtaatatgaagagataaaattccatgagctgaagttgatgagtaatatacaactaagagaggagaaaaggaaataagagattaaatgagatagagaaaaataatgctgggcaggccatttaataaattctctgactttgtttctgcttatgcagaagaggtggactaaattatacctgaactcctctgttctgtgaaggtcacaagtacagatgtttctaaccttgaagggaagtaaggtgtttattcatttttttcttttagcttttgttctttccctaaagatagagaatatgcaaattattaaaaaatcaaatacaggccaggcgcgatggctcatgcctgtaatcccagctctttgggaggccaaggcgggtggctcatgaagtcaggagactgagaccatcctggccaacatggtgaaaccccgtctctactaaaatacaaaaaactagccaggcatggtggtgcgtgcctgcagtctcagctacttgggaggctgaggcaggggaatcgcttgaacctcagaggcagaggttgcagtgagccgagatcatgccactgcgctccagctaggtgacagagtgagactctgtctcaaaaaaaaaaaaaaaaaaaaaaatcaaatacagaaagacatgggggaggaaaagccaaaattcggtgaaatattcctctctgtataaaaccatgattgagtcactgtcagtcatttggtaaagatactattagacttctgtgcaagcagcatgaactgttgcatagcattcaaggtgaaggaaacaagcagtcacagcttatatttttccaaactaaattaaatccaactgaaatgtatacttgccagactgacaggaatttcaatatcaccctccagggatattctctcctgtgcctagtttgtcagccccctaaccccaatccccacacgtgtgtacagtctagaaaggaatttcgctgaaatctgctttcaagcagagaagagccttaccatccaccaatctcctgctgccatccctggcctgccctcagccttactaccatgtggcaccactattgagcactagcccctcttggctgtccagtagtgcttgcttttgatactgtgaaatatcatgagcttgagctcccagcaaagaccacgtgcctctttgaacaagggcagctctattagttcagtgcatcatccattttctgtgttacataatatatcattgatggcatgtgccatcatttattcagccagtcatctcatggtgaatgcatagatcagcattatttataaagtgtcacgatgaacactttacatgtatctttggccacctatctgtgtttttagagctaacactcaggagttatgttgctgtatcaaaaggtttacctgttaagttttgacccctattgcaagtttgcattctggaatagatgcaccagtttacattcctgagagtgcattggagtgcacttccttgtcacgcttgctgatgatctctgtgcaagaagaaaatagttctggctaccacaatctcagaagaagaacatatggtcatacacatggcaacattatctctagagaacttgggttcctctggtattcaggatccatctgctagggatttattatttttcttgtttcccctctctaagttggtgttgaattggtcatgttgacccacttaaattcagaggatgagctattttatttatctcatgttctcttaccatatttgaaggaatggccagatttttctcagccttccaaccctttcactgtgttttgtcgtgtatgtaggatttacccagtagcaaaactgtaaattcagggtcttcaagctaaaacttcctaaagcaataccctaagactcagttgtgaactgaaaaatctgtgggactctagaggagcggaagatctgccccttggcctcttggttccctggattcctgtggttaggttagctggaactaattgctgaatatttgtttctttctgaagttaaccagttattttcttatcttttgttctttagccagattcatttgtctttctgactttttcatgatttttctgtattttacccttattctttagaaatgtttctctattctgtgcttgtgattgatttctaacgtctcctagaagttacaaagggcctgggttaaaatcctgtcagcaataacgccatatggtttcctagatgctctgcacactaaagaaaacacttattctgatattttaatcaaactctgaggacttaaacatatggtataaagaatgctagttaatagctttttgtgttattttaatggcaaaaactgcaattatgtttgcaccaacctaaatagaaccatatcagagtagcagaagaactcatctcaaagcctgtcttagagaggtggatggacctgtgcactgtgtttcatcatgctaatatggaatgtgcctgcctttgggcaactcatttcatagtgggccttaatcccaattggtaaaatgaactataacctttcatcattccatagattcagcttaaagtgggcccacagaagaagagagggtagagagtgaaaatggagtcacaaacccagcagagaatcctccctctggtttctgaataaacattgtatacacagaagaaatcagtacgcagaaccttcccagaggaatcagactgactacaaaagttgaaaatctcttgctacaaaatacttagaaatgatggataaaacaaaacaaaaatgttttcattcatagcaaaagtaaccagaaagtgttatcaggagcctaaaatgaagagggaaaccgaagacctgagctgcttcaggaggagtagtgaggggagaggtggtagcaggtagtgggtgagggtaggacttgagtatatcgtgtatcatttggggcctctttgtggggagagattggaagtgagtcacaagcatgagtatagaaattggggaacaggtagtaaaataattaccgtcattcgatgatatgattgtatacctagaaaactttatgggagcaattgaaacaacatgacgaacaataagcatgttcattttaacatacagaaatattagcatatgggaatagcctacatagatgcgaacagccaccaattagaagatatcgtggaaggaaagatctcatttgcagtagcattaaacaaagataaaattcctagctataaatgatataatttttctatttaaaaaataaatataacacatgtatgatttttcctagaaaaagacatgagaaacagaaaagcataccatgttctttttatgattgaaaagacttagcatcataaaggagtcagctttctctaagttaaactgtaaatgtaatgtgatacttatacaaaagataatatttttagtaagataagcctattataaatttatggaaaaatagtaaagtatagcccaggaaaatataaggaaggataataaggaaaactagccctaatatatatttaaaaacattaaaaaatctttgatatttaacatagtgtattactagttcatgaagaaacagattaatagtttaacataagatacaagtgtatttcaaatcactaaaacaaaatagataataaatggttttgggaaagatggatagtctgcttggaaaaaaggttggatccataattcacatcttggatccataattcacattggcaggaccaggaaaattttccagtggaataaataaagatttaaatgttaatgaatgaaatcataaaaatcacttgaagaaaccagtgaagaaatttgaaagtagttttgatctgatggaagcttttctaattatgatcccaaacccagaaactataaaggaaagaatcaggatatatgtaccgatataaagaggagaaatgttgcacagcaaaaaaaaacacccatgagctgggtcacgaaaaaatttaaacagatggaaaagcaaggagcaaaacatagtgaaccctcttgtttccatctcccaatttcaaccatttcaaactcatgactgaatttctttattttgaaggtaatccttgcttatcatatcattgcatctaaaacaacctgcatgtgaatataaaagagtccttttttccctcaacacattaaaatgccattattacaattaggaaattagtgattccctaatattcatgatgatttttaaggcataggaaaaatgagtcttccagtaagtaaataatgtccaccgaaatatctaaaaggcacaatctgtgatttcagaaatggtttttttaaagagattaatatactgcagaaatttctattaaactaaatttagacatgcttccccctttcagtgttccaaatgccctgaatctgttaatgccttgctgtcagctggttatgccacttgattatgcttttgttaatcctggatcttgctctgacctgaaagaagcccattactttatcctgccttaaaaatcgcttaggactgcgacagatgatggcccagcagtctctaataaatccctcaagatggggacacatcagacattgtcaggaccctcaagctcttgaaggaggattcaacagagatgaaatgtggaggtagtagtagcctgggtgttgccagaatttcccaccctttatcaaatgaaaatgagctgcattatttgggtagggaatgattttaaggattgtatggctcggggaaaaaaaacaataaaaatattttataaataactagcttgagtgaatctcttttcataaaaatatttaagatgcatgtgatgtcaataatgagtgatgttgaattttgatgtaataatcacaagtttgaatattaaaattagtgtgtttagaataacatggcagtttcatttccaaaagttgaggaggagggactcctccttaactcattctgtgaggtcagcatcatcctgataccaaaacctggcagagtcacaatgaaaaaagaaaaacatcagtccagtatccttgatgatgaacatagatgcaaaaatcctcaggaaaatactagcaaaccaaatccagtagcacatcaaaaagctaatccactatgatcaagtagtcgttatccctgggatgcaaggttggttcaacatatgcaaatcaatatatgtgattcgtcacatacacagaactaaagacaaaaaccacatgatcatctcaatagacgcagaaaaggcttttaatacaattcagcatccgttcatgttaaaaacccttgacaaactagacatcaaaggaatatacctcaaaataataagagccatttatgacaagcccacagccagcatcatactgaatgatgaaagcattcccctggaaaactggaagaagacaaggatgccctctttcaccactcctattctacatagtattggaagtcctagccagagcagtcagcaagaggtataaaaagcattcagataggcagagaggaagtcaaactatctgtctttgtagaccatatggttctatacctagaaaatcccatagtctctgccagaaagctccttgatctgataaataacttcagtgaaatttcaggatacaaaattaatgtacaaaaatcagtggcatttctgtacaccaacatcatccaagctgagagccaaaccaagaacacactcccattcacaatagccacaaaaagaataaaacaactaggaaaacagctaaccagggaggtgaaagatatctacaatgagaattacaaaacactgctcaaagaaatcggagataactcaaagaaatggaaaatattttatgctcacagataggaagaatcaatattgttaaaacagttatactctccaaagcaatttacagatttaatgccattcctatcaaattaccaatgacattcttcacagaattagaaaaaaaaaatattagaactcctatggaatcaaaaagcctgaatagacaaggctaagctaaaaagacaaagctggaggcatcgcattacctgacttcaaattatgctacaggctatggtaaccaaaacagtatggtactggtagaaaacagacacacataccaatggaacagaataaagagcctagaaataaagccacacacttaacaaccatctgatttttgataaagttgacaaaaagaagcaatgggggaaagtactccttattcagtaaatgttgctgggataactggctagccaatatgcagaagattgaaactataccccttccttacatcatctaaaaaattaacaccagatggattaaagacttaaatgtaaaacctaaaactgtaaaaatcctggaaggataacctaggacatgctgctgtggacataggacttggcaaagatttcatgacgaaaatgccaaaagtaattgcaacaaaaacaaaaattgacaaaatagagatcttctgcacagcaaacagacaatctacagaatgggagaaaatatttgcaaactatgcatgcaacaaaggtctaatatccagaatttataaggaacttaaatttacaaacaaaaaaaaaccccattaaaaaatgcacaaaagacataagcagacacttttcaaaagaaagcatacatgtggccaacaagcatataaaaacatgctcaacatcactgatcattagaaaaatgcagatcaaaatgacaatgagatactatctcacaccagtcagaatgactgttatcaaaaagtcagacaataacagatgttggcaagattgcagagaaaagagaatgcttatacactgctgctggaaatgtaaattagtttagccattgtggaaagcagtgtggcaatttcttaaagaacttcaaacggaattaccactcaacccagcaatcccatattgggtatattcctaaaggaatataaatcattctaccataaaggcacatgtatgcatatgttcagcacagcagtattcacagtagtaaagacatagaatcaacctaaatggacttgatatagaaaatatgtatcatatgtaccatattcaggccacttaaattgacgtagattcaacctaagtcgactggataaagaaaatgtggtttatatacaccacggagtactacgcagctgtgaaaaagaatgaaatcatgtcctttgcagcaacatgcatggagctggaggccgttattctgagtgaactaacacaggaacagaaaacaaaatacagtatgttcaggtataagtgggagctaaacattcagtacacatggacacaaagaagggaaccatagacattgggacctactcgagggtagagagtgggaggagggtgagggtcgtaaaactacctgttacgtactgtgcctatcacctgggtaacaaaatacaccaaatgctcatgacatgcaatttacccatgtaacaaacctgcatgtgtaccccatagtgctaaaataaaaatgaagaacttggtagttccatccaatttgttttaaaaaatgtttaataaaaaaaattttggagacatagggctaaaaactgatcaaagtaatatatagaaagtattagtcgatgatatcaaagtaatgtcgatatatctaatgtaagagatcaaagtaatatattctaaataaaacttagatttgagtcatttgagagtttaccccttttattctggagtggcaaagggacatgcccaaggccactaagtagggcctgaatcccatgtcatgatcccagtgcctttttcctttccatgtgatcatacttcttcctttcatacctttaagtcaattatcttccttccttagaatgtgtgttgaagttttgaataaagcataatagacatgaatgtatttttatgctttcctaatttaagctgtttttctccacattgcctgtgatgctagcacctcttcatgaactttcctgtcctctcagttgtaccaggcttttgattctgccagatgcagcgggagagcaattgctcttcctaaagaaatccatagctggctttattttcctcttatcttttcttgccatggtaaacttttatggtcatttatctctgtcataaaaatgaatgttgtacgtgtaatctttcctgtcttaaattatatgacatatactgttcatgtctttgttctagtttcttttatgtaaatgggcattttggtttatgaagaaagatttgtatcttatttttttcctcctggctttagacatcttataggtgagtcccttagagttttggatcttccttgcaggtccctctattcctgatatctaagactaatcttataccattaaaatgaataatgacccttaaaaaatggaatcctcttctcacgtaggagagtcaggagaggctagaaaaagttgctgtagggttttacctcaacaaaatagtaagcatttgaaaggcaattcaagcagtgtgctttggccagagaaatgtagcatttcagagtaaaagggatttttaggcaatttgtatatatatatgcacttgacatataaagcccttacactgctaaccagtggtcagccaatccttgcttaacccatgctgaagaccagaaaatcaggagagcagcctacagtaatggggggaacttgtgcttttaatcaggcaaatttctgtatcctgactgcaacacacacatgttgtgaccttgggcaagacccttgactctctgattctccatttccttgttgtggtctcattagagaattaaatgacatatcaactaccactattctcatctatcacatctgagctgaaatatcttccactggctctcatgtctttcttctaaatcttcctcttggggtcatacagaacacggttgtaatctcactagctatcttctaggtgtgtttaatttcaagtctcaactctctctagggctgtccattatcttttatgtgtttgaaagctgtgcaatcaaaggacaatggagacagaacattggtaagccaatgtcaccttctagcattctctgtgatctacctgtattttactgtgctgtactaactttgtgctatgcaactgtgctgtactaactttgtgctatgcaacagtcactttgtgaacttgtggtatttgtgaacaggagctcaaattaaatattccatttcagtcattaactgatgtgaaaaactcttccttttctggatgaaactatagatatgtttgggcaaaggagagtgaaagttgatattgataccagacactttacagctattagaccttacacctaaatccttatgtctaagatttaaagcacggtcccttacataagcctgtttcatttgctaccgataataaaaatcctgtcctaacacagacaagtgaaaaagtaacctcacatgcatattctgtttcacactcatcttgtgtatttactcttcacgtgtctcccaaatccaaataaaaggtgagacctagagagacacatgttcacacttgtcctcttagaagcatgtagattttatgcatgatgtccccattattgtaaatggagtgcacaaagataattcagcaagtccttatctctcagtgtctcaattatgaatagtttttgattcagtgttgccctgagggcctctgaggtgggtagagaaaccgtctgtctccagattctggactgttcccaaggtcttggcttctttcttcccatcgtggtcattgctgttcccaggttctgtgcctgcttctggacatcctcatcactgtccccactcctttcatttttcccttcatttttctacagtctcactcgtatttgtgtttggttttgatagtgagactgaattttgtttctgcttaaatgattatcacgctttatatatttcattttttgattttgactcttagcattctttcatgtcagatgtttctagagaaactctactttgcgtaatttagggaccccagagtagagcaattccagtttgaaaatattctaattttggcttttaaaaacatgtgaagtgtgaggatgaaaccattagagcttgactttcttagaaatttgtcaagtatatatttaacaaatatatacgattgcgttatactttatttataaactaaatgttctttaaccatgaacacctggtcaggtgtctctagtggctttaagtaaagaccacttcatttaccctcatgtggctaagataatgcctcttgttgtgcttcaggtttgttatgtgaaagcagtccacttctgagattagtttaaaatgttctatttaaaggctgtttgcatggccccatttaagaaattaggctatgcaaatccaacctgattacgagattcagttttaaagaaatttgaagtgcatttgagactctttgttaccatcgatcttagattttactggaatgaaaccactgagcttcaggcttgttaggtttcacttaagaattccatttccagcatcaatgttattacctttcattctgagtcctaagtgaccaagctattatttttctccctgttcagcaattgattttgttgccttgatatacttttatttgtcagtttatttcctgctgccatgattcttactcctatcaagacattagtttttgtttctaatgtgggtaaaatgtttaggccagaggttctgctgatctatgattctctagattctgcaggttgaagtgtttcccagggcttgcttatttggggaccatgaagaatccatttggcctgaaaaaagcttggtttatttgtatactacttgtaagataagtcagtcctttacaatatcctgtcgtggatggaatagaccactcatgaatagaaaacagagtgtattaaagcctttaatcaagaaatcctaccaaattcctaatcgcagatgtaagagcatatttcttgtgtagcaagtccatgaaaccaaagggctgatccatacataaatgtgtgatacccctcagcagagagagatgctccagatattaggctgtttttggtgctgtctctaacatgcaagtgggctgtgtatcattggtctcttttcctccgatgtgcctagtagagcatcctaaaggagcttacaactgaagatgaaaactagcatgtgaataattacatgttacatataaagaaaacgtttctcattatattaacataaatattatatatgtgtgtgtatatatagtttaacttatttgtattacacacacacacacacacacacacacacacacgtttaacctgtattctgtctcccctgttactttgcttattttagaatatggcaatattttaatattttggacagccaaactgacatttattcaatatattgagttcctagtatgttccaggcactgtggaagggtgctgaagacacaaagaggagtaaaaatatgcatccttttcttaaatagttggaagcctagtgagggagatagaaatatataccattaacaatagagtgagggcagtacccctagaggccctataagtacaaagtgctttgaatccttagaggaaggagtggtccttatgattggagtggaattgtctgggaaggacttgctatgttgaagagtctgagtttcaccctaaaatcagttagggaactgatatggtttggctgtgtccccacccaaatctcatcttgaattgtagttaccattcaattgtgagtgagttctcacaagatctcatggtttaaaaagaggctttcctcccttttgctctgcatttcttcttgctgctgccatgtgaagaaggatgtgtttgcatccctttctgtcatgactgtaagtttcctgaggcctccccagccctgcagaactgagtcaattaaacctctttcctttataaattatccagtcttgggtatgtccttataacagcatgagaacggactaatacagggaccattaaggaattttaagccttggagtgttatggtcaggtattccttctagaaagttgatactgtggactgcaatttaggaatgagaagctagaggaatttttcaacaaattaaaacaatgaattactatatgatgcaggaattctacttctagatgtagactcaaaagaactgaaagcagagacttgagcagatatttgtacatccatgttcacagcaacattattcatgatagtcaaaaggtggaaaaacccaaatgtggataaacaaaatgtggtatatatatgtgcaatggcatatcgttaaaaccttaacaagggataaaattttgacatatcctacaatagggataaaccttatagacattataccaagtgaaataagccaatcctcatctttgaagtgtgataataatagtacagctctctcctcttatctgcaaggggtatgttccaaaatccccaatgtatgcctgaaactgggtattactgaatgctgtatataaattagatacagtaggagattcacaacaataactaaagtagaacaattataacagtatacttaataaaagatatatgattgtgcacattcattctctgtctctcgctctctcagaatgactgtgggtaactgaaaccatggaaagtgagatcacagataatggggaaaaaattgtgtctatttaataaaatgacagggtggtggccctgaggaataaattggctaactcatgtaaggtgcttcaaaggatgcctgacacagtaactcctcagtaaatgtgagctgctactgaagtacttttgttaccactactaccattagtgtttttttatttgaagaactaacttaaatatatgacatattaatcttgtttccttgactttgatgggatgtcttatttttaatagctttattgtggcattcttcactacagtaactgtacttatttaaagcatatagcatgataagttttgacatatatatacatctgtgaattgatcactgaaatccagaaagcgaacagaatccattactttctcaacagaacccaatgctttctcaaatcccttggtaattcctccatttccccagacgaccaatgttattctttctcttaccatagattagtttgagttttctagagttttggatacctgtaatcatataatattgtattcctttttgtctgacttctttcaatcggcataattgttttgagactccatgtttttgtgtatataaagttaattcctttatattgccaaatagtattccattgcatgaatataccacagtttgtttatccataagcacctgttgatggatgttgggttgttttcagctttggagaattataaataaacctgctatgaatattcttgtacaagacatattcttttaatggatgtatgttttctttagggtaaatctaagaatggaatagctggattatgtggtagatgtatgtttaacttttaaaaacagtactcaacagttctacaaagtggttgttctattttacaagccagcaacagtgtactagagtttctgttgctctacaccctcactaatacttggcatggcagactttttagttttttccactctgataggtgtgcagtggtatgtagttgtagtttttaattggcatttccttaatgaccaatgatgttgagcgtctttttatgtgctttttttgctattcctattttctttgatgatgtatctgttcaaatctgttcctcatttctctattgggtgattttcttattgtttctttagatttgagaattatttacatactgtggatacaaattctttatcatagatatgcttgtaaatattttctccacatctatggcttgactattttcctaacagtgtcttctggggagcagaatattttaattttgataaaaatctagttcatctaatttttcacttgtgatttataatcttggagacatctctaaaaaaaactttgccgaacccaagtttacaaagattttttcctatcttttctttcagaagtttcatagttaggtattataggtagacctgtgatcagtttgtgctaattttgtatattactgaaggtgtggattgaatgttttttgtttctgcatatgaacatccaatttctctagcatcatttgttgaaaactctggtctttcttcactgtattgcctttctatctctgcaaacaattatttgtcctacatatctaagtttgtttctagattatttattctgtagcagtgatctatttgtcttttctgatgccaatacctccttgattacagtagctttatgataagtcttgaaatcacattcatctaagttgttttgtccatctatgtccttcacagtgttttcaaatggatttagaatcagttaatcaatctgttggtctatctgtatatccatccatccatccaaccacccacccacccacccacccactcactcatccatctcactagctataaccttgattacaatgtccaatagaaatagtaagcgtgaacatccttgtgaacattcttgccgtgttcctgatcatagagaaaaagcattcagtctttcaccattaaggatgatgttagctatacatttttcttataggccctttttaaagtttaagggcattcctttcccttcttagtgtgctgggtttttttttttaaatcaaaagtagatgttagattttgtcacatgctgttgagatgatgatgtagttttcctttttagttttttaaatgtgttgattgatgttttgagtgttaagctaactctatattcctcggataaactccacttatccctctaaaatttgtagaatctgtagtgatatcctctatcatttgtaatattgataatttatgtattcttttcctgtgataagttttcctagagatttatcaattttattgatcttctcaaataacatgcttttggcatcattgacttttctgtactgtttttctattttttatttcactgattttttggctttgagctttattatttcctttcttctgcttgctttggtttaatttgcttttccttttcagtttgttaaggtcattcgttttgagacttttattcttttctaacacagatgttaggtggtataaatttcttcttgagtactgtggtagtgtcattccacaaattccatgttgtattttcattcagctcaaaatgcattctaattttcttttgatttctttattaaccagtggattatttagaagtgcattattaactttataaatatttggagattttccagagatctgcttttttatttctgatgtaattccattgtggttagagaaaatacgttatagaacttgaatccttttaaatgtattgagaattattttatggtcaagaatattgcctgtcttgtatacgtttcatgtacacttcagaataatttatattttgtcatcgttggatggagtcttttataaatgttaataaagtcagtgtggttgataggatagttctagtctactatgtatctgacaattttctgtccatttgttttaattattgagaaaagggtactgaaatcctcaactttaatttaggattttgtctgttttacttgtatttctgtgtttttgcttcatgtattggaagaaataatattgggacataaatactaaggattgttatatcatcttgattaattgagccctttattagtatgaaatgatggttttgatccctagaaatagtccttactatggtgtattttttacttgtgttgacttgtgttactgtgtgtgtctttttccattctattaccttttttcctaacctattagtatctttgtgtttaaagtgtttgtaggtttgtagtaagcaaatatcgttgggtcttcatcttttatccaatctgaaaatctctgccttttttatggatgtttagaatatttacattttaatatgattattcatatctttaggtttaaaccagtcatcttgttatttgctttctatttgtttaatctgttatttattcatttcctttgtttttccctgcctttttttggattgagtattttaatgattctgatttatcttccttgatcttatattgttcatagctatttgtcctgctactttagtggttggtagtgcctagatggtctataacattgatctttaacatcacagtttaagtgatatttagtacttcacttattgcatacaaaccttagagcagtatacttcatttctgtctctcttggcctttatgttactgttgtcgtatatatattttacttttagctatattataaatccctgagtacatagttgttgtttttgtttgaatagtcagttatcttttaataggttttaacaacaaaaaaactcacatatataacctgtaacattttctatgcttttaatttctcatgtagatccagattttcatctggtatcatttgttttttgcttgaaggactttctttaatatttctttctcagtggttgttgagtgatgaattattccagcttttatatgtctgaaagtaagtctttatgttgcctgtgtttttggaaggtgttttcacaggatatagaattcttggtagacatgttttgttcttttagtgctttaaagatgttatcaacagtctttttgttttgtattgcatatgcagtattcatagctctcatcctttgtatataatatgtctttttttctctagctggtatttaagatttttttccttatcactggttttgagtgtttgattatgatttctttcttttcttttttttttttttagatgggttctcactttgttgctcaggctggtcacaaaattgctttgttgtccaggctggttatgaatatgatttcctttgatgtaatttgcctagtgtttcttgtgtttaggattcattgagcttcttggattcatcagtttgttgttttactgaagtttggacattttcagccattactttttcaaaattttttttgtctctctccaattcttctctccctcatgaacttcacttactcttctgttaactcactcgatattgtcctatatctcactgattattttctttctttttttgattcattttctccatgtgtttcatttttggattgattttattgctaggctttaaatttcactaatcatttttcctgcaagacctcccgtggttaataccatccagcatattatttatctcagacattgtatttttttatgtctgggaattatacctcatagttatgtgtatatataagcagctgttcctcaactcataatgggcatcgcattatgtccagataaacctatcataagttgaaaatatcgtaaattgataatgcatttcatacacctaatataccaaacattatagcttagcctagcctaccttaaacatgctcagaacccttacattagcctgtagatgagcaagttcatctaacacaaagcctattttgtaagaaagtggtgaatatctcatgcagtttattgaatactgtactgaaagtgaaaagaagattggttgtgtgggtgttcaaagtattatttgtactgaatgtgtatcacctttgcactgttgtaaatttgaaaaatcttaagttgaactatcataaattgaggactgtctatgtttgtacgtgtgtatgtatatattctacatctctatttaactttttgaacaaatggaaagtaattataattattttaatatccttgtcaaacaattgtatcatctgtggcattctgagttggacttaattggttgctttttgtcatttggatcttttattttttgcttctttgcaatgcctaataatctttagttgtacgatattgtgaattttacttgacttagggggctggatgttttaatttttctataacagttcttggtctttgttctgggacacagctaaattacatggaaacagttttattcttttgggtcttgcttttaatatttgctaggagggaccagagcatcatttggtttatagctaaagcgccttgctttgcgctactgagatgagacctctgaattctctactcaattccaggtcaattataaggttttccagtatgtgcagtgggaataggcactcttcctggccccatggcagtgtgctgagtactgttccctctactgtttttggatggttcttttctcagtcttggttagtttcctcacatgcatgtgttgatcagaactctactgaataagggaaacattttatagatatcttgggttctctctcagtgcagctctattcactctggtatgctgtcctgaaaatgctagtcaccttggtggtctcagattctgatctctcttcactccattcgcctatgttctctctctttgcattgtgacctggaaaatctctcaaagcagtaaactgggagagttgtagggctcacctcatttgtttcctctcagtcagggatctctgtctttcatttcttgacactcattcttaaaaatggttgtttcttatatagatagattcatacatacatatggttgattggttggttggtttcaggcaggaggttaaacctagtccctctcactccattttgcccagaactgatggcctgctttttatttcgtcagaacctggtagctatctatatctttaaaggcgttcattatggtccagtgggaacagcaatataaagctgaaggtctcatcctatttctaccaattaccagctgtctcaagggacagacttgtggagtctcctattcggaaggtcatgtggctgatcatccagtgccgcataaatcgctttctgtacattctctcttttatgctgtcacatgttgggcagctctcccttttgaagaacacatttcgtattttgggtatttctcatcattcgaaacatctttttcatattacctgaaatcggtcttttactaacctccatccaaatttgtctagcaaagtcatatgaaattaatcttttttcccacacagtagccccactcttatttgagggcttttgccctcttccttcccaagtcatctcccagagtaaaaaccttttgatctctgtgagcttcagttgtctcatctataaaatgtgctatttattttaaaaaggattcctgtatctgtgagtgcctcctttactgagtcagataccatgccagatgctcaggatgcagaagagaatatgccctctctgccttccagggactcagacaaagcgggggaagagaagttaaatgatacagcgcacagataaaattgctaacagaagtatgccaggcatgctgggcaagtcataggattttatagatgaaattaatggaagtatgtgaaatgtactctatgtgctgtaaaggactgtatgtttgattatgtttgatattatttagtagtagtcaaagatgtactagcagctgctccatacccattatttttttctggagtctgttatgctttgaccttttcggtgttaaggttctgtgtgaatcctctgggttccacataattaataagttttagtgtgtgccaacagggggtggaaacatgacagtaagttcattttcttcctgctgttgcaggttatttgggcttggctcttgtaaaagacaacttgtacccagtgaattctcacatgaattcaaatcttgtaagctaggaatactgtaaatctctactgatgcttgactgagtaggactttacaactccagatggcagttgtaatactttagcatttaccatacagagaaatagaaaacaattttctgaagaaagcagtgacaaaattccaatatcatggttttgtagcactagttcatgccatcctccctcacacagtgttagaacttcttatcgtgatttatcaagcatttcattacattgccaacgatatgaaaaacaaaattaagaactgctgtatactggtgtggcatggtgctgaagtcaggctttgggaaagtacacaatgtggcagcatttcttaaaggcctggagaccgtgttaaaaatgcagattctggccaggtgcagtggctcactcctgtaattgccacactttgggacgccaaggcgggtggattgcttgagcccaggagtttgagatcagcctgggcaacatggtgaaatcccatctctaccaaaacaaccccacaaaaattagctgggcatggtggcacacacttgtagtcccactgactcagggggctgagatggaaggatcacctgagcctgggggagatcaaggctgaagttagttgtgatcatgccactgcactccagcctgggtgacagagtgagaccctgtctgaaaagaaaatgctaactcccaggccccacctccaaatattcttatttagcagttcaagaaagtgggggctgcattgtacttttaattagtttctggatgattctggttcaggtgggtcctgctttgaggaacactggtggagggagtgaccatgtgatataaggagaatcgattttccttcttcttctgcgtgtgaccttgtatttattctgccatccactataacttctgagggtttactttttatcaggaatttaaatcctaaggtgtcataaagatgagttaaaatggttctgttcttgaagtatcttcagtgtgacctgtctggtttagtcagggtagctgtctgatcttgaatgggttacttttaagctcactgcatataattggaataatatggtctacctaatcttcaggagggttgttgtgaaaaccaattgaatgtcaagtgccttgcagtagtcatagcaaatactacttagtcctctcttagcattaattgtgccaatattacttctttccaaagcggttcaggtatctaaataagattctgaactctaacacttcaaacattgtaaagtgatacatgtgagttaactatttatagactgtttctaggaactgccaggcctaattccagtcaatgttttcatgatctgccaaattcagagcagcttataaatatgaagaagggacagaatcttgtctagagtataaagttaagctattggagtcaggtacatcatgtccttctcagtacctttgaaagtttttggctgggcacaatggctcatgcctgtaatcccaacactttgggaggccaacgtgggaggatagcttgattgagcccagcagtttgatcccagcctgggcaacataacaagaccctgtctctaccaaaaaataaaaaaaatttatcttggcatggtggcatgcacctgtggtcctggctatttgggaggctgaggtgggaggatcccttgagcccagaagttagaagctgcagtgagctatgattgcatcactgtactctagtctgggtaacgaagtgagaccctgtcttgaaaaaaaaaaaaaaaagttgtaatgcccttgtgctactggtatttaaaatgtaatactgtgtgaagaatcatttccacacttgatttcatgtatcacctgtgtatatataataataaactataaattatatattatttttgataagtagaatttctttttatttctgtttactaattaaaaaaaacctcctctttatttttgatgtgttgaatatcctgtttataaagttgtagttgaccaaaacaaatacacaaaatcatcagtgacaaagtagtattaaattttatcaataggaagaaagatgtttactttattttgcttgattctcaaattttaattttagcaacatcccctctcccaaataaatttagtaccggagacacgatgcgtcaaagaagttgtcccaaaagagaattaactgcatcatcttatgcctctttacagacaggaggggacaaaagaagaaagttacttttctaacatgctttcgatacttagattgttaaaagaaaaaccttaggcaaattaaatttaacagagttcgactgagcaaagaatgattcgcaaatcaggcagcccccgaaccaaaatacgttgaaagagctttggcctgccttgtggttgaggaagatttatgaacagaaaagggaaagtgaagtacagaaaacagaaatgaggtaccgagacagctggattggttacaactcagcatctgccttatttggacatggtttgaacagttggcagcgcttattggctgaaccctggtgattggcccaagagttggttacagtctgtttgcacatctagttaggttacagttcactacctgctaagaaacctttaggctgaacctaaattatataaggaggcagttttaggctaagctcaatttaacaaggtgaaataagatataaggaaacgtaagaaaaatgaaggacttaccactcagttttctaaatttaacttttcagaaagcctaatggtcttggtattgaagatgcatacctatctaaactggtggttcttgacttatgagccatgatgtgcttttaggtgagccaccaaaatttgatgaatgtggacaattatcgtttgctgcagtggtcactacagtggctttccagaggaaacattttgattggattgagtggtagtgtgttgtggagcagggtacgacttgtggcacataagacatgggaagccttatagactggttaacaaaacgaggtcagtgtttcaggccacatctgctctgctttctgaactctcgcactctcctctggctagttcctgcctgcttggtcctgagtctctttgtggccctctagattggcagcttggctaaactgactgcttggcttttgattttgtttttggctcttagaagtggacccacccactccaatgtgattgagaaaattaacatcgaaatggccacatccaggggtttctatggaacttgaccatttcagggtttatttcaggattacaaaagtaatatgtatttattgggaaaagtataaacgaacaaaaggaaatttaaacaatctatattctctcaccagagatagttttgatatataaggacttagttttctgttaatcttttttatatgtatattttaacaggatcatactaatgtaagcctgatttcttttaactttactacatataataaatatattttccatcattttaaatggttgctgtgtgttccattaaatgaatgtaccataccatattttacttaaccagtatagtttttctggtaatttttttggaaaatttctctttaatttcccattaccattccacctaaagaaaaaaagtatatttttatgggcagctatctatgcatgcacttaccatacatgttcctcactatatatttgtagctttgaatccctggttctcaggccttaagagttggactgagccatactactggcttttctggttctccagtttgaagagaggccttcccagcctccgtaacacatgagccaattcccctaataaataccctctcatttatctgtatgtgtatatctcctattggttctgtttctctggagaaccctaatataaccactaataggaaaattaggacaatgagatgggggttagttctggagagaacccagtggaggtgtccgcagtgaggtgaggtgaggttgatagttaacgctggtgcctgagacacatgtatgattttcatcacagtagcgaaggattcactctctctacgttgctatatccacttgtaagtacaatttgtaaactctactttggaggaatctgaaggtggtgaggaagtgaaagacctgcccaaagtgacatacccagaaagtggcaggattgatacccaggaagtgtggctttttgggcttcctgtctttaagttaacctcagatctgttctttgcctgccaagagaaggtaaatatgattatgaaaatcttctgtttagtaagctttactggtctctacttttagacaaaatgtcagttgtctgtatatgcagtaccaatatattgcacatacagaaaacttgcatatactgacatgtagttaatgtctcaatactcaagagaaaatattttctccatgcaatggtgaacattcatttactgttggaaatagtcactgcatgtttgcactctaaaccttttgtgattgagtgtggcaatgagtgtgcagtaaaatttttttttcttatttttttattttattttatcattattatactttaagttttagggtacatgtgcacagtgtgcaggttagttacatatgtattcctgtgccatgctggtgtgctgcacctattaaaatcatgctgcagtaaattttttttttaaaaagaattcctctatttaccaaatagctcatcggagtttacatacctctggatcacttcccttcagcatctgataaggcttatgcatacattgtcacttattttcttcataaattagccattttcttctgtcagtaatttatgtccatatctgactataacaactaggattccagtaggatgtggcagatccaggtgagagatgcatatccagggcaccctaaatggaattagctggttctttgtgtcagctcattatctcagcttcactgctgatcctttctctcacagatgccttgaatctaaatcacagtgcctgcttagtaattttacttaaattgtaaaagatgactagcactgtacagtcaaagcacatttaaaacacactcacagtttgttttctgtgacagaaaacaaaacagaaaaatgttttccagatgccagtgcaagcttattgcattggtgtagataaatggtctttgtggattttatttgcttcatatttgtacaaagctttcataatgtactgtcacattctcaccttaagtattttttatgttttttatattagtgtgcatggagccttctaaaatttcttctatgttcactatttttaccaaacttcaatatattatattttcagttaaaaaattagaatgaataagttctctggttgttttatgtaattaatatcacattatttttgccttcagtatcatgtacatggtacatgtttatgagctgttattaataatttagcaacttctttctaaacaaatgattttatacatctttcatatatgaacctaaatacagagcagttcactgccaggtgtggttgagaaatgtatctcaataatttgttgagatgaaatctgttaacttctcctaaactttcaaactgtgtaacaggagggattgcctctatttaacctttaatggaaaggtcggtttcagataaagtcttttgacaaacaacatcttttcttcatgactctgtctcagaatttccttgctaccactttgatcttcttcgtctatttgcctgaggatttctgctacctatgaagacttgcctccattgatttttgtgttttttttctctctcccagagtgaaaaggtacatgcctttcctgatttgcactttgaatgtgtcatcctagtgtcatctggcctccattgttacagataagaagtcatctgttcatcttattgtgatgccatcattacataatgaaattcataatttttctcttattgatttcaagagtttatctttcaacgttttgaagtgtctggtgtggttctctttgagttttttgtacttgtaattcattgagcttctttgaagtatagattagcatttttcatcagtttggaaaatttttagctatgatttctttgaatattctttgtacttctttctgtctctcatctccttcttgtattttgattatgtgttggtttgctaactgctatcccccatttctgaagccctgtttactttttcttctttatttcctctctgttctttggatcatctcatctgccttcatgtatcatcaggtttgttgattcattcttttgcccatgcaaatgaagtgcttagcccttcttgtgaatttttcatgcaaatttttatactcttcaagagtcccatttgactcttttagaaaataatttgtgtttgtatttatatcctctatttgataagacattgtcatcatgccttactttacttccgtaggcatggttttcccttagttctttggacatatttaaaatgactactgccgagccatatctgctaattccaacatctgggccctgaaaaggaagtgtctgttgcctgttttgcacatcccccctccccccgtgtatgtgtcacattttcctgggggtgtgtgtgtggatatgtgtgtgcatgcacatgcatgtgtgtgtatgtgtttgaatgtctcataattccttgttgaaacctgtacattttagatactatggtaactctggatattgatcctctccctcttctagggaaagtttcttgaagttgttgtttgctcatttgtttatttgtttagtgacttggctttactaattatttgaagaatatttttctcactctgtgtggcccctgatgtccctgctcaaatttgtttctttgtgtttatctgttagtgtgggttcgtaggagtcacccctgggtctgcctaaatcatttattgatcaatatttgtgcttaagctggcttagccagttggatgtatgcgtggctttcacggttcagggaatttatacttttgtcctgagttccacaaggctctagtagataagtggttctttctccattctctcctgagagggtgcagcatggacatccatacagtcttccagaccatgataggtgaatgagattttattttattttaactcccttcctaggagtcacccctgggatagagtagcttaatgttcagcaagtatttggtctaaggttgtgcttaagcccctcaagttagtaaggcttttgcattttgctgatggatctgtgtacgacttgggaaattttttcaagtctgttccacattccactcgatttactcctgagtagaaataaaagaggtgtgcattccagggcatgtgcttagccttctttgtctctaggggtgagtgtgattccaagagcactcttctttggtgtctctcagtttccttggtccaccgtttcacttattgttactgttatcatgaagctaccaggccctgcataactgtgtgccaccaaaatctccattgtttttgacaatgctcttaggcgtgaacttctcccctctttgttcccaataaagtcagtctcctcagtcagcaaggcagaaggggagctccctctgtcctcagggcatgccatttctcctgcacagaatctctgtggcactgagtcagagttgtggtgatggtggctctggtctttgtagcctgcctctcttcgtgtggaatgtctaccctgtgagtgagctggggttggggttttaagggccccagtattctcagactttgctcttggcacacagccttgctgcacaaatgggaactgaatggggaaaggagacagagtcctcttagcagcacctgccaagaattgtgcttccacaacacatggctgggggttgaataggcagcgagaggcactggcagcctgcccctttcaggtgaaactctagccctagactaggagctggggagagtgggaacccccgtgttcttggccatatcttcccatagcaaagtttccatcacagagctggcagtaggggtgtagggagggtatgggagcaagtcattgctccagtgccacagattcttgccattcttaccaagatttagtatattttcttgaagagatgtttcttcacttgctgtatgcccttaggaaaatttccagaaactttaaatgtttctttagtttgttttaagtaattttcaccagttaaataaatggtggttgcaccaagagaggatctgctaatctcacactgctattccagaagactccccttcttggcgtggttttttaaggcttttctccagcagagtgacatttagcttatctgatgggctaatccttcattgtcattgaatgtgttcatcaggctgcgacctcttatatctttgtgttccctgtctccagtaatatgaatgctacttcatagtaagtactcaataaacgtctgaatgaatgaatagatactacatttttaaagtgatgtgttgatttttattcacaaggagtgatgcaaacagtgtggactttgggcactgtagggctttgctggctgtggaagtaggttttgactctgctgacccagcataatcatagtgagctcgaatgtttaaaaatagaaggggtatgaagaactactacacgacacacgaataagaagagacaacccaatagcagaacaaacaacagtagcagcaacaacaaaaaatagatgtgtgatatgcctaggcaggctataaaataggaagcagagaggatcaattagcattaaagatattccacctatcaggaatatgacatttaaaacaatgatgtatcataaacttataatcatcagatttgcaaaaattaaaaagtctgacaaagtattggggaagatgtggagaaacagaaattttggtaaactgcagataggactataagttggtataactccttcggggaggaatgcagcagtaacaaaataggttgaatattatatagtcacacactagacacagtaattatactacaaggcatagattccagggaaaactgtcactcatgagcagcaggagacattaatagagagatgcttgttgctgcactttttgtaatagtgaaaatcataaaacaacccaaataggtatcagtggggaaatggagaagtaaatgttaatatagacttacagtggaacacgatgcagcagttaagatgaatagtctgcctctacagagagcaacatatataagtttgatgggtaacaagttacagaaggttgtataaggttgtatgcggtatagtattttatactgtttatgtaagttaaaatacagcaaataagtttttgttgtttatggataccatagcacaggtgtcaactatgtaaagtgtgtaggctgtttttgaacagctcacaagctaagaatgacgtttacattttaaaagtgtaaaaacaaccaaaacatgttacatagactccacctgaccctcaagttttaaaatatttctatttgctcctttactaaaaaagttttctggtttctgcagtacagatgatctgtgtgcccagggccatgccctccatgccctccagcccaagcttggtagacagctccctgaaggccacctctgactttcctgccccaggagttattcttgtgccttggaacttcagttcttcctgggggcagcctgaaacatcagggattaacacactggaggcaaccacagccactgggaatgtgaatcagtggatgacgatttccatatcttcctcttcaaccaaggagcagtgctgaggcatgttcttcatggtccctcacagggacccagcagaattgagccattttgcctaacttggtgaccggctccagaacatgccctttactgaccttccctttccctgccccacccctctcttctggctccttccctctgtttgctggaaccatcacccagataatctgctgtcccttcatcctcattctaggctctgctttggaggactccagactaagacagacatgtgggcagtaaaagaataaaactgccattgggaaggagactggttatctcagggaagacaggaagcataaaaggggttttcattgtatttgttacatgttatttctttatttgaaaatatctgcaataaatatggcaaaatgtttgctttttaaaagctgggtatttacatttttgagtttgaaataatgtaacagatttctatgcgaatctagtcttcctccttgacttttcattctttaggaacctgactcttgtggtgcttaaaatctggtttctaccttggcacattcatcatatcctgaggaaaattgatttactatgagaataaaggaagggtgtatgtatttaactaatagaaaagatgaagtaccacagcaattaaatcaaaagtggcttttcctccattattttgtgcttcataatataacttactcttccagcagaatggtggtggtatctaaaaccttctacttacagatactcttctgaattttatttttaaatttttaaaattatttatgtatgtatgtatttatttttattatactttaagttctgggatacatgtgcagaacgtgcaggtttgttacataggtatacatgtgccatggtggtctgctgcacccatcagcctgtcatctacattaggtatttctcctaatgctatccctccccttgctcccgaccccagacaagccccagtgtgtgatgttccccttcctgtgcccatatgttctcactgttcagctcccacttattagtgagaacatgcagtgtttggttttctgttctagtgttggtttgctgagaatgatggtttccatcctcatccatgtctctgcaaaggacatgaactcattattttttatggctgcatagtattccatggtgtatatgtgccacattttctttatccagtctatcattgatgggcatttgggttggttccaagtctttgttactgtgaatactgtggcaataaatatacatgtgcatgtgtctttatggtagaatgatttataatacttttggtatatactccgtaatgggattgctgggtcaaatagtatttttacttctagatccttggggacttgtcacactttccacaatgacaaatttatactccaactaacagtgtaaaagtgttcttgtttctccatatcctctccagcatctgttgtttcctgacttttaatgatcattattgtaactggcatgagctggtatctcactgtggttttgatttgcatttctctaatgaccggtgatgatgagctttttttcatatgtttgttggccgcataaatgtcatcttttgaaaagtgtctgtttaaatccttcgcccactttttgatggggatttttttttcttgtaaatttgtttaagttccttgtagattctggatattagccctttgtcagatggatagattgcaaaaattttcccccattccgtaggttgcctgttcattctgatagtttcttttgctctacagaagctcttcagtttaattagatcccatttgtcaattttggcttttgttgccattgcttttggtgttttagtcatgaagtctttgcccatgcctatgtcctgaatggtattgcctaggttttcttctaggatttttatggttttaggtctgacgtttaaatctttaatccatcttgaattaatttttgtataaggtgtaaggaaggggcccagtttcagttgtctgcatatgggtagccagttttcccaacaccattgactaaataggtaattctttccccattgcttgtttttgtcaggtttgtcaaagatcagatagttgtagatgtgtagtgttatttctgaggtctctgttctgttcattggtctatatatctgttttggtatgagtaccatgctgttttggttacggtagccttgtactatagtttgaagtcatgtggcatgatgcctccagctttgttgtttttgcttaggattgtcttggctatacgggctctttttttggttccatatgacatttaaagtagttttttctaattctgtgaagaaagtcaatggcagcttgatgggaatagcactgaatctgtaaattactttgggcaatatggccgttttcatgatactgattcttcctatccatgagcatggaatgttttcccatttgtttgtgtcctctcttatttccttgagcagtgtcatgtacttctctttgaagaggtccttcacatcccttgtaagttggattcctaggctttttattctctttgtagcaattgtgaatgggagtttactcatgattgggctcactgtctattattggtgtatgggaatgtttttgattttttgcacattgatttttttaatcctgagactgctgaagttgcttatcagcttaaggagtttttgggctgagatgatgggattttctaaatatccagtcatgtcgtttgcaggcagagacagtttgaattcgtctcttcctgtttgaatacactttatttctttctcttgcctgattgtcttggccagcacttccaatactatgttgaataggagtggtgagagagggcatccttatcttgtgccggttttcaaagtgaatgctgccagctttttgcccattcaatatgatattggctgtgggtttgtcataaatagctcttattattttgagataggttcaatcaatacctggtttattaagtgttttagcatgaaggagtgttgaattttacaaaggccttttctgcatctattgaagatactctcctaaattttaaataacaggtcaaacatgatctaagttgctctaaatatgacgtgaattgatggtaattcaacaaagtgcaaaattttcaggaaactatagttctttgggaaatttcacttagacttcagaaaattaaatctcactgaagatttcaatatgctgtgtaaggagaggaaccaaaacaaaaggacaaaaacagttttttaaataagtgcacacttaggcttacttagagaacgggatgtttttattagcagatttgggacttgaggcatgcaaaactttcagagagagccatatgttcttatgcatgccagccttgcgacagtcacgattctgtggttctgcagatgaaagcaaaacgttgtatagtccttgtggcaggaatgataccttttcctaaagcagcgtcctttggttatgccaagctgttatttggctgagtggctttgcactaaatatatctagagcgatgttttaaaattataaatcttatgtttctccctgctatggactgaatgtttgtgttcccccaaatatacgttgaagccctaacccctaatgtgatggtatttggagatggggcccttgggaggtgtttaaagttatatgagttcgtgagggtagaaccctgctgatggaatttgtgcccttaaaagaagaggaagaggaaaagggagggaggtggggggaggtagggaagagagagagagagaaagagagagagagagacagacagagagagagagagagcatctttctctctccacacaaccacagaggaaggtttatgtgaggacacagtgagaaggcaaaggcagcgtcatgcaagccaggaattgagcgttcaccaaaaaccaaccatgttggcactcttatcttgggcttctagttctagaaccacaagaaggtaaaattctattgtttaagcttacccggtctctggtattttgttatgacagcccaagctgactgatagactccctcatcgctgttaggatggaagccttagtttagtccaaaggggcttgcaggttctggcttttgccagtgtcttcagcttcatctcaagtgctctctccctccctctctgatttgcatcggtgctggtctcttggaggagctatgctttccctatttaccccctgggcttttggacatcctcctcacagtatcctcagtgccggacatacaaaagacattcagtgactatttttaaatgaacaagtggtagaaattagaaggtagtcaggttctgacctgtgatggcagaggaggagatactgtgatagggaaacaagcatataaaaaaggcaacacatttgactgttgtgtctgatcatgactgttttaaatgacatgagtgttgagtaggccaactcactttcactctttttttggacttcatcatattctcaacaacaatcataacagcacattaatattaccctttaaaaaataacctgtttaaggtagtactgttggagatggtgaccggagttgttgctaattactctttttttctgtaactgccttttgccctcaaggtttgccactggaagaggcatatctggtgggaaagaggaaaagacaaatgcatggtggttcaggggaatgatatcaaagagaattaattagaaattggaagttaaaggaaggataagcagatcaaattagtatagaggttggtatactgttccactgcctccttgtctgttaatgtattctggagcatatatcaggcctacattaggcactgggaaagagggatgaacaagatcaaaatcactgccttgcaggaactcagaaagtttgtagaggcattcatataaacaacgatagtttaaaatactgtctaacaagtgctgaatggttaggcacaggggccatgggagcacagaggggtttggaagtcttcatggggaatggtataattggcctagtgataatatgattcaataggcctataggcaaaggaaggagattatggatttattattgaaggacagtaaaacctaattgattttaatcaattcttgttcatttccaagaaaatgttcaccaacagcttttagcaatataaacagttatgagaagcaaattttaaaaaatttaaaagatttttgcacactgaagttgcatattgattatagccaacccaaatagatcctttcctgggaacagaagtttgactgggtttggaatcagggtacctgggtttcagtcctctctctgtaacacctggctgtctgaccatagcatacctggtcacttcactccccacgtccttggcagttcttactgctgctgccttccccactcttcagcacaagtgtgtacccgtgggatgatatcttcccatcaaatcataagtttaattctacagtgattcttttttgatgggtggtcagacctcctctttcctacaaccctcaccccatgtcagaaatataatccttcattttgccaaagcaaaacgaagttagactgcatatgctaatgaatgtgtttatttccctctcacattctctttttttaaattttttttatttttttcatttttttattattatactttaagttttagggtacatgtgcacaatgtgcaggttagttacatatgtatacatgtgacatgctggtgtgctgcacccactaacttgtcatctagcattaggtatatctcccaatgctatccctacccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgctgttataaagacacatgcacacatgtgtttattgcggcactattcacaatagcaaagacttggaaccaatccaaatgtccaacaatgatagactggattaagaaaatgcggcacatatacaccatggaatactatgcagctataaaaaatgatgagttcatgtcctttgtagggacatggatgaaattggaaatcatcattctcagtaaactatcgcaagaacaaaaaaaccaaacactgcatattctcactgataggtgggaattgaacaatgagaacacatggcctctcacattctcttacttaacctctgcttgccagcttagtgaaccagtgtactaaagaactctggtaacatgagttgatttgataagaaaacttaatataggtcccttctagaaaatgcactctcagtagagaattgcattttgaaatataaatctcaagttcatcactccagttcatcactccataacaggtgcccgcaggcacattattttgcttttcaagatcatctggaatgatgccatttagactaattgccctcaaccctttaatttacctggatttttggaaagtatctttgtttcctcattcagccacatgtttgtctgaggtagaagcattttggaagtttacagtcaccacatccatgagttttcatgtgatgtcaccttgttcttaggtaacaggacaaatattgatgctcatagattgacactaatctcttgcattggtaaagtactttacaattgacaaagcacttactcaattatactgtacagtcttcacataatttcgtgtataactgtcctgtgaggtagcttttagttatccatatattagaaaagttaagaggtaagacattttgcccacagttttcaacctagtaagtagcacacaatgtccattaacagttgaatgaataaacaaaatatggattatccatacaatgaaatattattcagccataaaaggaatgaagcagtgatacatgtcacaacatgaggaaccttgaaaacataatgctatgtgaaacaagccagagacaaaacaccacataattatattatttcatttatataaaatgtccatagtaggtaaatccatagagacagaagtatatgtgtggttaccaaggttggaatggagttgggggaaggagcctgggcagtgaaggctgtaaaaaaattctttttggtatgatgaaagcagtgtaatatttgagtatggtgatgattacataactctgtaaatacactaaaaatcactggattgtgtactttaaacgggtgaactttatgggatataaatgatatctttacaaagtaatgcattcttctttcccctacattccagaactaaaggacaagtaacttcaaaagtgctgcctccgggctcccttcctggtacctattctgcttcacttttgccacatcatgagaaggggtaaccagtctcttaagtcttttctttctaaatattcctctgtctcttcctctcaggtctcacttgaacaactaaaggggcagcctcctagaatcctggtattcactacctaccactcactggcagatgttgacattagcacattactaagcctaagcagaattaagagaaaaggaagccattagtgccaggttggaatcctgcaataggacttagcacctgtcctcagtttaatgtatgagtataagcaccctgaatctatagaaaatccagaaatgtccattatttataaaatgctccctgtatatttgtgtttgtgcatgtgtgagatttgtatttatgtaagagtatgacatatagctacagttgacccttgaacaatacttacttgaactgtggggtccacttatacatgaattttttttttcaaccaaacgtgggtggaatatagaatattcatgggatgtgagccctgcctatgcagaggaccaactttttgtatatgtgggttctacagggccaactgagggacttgagcatataagattttggtagacacaggggttctaggttctagaaccaatcccctgcatacactgagggacaactctgttggcacagagttgattgaggcagtaggaaatgggaagataaagctggcagctctttccacacatggaaagcataataggaaagaagggcttaagttagcaggtaggtggtgtgggattcagggacattactctgcgtatatgtttcatctattgcagcagcctttcctgttacatacttataccctgtgggggcagtggacaagtacagttctgatacctgagactgtgcgaagaaagcaagccaggaatttgtgtgataggggagactccacaatttctcgtttgattcagcataagcctgcattgttggggtatctccaggaagtcagccccagtgcaggcagcagacctcacggcatagggtggaagcaaagtggagcatctgtcagtgcatagccttcttaagcaatgatgagctgcttagcattcaggacattcagcccaagattataaatgaaatgtgtttgtgtgtttatatgtgtgtgtatgtatgtatggatatgtatgtctgccctgtcactggaaggctttttaaattttttgatttagatcatagaatttctagagatactaattttcaaattttatacctcagacaggaatccatctttctgagttttgtgtagttatatttttggtcctaatttgtcagtaaacaggacttttatttcctccatagagaagtcagtgatttttctgtctggggtgtcttcttgcatgccccctggttgtccatccactttcatgactacctctgcagtctcttcatatctctttcttattgttacctaaggtaaagcttacgatttattattgtatctgtgagcatggtgccagtagcttcctttggcttaggaaggaagaacatttatctcaggatagagcttcactgccacatttggtgacataaaatgctatatggagaactgactatactgaggtgtgaaatacatgtaggaagtctctcaaatacattcagatatccatcggcttgcagtttgtccctgatgttggctttctgtgaagctgaagtgcctaccttgaatggatggaaaaaaactgtccgagtctttgtgccctgtagccgtcaattactgtacttttcatgagcattgcctgtggttccaaatgatatttctataggcagaaagtgagatggaagagggaaatattgtacacaaaaatatgaggatgtgaacagagcaggactgttcacaatagcaaagacttggaaccaacccaaatgcccatcaatgatagattggataaagaaaatgtggcacatatacaccatggaatactatgcagccataaaaaaggatgagttcatgtcctttgcggggacatagccgaagctggaaaccatcattctcagcaaactaacacaggaacagaaaacaaaacaccacatgttctcactcataagtgggagttgaacaatgagaacacatggacacagagaggggaacatcacacactggcgcctgtcagggggtggggggctaggggagggatagcattaggagaaatacctaatgtagatgacaggttgatgggtgcagcaaaccaccatggcacatgtatacctatgtaacaaacctgcatgttctgcacatgtatcccagaacttaaaatataattttaaaaaataagaaaaaaagtaaatgaataaataaatagaatttatctgagaaaaaaatatgaggatgtagttcctattatctgattcctagtgtcctttggatcatgcttattttgtctctaagcccattgtattaacctacatcacatatacgcagtttgcactgctggaagctatcaggctctgtaatactgactctgaaatgattgtttcagccgcaccctactgctacctccttgcccgtcctctgagcttgcttatactcattagggaaacttctttgactgttatgacctctttctttcctgattatccctttactttctgttttttggttttggtcgttttcgttggttctttccctgcctcgtctttaattgttggtgatgctcagggttccttccttgactcagctgtactctggagatgcatgttctccctgagcagtcgcctttgagctctggcaacacactctcctgtgcatatgccacatgttttgcttgtttgctttttgtcatgtaggaacttctgtgtaataaagcttcttccctaatcccatgtctgttcatctggcttacttactcctttcagaatcagcccagcctacaggaagcttttcccagcctactcttctctctcaactatgttctaattgtccatgagggtattctgtactttggttaatgtatgtacaccattgtattgaaatgatttgtttatatatacagtcatctaaacaaaactgcaggttcccagacagcatgtgcctgttttatttgcatttaaaaccttcagtgcttgcaaagtcccaggtatatagtaggcattcaatttgagtgctgctatattcattccatttggtggatttaatcttaagatgtttttgtctctttttttctgaagaatggaacttgcaccaaaataaccctaatctgaaaaaaaaatgtgtcatggcattttctttttaagcaccttgcatagtactttctcttttcctccctttcctaatatatggtctgcctgtgttgtactataaatagtactgcagcaggtagaaattgtagcagttagggttctccagagaaacagaatggtgagacatggatatacatacatacatacttatatatacacacacacatatacatacatatatacatatgtgtgtgtatatacatacatatatacataagtgtgtgtgtatatacatacatatatatatagagagagagagagagagaattttatttcaaggaattgcctcatgtgattttatatatatatatatagagagagagagagagagagagagagagagagataattttatttcaaggaattgcctcatgtgattatgtttgacaagtcagaactttgcaggtcaggtcagcaggcttggaaactcttgctcagaagctgatgcttcagtctagaggcagaattccttcttcctcagagtcagctcagctttgttcttagggcttttccattgattggatgaggcccacccacattatgaaggataatcttctttacttgaagtcaacagattgtagatgttaaccattttcacaaaacagcttcacagctattgcattagtttgattgaataagtggatactgtagacttgcgaagttgatgcatgcaactcaccgtcacagaaataagcatgaaatttgtagttgtaacgtatcttagaactcttctgattacccaggtccaccctgttgtggctccattttgtggatgaggaaacaggcccagggtagtttgtagtttcaattcacaaaactggttagtagaaaggggctagccagaaattttctcttaacaaatgagaaatcctgattgacttgctttggccttgtcaacagagtcatcaggcattaggttctagaccacttattaaccagctcagaaatcccaaagtaattattagcacttttttcttctctttatgagttgcttttttttttctcaaggggatttatgactagctttaaatagaattcgaaaaactactacatgtcataaatctgacctcaagtcttagagtctgttattagcagatactgtctttttatattttctgtaacttcaatggcttattgcagtggactatgaaaatgtataaaattttttcctattgccagggatgggaaactatggaaatgtcatccctgcttgctgaactgccctcttaaattgccccttatctgatgatgaactaaattatttgggggagttgaaaaatagagaaatgccagttattttttattcagcacattgtatatactcaaaacattttctgtaaggcaaaaacaggaaaccttgcaaacgaaactgtgggtaatatgtagttataaaccatctttccaggaaggagctgaaagctctgcatgatccctctattataaatttttccaactccttttgaaggatgttaagtaatttgccccatagtctatgggaatttttcacctcggggaaatggggctgagaaagttattacttttaaccccagtgaaccacaccagaaacagttacagcatcatacaaatcaatttctgcattttccataaagtgtttggcaaggaacaaaataggctggaagctgggaaaaaggccaagtacttaactcactcaaactcattttaaagtttttagctctagatattcaaagaaaatcagtgttcatcctgttgaattcatgggaacatcattgttttttatattatataaaaggaaactttccaattttcttaaatatacaattttttgatagtgagaaataaaattaactcaatttagatagacaaaatgcctttactcattttctaagaaaatcttaaatttccggataggaaaataaatatatattttttgaaatccattttcaaaacatcatggcatttaagcattccaacttaatgacagctgagaaagactgctgtgagacatatactgcgtaaagtgaatccaccctgtctattatacatggggataccaccatctggaaaaacaagatctatgtatatttagccaaataccaaaagaatactgctgaaatttcactctcctgtttccctctaagtatttgatatgtcatcaagtattgtattgtattgtattgtattgtattttttaaatgttttggtactttactaaataacaaagaacttttgcacagagtcagaggatggtcttttatttattatcagaggtgatgcctttctataaatattgagaatacagtagtgtcctacagggatagctatttcgtctttctaaagagcttgtgcattaagtaatgttgttctttaataatgcacttaaattacatttagatttttttgctaaatgtgtgaaatcagtttaaaattccatctttcatttaagactgcttattaaggaataataatcccttatttaaattatgatttttgacagttgacaaagtgcttttacacatattttctcatctaattctaaaaacagatctagtgttagatgatgttggttttcattcctgaggtgaagaaattgaggcagcaagagtttaggcattttctttttcacgcaactattaggtgacatttccaagactggaattcatgtgtcttgactctaaatccaatttttaaaaacccttgcctaaagtggctctcatttactgaattgtcaacggtattctttgtacatataaataaattattttatggattgccccataatgcagattaggcaggataatttatgaattctgatttctactcttaaaacctatgcatacttaatttatagaatgttaattaaagtaattctgttttaatatgagtaaaattatggtgatttttcaaaaaagtattttggaaaagtattatgtttattttctatcaaatgtatgtgggtatacacacaaaaacacatttgcctacatatgtgtgtgtttatatatgcaaatatgtgcatatgcatataaactaaaatacatgtatttagacggtagcaagattaagaaaataattaggtcattaatactaattgcagttgtaatgaaagttgtatagtggatgaatgcagaatagttaaaatgaagatagaattttctttagccttggctgtaagtaaaatgtaatacatcacacagtttgttgaattttcttactctttccctgtttttgatagagtaaaagatatactttggagtggagattaaactcttaagagatacagaccaatgccgactcatagttaagggtccttatttaacttacatgcaatttttggttttagaataattcattgagatatatattttctgctctgctcttcaagcgctatgttaattactgaagtctcagacattttcaaataaaagaacctgtgatatatgatctcttccattaacagcttacaattcatatgagcaaatatgcttagcagttttactcaacgagtagttcgttccaggtaatccaacagatgatgtctcattaagagtacagaggaagtccgataacttccagctcagatggggagtcacagatgatggagaaggtgtcatctgggtgggcgtttttggcaattggtagaatttgaagagtagaaaaggaaatagtttcaggtacaaagcaaagggaacaaacagcacatttggtggatggtaaggaaacctggctttgcatcatgaatagtggctgaacaaaatcagggaaattaagaggtaaataaactggcagtgtgggaggtatgaataaatttggtcttaagtctattgaatttcactgatgatgcggttttcaaggagacctttttaaatggcagtttggaggcacagtggttggctcttaagcatttagtaaatgaaatgcaatgctgggaagaatcagagccacccctagaggatggaatgtcttctgcgtagaggtgacagctaactgggggaggatgagtcattattggaaagcaggacaacatcctttgggctgagaacagtggccatttatttaagctgtcgctggctggtggtcctctttgacatttttcttatttggtatatggaaaaaatatagcataagacatccactactgcaggcttaaaattaagacttttaatttaaaacgtgagttgattgtattatttattttcttttttgaaatttgagctgtttgaaataccatcccagagtgaggtgagcagtcttatttgccttgatttatgctacctctaagtcatcttaacattagtattcacaaaactacattgcagtgaaattcaacaaatctttactgaatacctcttatgaggaagacgataaagaataagaggaaaatgagatttttagtttgtttggaatacagagtgtatgggaagtataatagattagaagtataaagtctcaatgctgtactaaatgggcaccattaaaggttttgaaccatcaatgtttttaggtttttaaatggtacaggagagttgtttttaggagttgtttttagttttttggatgatacagggggacatattggttcacttgttctgtttgattcgcatatcttttgcttttaaataggtgaacagtttctcaaatggcaaatatgttagtcaaagtatactaagtggcatcagataacattcagtactgtgaagtgtcaattttagatatcacctcagtggaaaaataatagcatcaaataaacagtaccaggtaaggagaaacagagctcttcattattggccagatggactcaacaagcctgtgttcctcaccttgatccttatgcataaaacaaaaggaagttttaataacatttaaagaaaaggaagaaaaaatgtttgccatactcctaaggaatgagtcagttgttacatagtctgctgttaaattcggggccttgatatatttagctcctttgtgacttggaaaaatagcccagagaacaatatagatgttatttttaatattactttttcccccaggaatctaattacgtaagaaattttttatatcaaccaaccattcaggccagtataagtgtatcagtacataactgctaataacatcattcgctatatttggtgaactgtctctctcagcagctcaaatgtcagtttttatagagaagaggaaagctctctcttgttcgcattctcattgaggcactcctccctccttcttcctttccctctcttcttccctctctcttttgtgaacacacacacacacacacacacacacacaccccaaatagttaaagccaatggattgatgatttgaccccgttgtgttatcaagactagttctgaattactaatggccagtgggatccaagtatctcatttgatagagtgatgcagctactgtggtgctatgctgtggatggatgcaagaagaggggaaattaaaatcactctatatttaacagtataggattgaaagtgtgatgtaggcccttgtgcttttgataagggaaatggtttattcactagagttggtcaaaatgtgattaacacagggttaccaggattctctattaatgaaagcatctctcagctatatatttccttgtgtgtctgttttttaaatgaaattaaatatcacaggtcacaggtcacatgaaggggtctatctataatgattctctttgacaacaaatggaattttggaatatagtgagtttcctgacattggagacagccatgtagaatggagacaacaattgatttggggttttgtagaaaatattttttattgtgtgggaattcagctagattagagtttcctagcccaaatttaatggtaaaccatgtacttgaaaaataagacaagaggggactgacatgtgagccagaactgttgtcactgagcaaaatgagagatagggaatcagtgtgacagtaaaaattggtttggtgatagggacaatattaataacctttaagaccccctctattcatgagtttctgtaacttaaacctgaatatgctcgtcaactcactggcacttgaaatttttttttttttttgagtctgagtctcacctgtcacccaggctggagtgcagtggcacgatcacggctcactgtggcctcaacctcctgagctcaagcaattctttcacctcagcctccagagtatctgggaccacaggtgcacactaccatgttcaactaatttatttttatttttgtagagacagagtcttactacgttgcccaggctggtctcggaaatcctgggctcaagcgatcctcctgcctcaggctcccaaaatgctaggattacaggtgtgagccactgtgcctggcctagtaggttcttaactgaattctaacccccgcacccaatttctagtttgctaaaaacccttaagaatgcaggatgcaggccaagaagctggcttgccaaacaaggtcacagttggtacaggcttcaggttaggtggtattgatgtcagaaaaatcctaaatctgtgaagactgctgaaataggggatcatcagtcagcatcactcagggcacaagttaagtgagagggctgatatcaaggattaagagttaaggcagtgggtacacctctagccttgtgagtctaatggaacttcagacggaggcatccagcaccacggacagctcttcagagctgttgggtggatgtaaaaactcctaggggtttttcctggaaaaactgcttctaattcttcctagctaaagatgtctactatacacaagtatcggactttatgcaaccctctcttttctcatcttcaatgtagtaataataaatgttctatatagttctctgggtacacatattaaatgataaattgaaagtatgtgtcagtgatacaaatttaataacctttcactttgaatcattgccctttatctacctaagattgtattatgtcaaggaaaattgccagcttcttcttaaagtatgaaataacagttaaataaactgatgggagaaactgtggtatggtaaacagatatacactttattggtgagagataggaactaggatttattgtataccatgtaggttcagacatatgctcttataattcttatgccatttaattttcataaccgctctgtgtacctatcaaggaatggaggggtcagtccatgtcatgctcttccactgcgccatatttctcctatttctactgatgggatggaatgggtgacatctggtatgcagggccagagtgatgatagaattccaacttgtggctgtcctaagagtggtctcttctgagtgttttcccgatggcaggaagtgggagtgaaggacagatagagggggtaagcaacacagctcaggtcccccaacaaggagatatcagagcattcctggccaggagatggagcagggtatccaggggccctttggaatgaggtaaaccaggttgttgctgagcttactgtgggttggtcatggtaggaatcttctcaaagaccctcaacctagctgctattgaaggaaatgaaaaaccatactttgatatctgtgtgcgataactttatgtaatacagtgacaacttagggaaaagcatctatctttacaattagggtattttaaagggaatgaaaaggtcttcgtgccattaacatttagtatttgtgtctttgataaaaccagagtatcttttgtgtgatccgtttgtatttaatttgaatcattatttcagaatataaaagtgtatctaatttttttattttattttttgagacagagtctcgctgtcgcccaggctggagtgcagtggtgggatctccgctcactgcaggctccgccccgctgggttcacaccattctcctgcctcagcctcctgagtagctgggactacaggtgcccgccaccacgcccagctaatttttttgtatttttggtagagacggggtttcaccgtgttagccaggatggtctcaatctcctgacctcgtgatccacccgcctcggcctcccaaagtgctgggattacaggtgtgagtcactgcgcccggccctaattttttatgaacatgaattttacatgtggttagtgactgtttgcatttgttatttgacaaacataaaatgtatcataatggaaaatgatcaagtagcaaagaaatgccttcaacagctttctatatgttttggcttatgtacttaaggatgtagacagctttatgagacagactatactatacaagtacttttgtctgaagattagctgggctgagactttttttcttttcataacagtttgatagatgtttgtgattatctgttcaatagcccatttaggactaggttgaagaagcagcagttttctgcataggtagcatttgagatccattatcagagggaaatgattattgtatgatgctgttgtcccttagaactttcaagaggaaaatgttaggattaggtagttatataatgatttgtttgatagaaggagcactgaggttgaaatcagaagatacaaatttgaatgcttgcttctatacccaccagatgcatagcctttagtaagtttttcagaccctcagagccacagtttgctgctataaaaatgagactctccacctaagtcagggaatggttgtgagattacattagatgacatttgtgaaagtgcttaaaatttctaacacattttttaaagaaactgtttataataattctcctttgtggttattttctacagaaagtgagtgagaaggttggaggagctgaaggaaccaagctagatgatgacttcaaagagatggaaagggtaagccttcactactgcctagtgttccctttgacataaaaatgtctaccataattagaggagaagagaaaacgggagagggcaactgttttccactggtctctgagaatactacattttgttatttaaaactacttttcatgtatattttaaaacataaaatgtaaaatattctgtcttccctttgtactgtcctgaggacaaaacctcagtgaaggtgaaaggtcacgatgaactttttctggtgggtttcatcatcattttaaaaaaataaggacagtgttgagctgatgtttgaattagggtgagatgcgtagaaaagaagctgcagaatgacatcccaaatgtttttgggagagtttaagtcactttctggctttaaggaccttccttactggatgattggccagaggcagccatgtatagtggagagaatacagttttagagcttgtccaaccttggcccaaactccccttcctgccatgtgtcacaaaagtccatctattgatcagagcctctttttaaaattttattattattattgttattatttttttgagatggagtcttgctctgttgcccaagctggagtgcagtggcatgatcttggctcactgcaacctccgtctcctgggttcaagcgatctcctgcctcagctccctgagtatctgggattacaggcacgcaccaccacgtctggctaattattgtattttttgtagagatggggttttaccatgctggccaggctggtctcgaactcctaacctcaggtggtccgcctgcctcagcctcccaaagtgctgaggttccaggcatgaaccactgcacccagcagagcccctttttaagtgaatgtaaaatgagaagactaatactcatttgggggattttagttaaggcttaaaaataatgtagattatttagctttctgcttaaaaggtaggttctcagcaagtgagggtagaagtgatgaacaaaacatctcattttatttttcttgggacatgagccatattttcgcttttacttttcttttactttaacgctcttcagaacaggtgatatttaggcttatgattaaaagtgtgtgttacattgtgcacagaaacattttaggtcttaagtgggtggtgggtaatggatctgagagtagcaatcctgtacttgaacagaagaggatgttgcaaactatggtacctagaaaccacatttaaacattgtaaagaatattgcttttgtacttcgttgtaacaaagcaattttttaatattctgattttgattctaccagaagttttttagggactggatattgttttagtctacatcagatccaacaggctgcctcagttttgctgtttttactatgtttgcatgaagagtcaaacaaaaaattcctaggtattcattagtgtagtgtgagaaattaaaaaaaaaatcctaggtactttctaccttgtctttttagtttttctcttggtgagtttattgatgaattcaataaatattttctttgtgtcttccatgaaccaggaggtaggatatagacaaggttcctgagtgcatgaagttcgtagtctagtggggagggcaaacttggggcaagtaatgaccagcgtggcgaggaggaaaactaatggagctacagaagcccagcacagaggaaactcacccatactgcattgtcaaggagaaccttcctgatagttaagtgaagatgggaaagagttagcagagcctggtaaaggaaacagcatgcaagcaggcaagagggaacggttgagttcctgaaaaaaaaagataagttgccaagaggcagggtcttgtgaaatcagactgcatagtattgatccagctggtcattctggctaagttcttgagatagacctcactgatggatacccagtggtgaggagattttatactggaattctgagtcccagccttcagaagtctggaaaaccagactcttacagctgaggcctggcacctacttcctccaactggaccaaagtctgcattggttcctatttctcatctctggatggttctaaataccacctgatcctcaaccaaagctggtagccactaatatccatagttctggaaataatattttacccattcatcttctacagcatctgagactccaggaactgacacacatttccagaaatgtcttgtctttgactcttctactgcccataaaattggagttcctcacgcttcatttgaacagcccatgggttaatccgcctctgtcttcacccagtcttgcttgatccctccttgtactttgatgctcctccttccccctcacccctggagagcatttatagtttgccacgtggccaatgtcatgtcattaatgaaagattaggcaggtatttaggaatttggaactaagtaccaggaatcagaatttgacacttccttttagcatctgccaggactaaagggaataagctaggcagctcactgtctaaagtgagacaagctaacttcctgtttcttaaatgagactaaaaagaacaggaaatttggagaactgagtagaatttatcactgagcaactaattagacctttggagatttattttggtgagaaatatatgccagttttgcaaagtaattgaaataaaagagaatcctccaagcattttactttaggcaaataccaacagaccttcctctgagtatgaaagtaaggtataaggattatttctcctaatttatagaaatgtttctgaaacttttatttcaaaatatagatactcctgcagcaaagtaaacatctgattgactgaagaacacactcatggctctttacttgggtttatacctgaataaattgagagatttaggtttcagtgcagtgtggcaattgttttactctttttgattctgtatatcttttgtttctgtctctattgcaaattttgcaccctccactcatgctaaatttacatgaatagtataagatttctgtggtaattgaaaagcacttgctttggatttagactctcaaatcttttctcgcctgttaattgattattcacacaaatgtttgagctcagtgttcccaagcagacagaagaattgcctttccatagtttgttttctgctcgtcaggcatttggggtagagagacctttgctcatctgtattctcggaggtgcaattagataacaaaatgaaataaattagaggtttgcttcaagcagcattactgggagagagaagtgggttttcctaggggtgtttctctaatcagccgccccagccactctgtggctgagatgcagtaaaatcatcatgtgtgtcccttagctctgcagccctcctctccctgagctgattggatagaatcctgcggctgtgctgtctctgtaggatccctgcccatcattatttctctcctaagtgccttgcatggaattctttttgttttcattttaaatgctgtctgttgcttacaagctttgttaaacacaggctaaatgtcttactctggtgcaacattggaggatttgttctttgaaaagctataggattttttgttaagaggaagttcggaaatttgaagaacctctggttccttctcaaattttcctcagttgctgcaatgattgtgtagttttttgttgtgtgtacagttacattcattaatttacttggaaagtgcctccatgttaaggcagtatccctgccttcaaggggcttccagttttgatttttaaaaaattgtacgtaaatcagtaccttacagaacatagtgcttggtgtcctggggaggtttcccatggaatattcaggctgggtacatcaggcttcctagaagagagagggcgtctgagctaaatcctgaacatgtctcttgtccctgattatgtggttaattcagaattctaagctgaggaatatagtatctgttttgcagcctgaaaattattgtgggaaatcccttctgttgaacccagaagatgtcctagggatagaaacatgtctataggccctttaataaaaatgggattctttttaaggagcaactttgagttttaagaagagcaagttgttgagaaagaatgccatttcatatgagagtaagagaggattattggcagattcaggtgtggagaaagtccaataggaaaatgtccatggtcattatcttcatacactcagtcactgggtggagaggggttcaatttttctatccagcccaagtggtagagctagaattaatgagtagaaaccatggggagatagattctggctcaatataagaaaaacttttggctatcaaagctgggtttttggtgtgtgtgtttttgtgtgtgcgtgtgtgtgtgtgtgtgtgtgtgtgtgttttgcctcagcaatgactgaattccctatcactgcccatgtttgaccccctcgttcccaccgcccatgttggaacacacactgacctgctagttccctcccatcatgtgaggcacaccagtcatctcttgtgagttttgtggttagtaatttgttactaataatgtcactttttaatgatgtcactcttacttggattccagtgatctctctcaaatggggagagaaaggagtagagtttcagctggaatgctctgagcaacacgtatccctgagtgcacccataatgtctccttcatggtgtgatgggaaaggaggaggcgtggagcattgtgctaagacacacccccccggtgtggggatgtaagaagggccagagctccaaacaagatgagctttgaagacatctttttccttagtctgaaattcaatgatgacaagcttcctctgagttacatgtttgcaatatatagttccaagcttatattcattaaaggtaatgaccaagaagattaacagcaaaaaaaatacattggagcaatcacagcattctaataaccttgtttatttttgttttttaacacgttgtttgtcagttgggctttctgaaaacataagataatgctttaaatcaaagcagcttggggacagatggattaactcttctgagtcagcaggggactattaaaaacatcactcttggacctgcctgtatctcgctgccagacagaccttcccaggacacggttttcatcatgtctctgtgattgtttattgagctgttcttgttcaggagtctcagtactttaagtgggtgtgtatgcattattaatagttgtagtttcttaacttcagtgacagaaaagttaagaatttgaaaatattttagtttttcatatgcctttttaatatttcttttatgttaccactgtgagttacccattttcaagtgggtgtgtaattcatctacttatttatctaatttatttatttacttacttatgtggagattgaggtctcactctattgtccaggctggagtgtagtagctcagtcatagctcactatcacctcaaacttctgggctcaagtgattctcctgcctcagcctctcaagtagctaggactaccagcacacaccaccatgcctgcctaatttttattatttatttgatatttgaggtccaatttctttctttttttaaacttgtatcttaacttcaggggtacacgtgcaggtttgttacataggtagacacgtgtcatgggagtttattgtacagatgattttatcacccaggtattaagcctagtactcattagttatttttcccgattgtctccctcctcccaccctccaccctccaataggtcccagtgtgtgttgttcccctctgtgcgttcttgtgttctcatcatttttgtcccacttataagtgagaacatgtggtatttggttgtctcttcctgcattagtttgctaaagataatggcctccaggttcatccatgtccctgcaaagaacctgctctctctcttttatggctgcatagtattccatggtgtatacgtagcacattttctttatccagtctctcactgatgggcatttgggttgattccatgtctttgctattacgaatagtgctgcagtgaacacatgtgtgcatgtgtctttataatagaacaatttatattcctttgggtgtatatccactaatgggattgctgggtcaaatggtatttctgtctttaggattttgaggaatcaccacactatcttccacaatggttgaactaatttacactcctaccaacagtgtataagcattcctttttctccacaaccttgtcagcatctgttgttttttgactttttatctcattgtggttttgatttgtgtttctgtaatgatcagtgatgttgagtgttttctcatatgtttcttggccacataaatgtcttcttttgaaaagtattcatgtcctttgtccactttttaatggggttgtttgctttttttcttgtaaatttctttaagttccttatagatgctggatattagacctttgttggatacatagcttgcaaaaattttctctcattctatagcttgtctttttactccgttggtagtttcttttgctgtgcaaaaactctttggtataattagatcccatttgttaattttcgccttggttgcaattgcttttggtgtcttcctcatgaaatttttgcccatgcctatgtcctcaatggtattttgcctaggttgtctttcagggtttttatgattcggagtttatacatttaagtctttaatccatcttgagttaatttttgtatatggtgtaaggaaggggtccagtttcaatcttctgcatatggctagccagttatcctagcaccatttattgaatagggaatcttttccccattgtttgatttttgtcagatttgtcaaagaccagataactgtaggtgtgcagttttatttctgagatctctattctattctgttggtttatgtgtctgtttttgtaccagtaccatgctgttttggttattgtagccctgtagtatagtttgaagttggatagcatgatgactccagcttcgttctttttgcataggattgccttggctattcaggctcttttctgtttccatatgaattttaaagtactttttcctagttctgctaagaatcttaatggtagtctaataggaatagcattgaattcataaactgctttgagcagtatggccattttgatgatattgagtcttcctatccatgagcatggaacgtttttccatttgtttgtatcatctctgatttctttcagcagtgtttgtagttcttcttgtaaagaacttttggccgggtgcagtgactcacgcctgtaatcccagcactttgggaggctgaggtgggcagatcatgaggtcaggagatcgagaccatcctggctaacatggtgaaaccctgactctactaaatatacaaaaaattagctgggtatggtggcaggcgcctgtagtcccagctactcgggaggctgaggcaggagaatggcttgaacccaggaggtggagcttgcagtgagccgagatcacgccactgtactccagcctgggcggcagagtgagactctgtctcaaaaaaataaaataaataaataactttcacctccctggttagctgtattcctaggtattttattatttttgtggcaattgtgaaggagattgttcctgagttggctcttggcttgactgttcttggtgtataggaatgctagtgatttttgaacattgattttgtatcctgagactttgctgacattctttatcagcttaagaatctttttggctgagactgtggggttttctggacataggatcatgccgtctgcaaacatggatagcttgacttcctctcttcctacttggatgtgctttatttctttctcttgcctaattggcctggtcaggacttccaatactatgttaaataggaggggtgagagagggcatccttgtcttgtgccggttttcaggggaaatgcttccagcttttgcccattcagtatgatgttggatatgggtttgtcatatatggcacttattgttttgaggtgcattcccttaatacctagctcattgggactttataacatgaatgaatgttgaattttattgaaaaccttttgtacatctattgagataatcatgtgtttttcttctttagttctgtttatgtgatgaatcatatttattgatttgcatatgttgaaccaaccttgcatcccagggataaagcctacttgataatggtggataagctttttgacatgcctctggatttggtttgccagcattgtattgaggatttgcatcagtgttcatcaaggaccttggcctgaagttttcttttttgttgtatctttgtggctaattttaaaatcttttgtatagatggggtctcactttttcccaggctagtcttgaactcctggccttaagcaatcctcctatcttggcctcccaaagcactggggtaacagacatgggccaccatgactgactgaatttatttatatattaatgatcactaaactcacaaagtgttggtgctccctttaaggtgtctatgtttttcttaaacttttgctctgctacagcatctggtataatgtggtatctaatagtatgaaatcatatctttcagtccttttgttgctccacaaacaacgccacgctgttcacgagtccttacacctaagttcaggaaataccaacttttcttcagggaagaaaggtaatattcccatgtctctggaagagtaaccccattctagtcatttccatgccttctattctttagtatcttgtctctaaagactgagacagctggtgaaataatcagtatcatctatagattcagcatggcattattattagtgaagctagcacctagcacaggaatcaagatttttttgtaagtgctttaggtttttggggccagagggtctctgtggtctcttacaactccttgccaatgctgtcaaaacacaaaagcgtccattgacagcgtttaaatgaataagtatggctgttttccaacaaaactttatctaaggatgctgaaatgtgaatttgaaatttgaataattattttgtgcagtaaaatagtagtctcatttcaaattttttcaaccatttaaagaagtagaaatggaagtttttattacctaaaaaacatgcctgtatctgtatatatttacagtttcactttcttttttttatttttattttttattatactttaagttctagagtatgtgtacatgtgcacagcttgcaggtttgttacatatgtatacatgtgccatgttggtgtgctgcacccattaactcgtcatttacattaggtatatctcctaatgctatccctcccccctccccccaccccacggcaggcccccatgtgtgatgttccccttcctgtgtccaagtgttctcattgttcatttcccacctatgagtgagaacttgcggtgtttggttttttgtccttgcaatagtttgctgagaatgatggtttccagcttcatccacgtccctacaaaggacatgaactcatcattttttatggctgcatagtattccatggtgtatatgtgccacagtttcttaatccagtctatcattgatggacatttgggttggttccaagtctttgctgttgtgaatagtgccgcaataaacatacgtgtgcatgtgtctttatagcagcatgatttataatcctttgggtatatacccagtaatgggatggctgggtcaaatggtatttctagttctagatccctgaggaattgccacactgtcttccacaatggttgaaccagtttacattcccaccaacagtgtaaaagtgttcctatttctccacatcctctccagcacctgttgtttcctgactttttaatgattaccattctaactggtgtgagatggtatctcattgtggttttcatttgcatttctctgatggccagtgatgatgagcatttttccatatgtctgttggctgcataaatgtcttcttttgagaagtgtctgttcctatcctttgccccctttttgaagacttaaatgttagacctaagaccataaaaaccctagaagaaaacctagacaataccattcaggacataggcatgggcaaggcattagacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctattcatctgacaaagagctaatatccagaatctacaaagaactcaaacaaatttacaagaaaaaaacaaccccatcaaaaagtgggcgaaggatatgaacagtttcactttctttaaacagccttccctaatggctcctcacaccaatcccaggcaaggttagttgaagacggaggctcaggagcttataagatgagaaattcttgtaatttaggatgcatcaaaacttactttcaaatagtaattggaaattttggacattgagaaaaataacagttacatgtcataagttcaaagttaaactgtactgttctcaaatggcaataagctcaattctgggagcttatgggaattgctagttataataagttacttaagtggaaatcttctttatgctaagttaatcaggcctgttactaagagaatatgtacttggatattaccagcttaggtatataaataactcttctgccaagtgcataacaaggcacattcaggggtctcatggggttatggccctcagcttgtctctggctgacacagtgtagtttagcaaaagagtcctgggcattattatggaggaccgaggtggagagaagttagaaattagtcagcctcctactggcagatgacttcagaatgtgactaatcattggaccattcagttcttctggtacttttttaaagaaagcctctgattaatggccttgggaactacttttctcctcataacacacttaaagagctcctttcccttctctaggccacaggtgtggacatttaataaattaaagcgttaaacagaatgctcccctggtctcttcctcttatgtccatgaagtctatcaagtaattatctgtaagaatgcagccatgcctggtgcagtgactcatgcctgtaatcccagcactttggaaggccaaggcggatggatcacttgaggccaggagttcgagaccagcctgaccaacatggcaaaaccccgtctctaccaaaaaatacaaaaattagccaggcatggtggtgcgtgcctctagtcccagcttcttgggaagctggggagggagaatcgcttgaacctgggaggaggaggttgcggtgagctgagattgctctactgcactccagcctgggggagagagtaagaccctgtctcaaaaaaaaaaaaaaaaaaaaaaaaaaaaaaaattgcagtcagtagcaagggcctaggaatggatttgccaaaagtgggtccctctttagtataattcctgataatgaaataaaaatgtaactgtattgaataaagttgttttcagaggtggtggatttcaagcgaaggttattttatgttgtagtcaaaagggtttaggtagaacttgctctgtaatgatgcctggactaggtaaccaaaagtgttgaaggagtctgcctcaatgggcacaaagtcggtaaacatctgggtgggatgagctctttctttagacaagtcacaagggacactggaatagtttttattcctacttctcttttaagatggagtcctgccctggggaccaaatgtaataatctaatattggtatccccagggtctctgggtcttccctgagaccactggcttcagccaagctagtggtgtctgtttacactacatgagtggttgggctccctacacagagcttaaaagggaagggggttctgtagccaaaatgagaaactagctttcacagccttccttgctcacctccctgtgggccaggtgggatagacactgcaggtaccagtctctgtagggaaacccgtgaaactgagggcctgtggttcagcagatcagcattgcagagcctcccttccagagaggcccaggatggaatagtcttgtggatgaagcttccacagactttgagaagtttcaaaataaaaacagaatatgggatggcaggtaccttcctgctgatgctgtttcaccggctactgccaggtccccagccccatcttagggagggaacaaagcatattccagctctgacttggcctctctttcagattgggagatgcctctgttgcctgtctttttaggaagagcttttgctttcaagaagtataggatggtcattaagaacacacacactggaactagaactggggaagtttcttaacccctctgtatctgttttctcatatacattacagagtttgtgagcattgagtgtgtaaagatatttatagtccttagaacagtttctgacaaacagaagacagcttatggtgatgattgttataattattaaggacagagatgggggaaccttagaaattggtcagccccttaacagcagatgacatcaggatatcaaacagccattggaaaatttaattcctatggcactcttttttagaaaccttggctttttgaatgattttccttctcatcataactacaggatatttagacacatttgtcatctaattccttaattcccatcacataggcagcaggagatctacatttgtacttctatcacacatgtaccatggagtttcagcatatttgttccatacacacctttgatccatttccctggcataagacattctatgacttgagtacatagtggttgtttggaattttgctaatactaggaccttcacatatggcttcacaagttgtgtactgcacaactccagggggctactgagcatttttaagctaatcactacctggtacacactcaatcttaaagatctttgaaatttgaatcaatcaaaaggatatttatacaagatttatatgtagacaggcacatttgaaattgcatccttctaaagataattttatatcattataacttcacaagaaaaaatttgttttcctctgttgatcctagtaatagcaaacacacacagtaatatgactgccatggaatgaaaaattattaagtattgaaaaactgaactgaaagataaaatcttttaatgtgtggattatggaaaaggaggaggcttactttatgcaaggctgatattatataccggtatatattatataccggtatatattggtatatactgatattatactggtatatactgatattatatactggtatatattatataccactaggtacagcaggttatggaaaagtttctcatagttgaagggggagccttttaacaaacagaaaatttctccagtggacttaattgatacctaaatttctacattaaaatttaatcactttcatttatacctatgtcatatattacatgtacataccttgaataggaggatgcatttattctcattagtcatttaccatgtagggcgaataggaggcccacagatgctgataagaaaaggatttcttggagaaagacagagagcactgcagtgagcaccttccatgacctctttcaagtggggagaggggcctgacaaagagaacacggtgagatgctgaaggcaaacactgaccattccaaatttagaaatttagaggatagaacaaatttggaggatagactctagcatcaagatttttgtttagcattaaccaaaagttcaaggacagactagaagtctttgctcaagattttatatttttaggatgttcttagaagttaaataaaaagctccccacttcttgaataagcagagttgatgctgcatgattctttcttgagggcagcaaaatctgcctccatgcctgacccactgtaggcatccaataaatgcctctgggacaaaatatgtttcattttattcaccttattttcaccagaaggtaatgaattatattttgaaacaaattttaggaaactacaagcttcttctttggataaacgggctttccacatcttggcagaccactgctgagtacagtgtcagcatgacttccagccgcgtctcagcctccctcacctactgcgggacttgtccggggctctgttgcataccccgccattgtatacagactcaaccaaaaaccggtattctaaagctcatcatttttgtcatttagagcacttattttctcatttcagaaagtggatgtcaccagcagggctgtgatggaaataatgactaaaacaattgaataccttcaacccaatccaggtaaggcatcatcttatatgtttaaaggatccctcgaggtaacttttagtttctctttgatagacattttaagtttggtgtgtttcttcttttggtgttgcttcctcggtccacttttctgagaggttagcgacttcatggatagcacattttaactggggagaagggctttttaaagctcacattgaagtaactggaagatctgtggtattttatctgactgtggtatatttaacaaataatgtatgcaaacagttcaggtgacacataatatcagagtagctataaactgttatcagtttgaactttcaagagatggtaagaaggaaaattaggatagtttaaggtaagatataatgattcccagaagatgtgaaaaagtagggaggtgaatcgttttcatgaaacacagagggtttcttcatagggcatcaccaaagtcttcagagcgttgatcttgattctgattcttctccaagcacatcacagatcagcattggttcctgctaacttgttatactctaagaaaaagaagtggtaatagagataacggagctatatgttgataagaggaccaggcagagttggggcagtttcggtaggcactaggtatagcaaagcaaagcaaagcaaagcagcctacctgatagacctcctcattaccattcctgtgtgtcagtttctaaccacagggcatggaaacgggaagtgaggctggttgtatttaagtgagatgtgtgaatatttggaataccccttaatcttgaggctagtttctttgcaagtttcaggttggggttccgtgtattttatggtcctagagaggatggtgcagacaactgcttcagccccaatgagtttggatactgagcaatagtggacaagtgatcaaaaaaaaaaaaaaaagggggcgggtgtgggctgagaggaagcaggtgtgtgctgtactaagtgctggctccttttctatgccccctgctgctggctgcagcttccttccatccttattcacctatgaccagcccagctgctattctgaggatgagcagactatgtaggaataactttctggatatttgttgctgttgtttttgttcataaaacacattagaaatgagcttatgtgagggaggaaaatatggaagaaaatgtgataagctataggaaccaggaatttaactgacagtggtctagatacattttcaaatgcttagcaaatttgtcaaagcactgcaaaaatcaggtttcttatttttacccagaaccttcttggtaaccactgtttttcacagagatgcaaagatctcttggatgcacatttattccttactgtttaaaccactgtcataggtcaagttctgaaagagaactgctcgccctgcttccccgcaagaaatcattatataggggcaagaagttttggtctttatctttgcctagaaccttgaagtactccatgatttcctgggattttcacgagttgtacttgtaactcatggttgtagggctaagagaaaggcagtgggaggaggaatatagtatttattgagcactgatgcattttcaatgcagtgctaggtatatgaggcattgtctcatctttaaaagtaaccatttttctccatataaagtaaaaacagttgaagaatttctagtatgaaaatagactaaaaattcattgtaacacaaattatcagtgggagctcatcagttttcctgagtataatggaactgtgctctgttgtaggtaggtgtggtgggttgcatagtgtgtctccccaaattcaggtccatccagaactaaacttataaggaatgtgaccttatgtggaaataatccttgcagatgtaagtagtgatgtaggatcttgagatgaactcttcctagatttagggtggcccctagaaccagtgatgggtgtccttatgagaagaggagaggacacagagaaacacaggaaagaaggccacgtgaagaatgagaagaggttgaagttacacgtcacgagcaaaggaatgccaggagccaccaccacaagctggaagacatgaggaaggattctctcagagcctccagagggaaccaactttgccgacaccttgatttcagacttccggtatgctgaactgtgagggaatcaattcttttctttgaggctgcccagtttgtggtcatttgaaatgacagctctagaaaactaatccagtacgctagcctcattttattcaggaaaaaacaagggtcagagaatttaaggaactttcccattcatacacctaggaagggatgaagacaagattggaactcaggtctgactacctcctaagtctctgcacttcacgttgcacgatcctgcctctgagaagggtaggctccatttcatttaggtgtgaagggtccttccctttcagagagtaccagagaaattcagaaaggaaattgtgggattaaggcttatttttattttaataaaaaacatcaaaggaggaggtaattgagaagatctgaatgtttagaaatgacatttttaatacaatattgcatgtgctaattggctgccaatataatggttttgtgactatttgagagttgaatggacatctgccactaagaacaatgaaggccattacaggcaattcgaggttggtttcagaaaaacagttatgtatgggcaggccacatacatatatgagtaagtactacccagaagagtccagaacaaaacgaaaattttgtgtaatcattccacagaatttaaacaacctgcatttaattgtttacaacaggtacaatttcatccctccaccagcttcttgccctgagagtagacactggccatagagcccagaccaggtaactggtaaagttgagagttaggcagacacccagagagacagtccttgggcacaggagagcacaaagaatgttcccaaactcgtgcagtttgctaaatactttgcccactcagcctttcagtgaaccctagagctgggccaaccagtgtggatactgaatgctggttctgaataagcaagatatggcctgggttaggacagggcctgatgccaagtaacacatttacatggacaggccaggggaatcagtaggatttgatgcttcgagggtactttgggagtacatctgtattagattactgctcccgggtgcttgctggctttcacatcttgggtacatggacaggccaggggaatcagtaggatttgatgcttcgagggtactttgggagtacatctgtattagattactgctcccgggtgcttgctggctttcacatcttgggtacatggacaggccagggcaatcagtaagatttgatgcttcaagggtactttgggagtacatctgtattagattactgctcccgggtgcttgctggctttcacgtcttgggtacatggacaggccaggggaatcagtaggatttgatgcttcgagggtactttgggagtacatctgtattagattactgctcccgggtgcttgctggctttcacatcttgggtacatggacaggccagggcaatcagtaggatttgatgcttcgagggtactctgggagtacatctgtattagattactgctcccgggtgcttgctggctttcacatcttgggtacatggacaggccagggcaatcagtaggatttgatgcttcgagggtactttgggagtacatctgtattagattactgctcccgggtgcttgctggctttcacatcttgggttcatggacaggccaggggaatcagtaggatttgatgcttcgagggtactttgggagtacatctgtattagattactgctcccgggtgcttgctggctttcacgtcttgggggtgtggagcttacacatgttttctattcttaaaactcagttcctattgaagtgatgaccaaagtgattttgtttagcttttaagaatacatggctatgctctgtgaaggtcctacatccactcttgcccatctccagaatgatattttaaaaagcaaatttggtcatattatgtaaaacccttccatggcttttcatgcctttaggattaactttcatttttaacatggcttaaggggccctccctgcatggtcagcctgccctttctccaacaccttgctaggctaacagctccctcgggtccagcgtaaaggtcacttattagccttccttggctccaaccacattaggttcccctgtcactgtccctcttgtaatcccagctgcttttcagtggggcacatgccatacttgtggttttgtttttcatctgccgtgagttcagcactgtgcctgtcttattcaccaccacatccccagcccccagctcagttccaggcagccaacaggcactgggatattggaataaatgaattatgaagcacagttgactgtcagtgtctaatgtactaaaacttctctaatacaaaaagtaggaggaaaaattcttccttttccctaaatcatcagatactcatatgtaaccaacatttgtcacatgcatttacttttatgcaaagagcaattctagatgctgtggggcagaaatgagaccaagactggaggcttgtcctctggaacctcacagtcttagtgtaagttacacacagtctgaggagaggagcccagaaggcttcacagctaattcctcctggaaaatgcagctaactgatgagatgtggaagtgtgagcgggatcacaggcttaaacgtctgccctgtgagggtgggctttcgagaacgcaggacagacagctgtaaagtcatccaagcttgaactgcaatagcataaaccagtacacattcctaaaatgcttaaataagatataatttgaatatagaaagtactgtgcacaaattccattctactggttgtaagtgcctattcttatgatatctgtgagcaaaaatcactgaagaagatataactcagttttctttacatattctgatgccttacgggggagcaaaaactgaatcgatgttgtccaatagaaataggatgcaagccacatatgtaattttgaattttctagaaaccacattatacaagtaaagagaaagatgaaattgtctttaataatatattttatttaacccattatagccaaaatattaaccactattaaaaattattgagatattctatgttttttttcatactctggatttcggtctgtattttatacttacagcacatttcaatttggactagccacatttcaggtgctcagcagcccgctgtggccagtggtgcccgtaatagacggtacagcactagatagtttgcctttctgttcgatatatgtttcatgtttacctccttggttttatgttttatcagtgggtttttcttttcaatagagaaatggattcttgatttagaattaggatatatttaggctctggattttttaaaaaaaattctgaaagtctgtttcatgacacttgaatggaattgtagacagttggactgtggaccttttccagacttagcatccttgttatgagagaggccttttcagtttgcactgagaagttactcttaccctgatgtgataatctaatacaaatttccaaactgcttacataaaaagcagcttgaatgtgaaaaatgttgtacacagtaggggtttgtttctctatggaaatgcttttcccttgaatgcctatatggtctagatttttccagcatttctgagatttgggtatcaaattggggtcattcgatgtctatttagaattttttaataatttcaaatctcatttgtgaaatattgcctgtggaaataaaagctagctgtattagtttcaaaatgtaccattagtccctggaaagatactctattaaaattagtgtacttcttttcccacaggctgtgctcttaatcatgtccttccaaagatgaataaatacagtgattatatttggtgactgtggaactgaaaatgaatacatgtattacttggcattcatgtagacaaatccttggtctcacaacacactgaatttactgttttttcctggaggacaggatagcttgtattcatctttgcatcttttagagtccttagcattatgcctggtacattgtttgctctcagtatgtctggtgaataggtgtatgaatgaatatatccatccttcacttaaagaataagggatgtgtgctgagtctagtagccagagcttttccatttccacatcctggcaatgaaaaataatcaaaatgcataaaggacagattacaaaagcagttgtgaggaaaatgttgttaagcttcaaaggaatagggtatttcaaggataaatatattaagaaagaaaacttaagtcaggtgatgggtgatataattcatatactaatgtattgaaaggctggagggtttctacttctacatctttggggaaaatattgaaaataggttcctgaaatatgtgagacactgtaagtgatttagacttttaagtcagctagaactggtggaataatgatattctttacttgtgtgtctaaacaatgaatgctaaagccagatcttgcttaaaagattcttaatcagggctgggcacagtagctcacgcctataatcccagcactttgggaggccgaggtgggcggatcacgagatcaggggatagagaccatcctggctaacacagtgaaactctgtctctactaaaaatacaaaaaagtagctgctcttggtggtgggcacctgtaatcccagctacttgggaggctgaggcaggagaatggcatgaacctgggaggcggagcttgcagtgagccaggatcatgccactgcactgcagcctgggcgacagagcgggactctgtctcaaaaaaaaaaaaaaaaaaaaacaccagattcttaatcataacaaatatagtatacatttaaaatgcatgtgtacatgtatattgagaattaagttaatggcacctcacgtgaatagtccctaaatactataaataaataccatacctaaatcctcagcatggcctttaagatccagcatgtggtggcccctgtgctttctgtctctcctagttccttctccctcttgttcactctgtggcctttagtttcttcaattcctcaagttctttgctgtatcaggagtttgtagcggctgtttccccttctcctggtagaatatgggccctcatctgccccttcttcgacaactgtcttctcaccatccctcctgtctcagcttatgtatctcgactctgagtggtgtcttctgagggccaagtcgaaatcatttctactccagttttatattttcatgctacctttatatcacatgagttcccctcaacaaatctcttgagaagttcctcacttagaataaaattgaaagcacttatgtgggttacaaagtcctgaggatctgagctcattccttatgttcctggctgtctccatctcgctccttctgagctagccttcctcaaacacacaggcactattgttcatggggcctggccagcccctttgcttcaatcacttcctctccatgtcttctcaaagccttcgctggggtctctgctcaaatgtcacctaatttgtgcagctttcctgaccatcttgtttaaaacatcagcccttctaacttcctaagccttttcttgttttacttttcttcagagcatttagcaccacttcagatgtacatttacttgttaaagtgttgcttgtcactgctaccgaaatgcagtgacgcagtgacttgagcacaggattgtttgtacactgcaaagagcccaattctattcttttattgcacttttcataatatttactttatgcaacttatgatttgttcactatactgcctttttccattattactctcctattttacattcttcacatagcagccagttccatccattaaagatgtaattcacatcttgtcactcctctgcttgtaactctccactggcttccattgcactgagaattatcctcagacttgttcctgcctcggggtctttgcacaggtgtttcttctgcctggaacactcttctccagctcctgttaatgtctgctgctcctcatcactccaccttcagtcagatgccgtctccctgtacagtcctttcctgcccccacccctattgaaaatagtttctcctcatccctctcatacctccttatattatttcctatcaacatttggaattatcttctaatttatctttttgtttattgttttcacatcactcccatttctcatatagaacgtaatctccagaagggtagaatcttgtctgtcttatttactattcgtaataatggaagtagtgccctcagtaaatatttattgaatgaatgctgttcatctcttccagtatattgtaaacatagtcattgaagacaaggactatgtctcttttactcctttatatatacccagttcctagcacagagtttggtgctagcgattgattaatttgcttaatgaatgaatcaaatcatgtgaagcatacataagctccatcttacgggagtagctaacttttcaggtaagtgtcgtggtctgcagacttttacagatcagtatcagagctgttctctgtgtaatatctatttggtgtcatgtacaattagtatatttcacaattgctttgggaaaagtgtggatgtgcatactgtcatgtataaaatcactgggctgaagctattaatagacatttgtgtttatatacatagataatagttgtatctatttttgaatgagaaaactgaagctgcaaggtgattagcaatttgcccgaagtatacaacagaacagccagaatctttattcagatattactatctccaaggcacattctgttttcaaaacaaaatgtcttatgctacaaagtcttaaactacaaagatacctccaggcttggtaagtgtggcaagtgtactctagggtgacttgtacaggttcacacccttatataatcccttcccgttgggtgtagatggaacctgtgacttgctgctaaccaataaatatggcaaaggtaatggaatcaactactcaccactcccttgatagtgattacattatatggccaaatcgatggtgcatcactcccatgaccaagtcacattatgtgagacagtcttagcagactaatacgagagacattcccttccttgtctagaagaagcacactgccatgttatgacagcccaaggagaggaccacatgtcaaggaactgggggtagtctctagaacctaagggtggccactggccaacagccagcgggaagccagagctctcaatcacactgccacagagaagtgaacagcccggactcaggaagacagcaacccacgtgagcctggatgcagacttctcccctctctggcctccacatggcaaagcagtctgactctacattgtttgcagcctggcgagaccctgagcataggactcaatttaggcatgcccagacttacttgcagaaactgtgaggtaatgtgtgttgtttgaagccactgagtttgtggtactttgttattctatgtagaaaactaatacagtgtggctgttcccagccagagctcctatttcaagcatacaactgtctgctggggccatcaggctatttgccctgtggctttaggctccttggataccttacattgaagtaggaggtagattgggaacacctgtcactgtcttttcagcttaagatgaggtctcctgaaccccccagggagtataggtcagtccagttccaccaaagactgaagatatctttgtgttttgaaacatgatagcaaagaacacttggcacagtgcctgacacttagtagggactcaagaaatattatgcaccttcctttcctggggtactgcagctcaacctagggcatctcagatgctaacccagcagttcctccctgggcaaggtctttagaaatcccactgcaggacccttcttacaataaggatatattatttaccaccaccctctatttgctctgaaaacctgagaaagcaaaggctgatgatgttagtacactgagggttgtgtatttttcagatttcacaaactgttttatgcccctgagggggacagttgcctgctttgccagggcactctgtgagacctgtgttggcaccttgcagcacccaatcttgaggtgggagatgtttgctgccccatgtcacaagttcttagggctgctgactgtgtactacagcacagggtcttaatatccctccctgctgtttcctacttgaggcataagagagctttgtcaccttggagagaggtgttatataaataccattatttgggttgagagtagcacgatccagtgctagggttgtctatttgtgtaagtcagtaggcaaatcttcctcttcccttttctcagtgtcttctaatagttaactacaaaagaaacaacatagatgtgagtatatttacctaagttctcattacagtataactctttctgtcattttgtaattgttagtgtgcaaaacagcagagcacattggtatcagtgcagagagcatcagagggccacgtttcagacttgtagatgctctgagacttcacctaagaaaaccaggccataatatgcaataatcacatgttgccaaaatgaaatgcatgctaagatgctatttattacataaattttgttggaagtattaagccccaaatcttatttagtgtgatttgaggatttatactcatcttacaattgtaatctctatattagacttcacaaatttagttaaaataatttagaattaatttttcttatttttcatagtaaaacatgcataacatgaaattatcttaactatttttaagtatacatttcactggtattaaatacattcataatgttgcgtaatcaccaccaccatccatctccataactctttttgtcttgtaaaagtaaaactctatccccattaagtaataactccccctttcctacttcagccgctggctaccaccattctactttctggctctatgattttaattattctaatcacttcatgtaagtggaatcacatagcatttgtcttttttgtgacggctttatttcacttggcataatgtcccaaggtttacttatgtaatagtgtatataagaattgccttcctttttaaggctgaatagtattctgttgtgtgtaaatagtgcaatttttatatagattcacctgttgatagacaactgagttgctttcacattttagctattgtgaataatgcttctatgaccatgagtatacaaatatcactctgaaactctgctttcaattattttgggtagatatccagaaatggaattgctggaacttaagggaattctattttttatttctgaggtaccactgtgctctcttccacagcattttactttctcaccaacagtgcacaagggttcgagttactctacatccttgctaacgcttgttattttctggttttttgatgtttaccatccttatgagtgtgaggtggtatctcattgtagttttgatttgtaatgacctaatgattagtgaagttaaccacctttttatgtgctttttagccatttgtatgtcttctttggggaaatgtcaattcaagccttcgctcatttattaatccagttgtttgggttttttgttgcgttttaggagttctgtacatatcagatatgatttacaaatattttcccccattctgtgggttgcctttttactcagtttctagtgtcttttgatgcacacaatttcttaactttcgtgaagtccaattgtgtaattttttttgttgttgcatatgcctttggtatcatatccaggaattcattgccacatccagtgtcatgaagcttttgcctgtgttttcttctaagagttctagagttttagatcttacagctagctctttaatgtatttggagttaatttttgtatatagtattagaaaaaggtccaaattcatttttttgcatatagatccatttttcccagcaccattggttgaaaagactattatttctcgtgagtggtcttggtacctttgtcaaaaatcatttgaccgtgtatgcaagagtttatttctgggccctctgctctgttcccttggcctacatgtctgtctttatgacagtaccacactgtattaccatagctttgtagtgagttttcaaatcaggaggtgtgagtcttctagctttgtttttttaagattctttttgctatttggagtcccttgagattccatatgaattttagggtgggatttccatttctacaaaaaatgttactgagactttgatagggattgcattgaatctttagattgctttgaataatgttgacatcttaataatattaagtcttcgagttcatgaacatgggatgtatttccatttatatatgtcttttaaaatttctttcagcagtgtttggtagttttcattgttgaagtcttttacctccttggttaaattaattcctgagtattttattctttttgatactattgtaaatggaattaaccttttaatttccttttcagattgttcgttgtcagtgtatagaaatgcaactgatttttgtgtgttgactttgtgtcctgctactttgttgaattcatttattagttctgacagctttttgtgggaaatctttagagatttctatatgtaagatcatgtcatctgaaaatagataattttacttgtttacatccaatttggattcctttttcttaccaaattgccctggccagaactttcagtactgtgttgaatagatgtggtcacagtgggcatcattgtctcgttactgatcttagagtaaaagctttcagtctttcaccatttagtatgatgttcattgtgaggttttcatatatgacttgtaccatgttgaggtaatttcttcctattcctagcttattgtttttatcatgaaaaggtgttgaacttagtcaacacttattcctgcatcaattgagatgatcgtgtgtgtggtttttttttttactctattttgttaatgtgaggtattagatggacccatttttgtatattgaaccatatgcttgtatttcaggaacaaataccacttggtcatggggtataatttttaaaatatgctgttgaatttgctttgctagcattttgttgagaattttcacaacaatgatcgtaagagatattggtctgtagttgtcttgtagtgtctttgtctggctttgctatcaagataatgctgtcctcatagaatgagcaggaaattttccttcttcaattttttggaaaagtttgaggagagttggtgttagttcttcaaatatttggtagaagtcactggtgaagccatcagatcctaggcttgtttttgttgggagatttttgattactgattcaatcttcttactaatgataggtctgttcagattttctatttctttgtgagttagtcttggtaggttttgtgtttctaagagtttgtccatttcatttaggttatacagttcattgttgtgcagttgttcatagtactcttaataatcttatttacttgtgtagatcagaatgaatatccccactttttatttctgattttagtaatttgtgtcttttctctctgtttttttctagttcagctagctaaatgtttgtcaattttgttgatcttttccaagaacaaacttttaattttttccatcaattaaagacatccttggctcttgataggtgatgaaggggcaagtgtatttttagctgttggttgccatttcaacgaaatagccgtcaactgtaattttctccaaaagtgggaaaatagagaaaaaaactaacatttttctgtacttcattttccatctgtaaaatggagaaacaaaacccatctgttgtgttttgcaaggctggatgatgtgtacgcattatatatgtagtagataacttctgaaattatagttataggatgaaatctggttatggtcttcagtttttcaggtatttcagggctctttctaagtttctggaccagatagtagcaattaatgaatactactacaaattattcggcatttgtcctgctcaagatctctgctcctttgggtaatgaggcttggtttctataagacagatagggatgacaaaggaattaggtcactaaaagcagtgaaagacttcagaaaccatgtttcatgtctttggtcttccctgatggatgctaaagccattaggtttcccccaacagtcagaacacaaagatgtgacttggagtactgtggccacctgttctgcccaagtgcatcagctgtgttcatcaactcacaccaagggtgggggttggattctcttcttccctgttgtgatagacagatgccctgtcattatgtttttatgtgaaatttcacagtgaaagaaggaagccactcttgagaatacagcaatttaaatcaggttgtaatttttaaaaagtgatttacaaaaggtctttcccaaaatactgccatcataatcatctagggtggggagaaaaatagggtgcggagggcagaatcacccctcatccttgctcttccagcagggaacactcattttcacacccttgtgcctctgcagccccaccctttgttgaggtttgtgctgggcatgtacgttccacagagtctgctggtttccagtgtgacagaaatctcatttgtgataaaccttgattttgaattgtagtaaatgaaactttaaaaaaagcagacattaaaactccctgtttttttccctaggaaaaggagcattccatcttctggcatcactgtccttgggactaaacccccttagaaaacaccgcttttgcctagccctcagaggcttggtcccctgacattttacacttttccagaaaaagaatctcaggggctttcctacaaatgtctgtcacaacctcaacaacctcacaacctcaagtctgtcctattttagagacacacacacaaaaatgctataaaggaagtattaatacttgtttagagagattatcaggaacattgtacttaacagtgagaaatctgaataatgtgtatatgagtgtgttatgttattctttgtactttgcattttcaaaatgtcccatctttttttttttttttaagccaagaagtatgataatacttacctggccaccacagatgagaattgaagtgcaataaaacttgccacaagctgggaggaaccagcagtgtgctgctacaggcttaacaaccatctttctggaagaaaaaccttgatttgtagcatgagccagtttctgtgtctcacatggccattttcaagctaccagtgtgacatcactgaactgtgacttggaaaaagaggctcacacttggctcccctgagcagtgctggcctaactccagcacaccactggattgaactgccaagaaagagtagctcccacggatagggaggaagcaaatgctctgtaaatacctgtagacagaggcagggagacctttgtagaatggagagtgttagggaccttcctcttctttatttgggaaaatcttagattacatattcattggttgatctcatgcttgtgtgcttatggaaataaagcatttagtcagtaaaatattgttacccaaggactcaataaccatgcagtcaataaactgtatatatttttagaggcttctttcaaacataactttttaagatgactttattcaaaaagagtaaacccaggtggaatatttataaagataaaagcttcagaaatccatgtgaaatgaaaattatgtaataattggtttgctcacaaatatagtaattcagatagttttaaaaaattactttgatttaaagtttgttaaaataatcaagtttaaaaagaaagtatatgggttgagtgatatccctcccaaattcatttcattttcccccggaacctcagaatttgatctatgtcagctcaggctgccataacaaaatatcataaataatagaaatttattttcttgcagttctggaggttatatagtccaagatcaagttgcttgaccatgttttaatttctgatgagggctctcttcctggctggtagttagacgccttctcactatgtcctcatgtaaccttttcgtggtgcatgtgtgtggagggagagagattgttctctctcttcctctcttataaggttaccaatcctactggattaggactttgacctcctgacttcctttaattacttcctaaaagcactatctcaaaatacaattacattgggtattggggtttcagcatatgaatttggggaggacaaatagcagtcttcttaccttttttacattcatcacttaccaactctattcctttagcgtaggttgggctctcatccctatctttagttttatactagaggcagactagatatttatagcagaacccaccaactctaagaactttcctcttgtccatgacaatctgggagtgccatatttatacatttcagtatacctcttggttaacatacttccataacacaatttaccatactggtcatagcctccattttattgaatagttccataagtgccaggcacggtgctggatactctaaaacatcatttgtaatcctcacaataaacccagcaaggtagctttgattttctccattctgtagatgaagaaatccattcatttttttcagttatcttccacgtttactctaaggcagttctgagccctgggcatgtatgagtgaatgaggcaggcaaagcccctgccctcatggagcctatactctggaaggatgagactgatagagaataatacctaatgtcagatgtgatcagtgcagtgaattaaaatgaagagtaagagggggagagagtgaccgggtccaggaagttctcatgtatatgagaacaataaagtgccatgttggctgggggaggtcagagaggcaagagcagataggaccttgtcaccattgttgggactttgattcctaccctgaatgacgtgggaacacattaaagtgctttggggagaagagtgatgtgatctaaattacactaaataggactgtccttactcttctattgagagtagattatagggggcaagcgtggaagcagggaggccagcaggagcttattttaataatccaggctgtagatggtagtagcttagaccagagtgagaaacagtctgatcctagatgtgttttgaatgtagagctgaccgaatttgctgactaattgcatattaggcaagagagacatcaaagataactatgaagtctagtgcctgagcaagtggaagaatgaatggagttgtattcattaatattgagagtactataggaggagcaggtttgggatgatgatggaaaatctggagtttagtttgaatatgttaagtttgagaggcctacacatcctagtacagtcaagtaggtattagaatgccttagtctgtaatacagtgtaaagggctagcctgcagagatacatgagaatcatcagcttgccaactcaaggaggtgatacaattggccagacctgataagaggtgggacttcagggcccaggcttgcttgcttatatccccaaggccccttggacacatgcttggtggcctaacccactggatagtccaaatcatcaagatagagatggggtccttaaatctatggttttaaaatgttttctgagtaattctgatatgcatcaggttgaccaccactagtaaaagcctttagacaaggattttgttttttggagacttaggggtttccatctgaaactttgagtcccacaggaaatttgacggaatgggaaagagaatgggtttgggagtggctcagacctgagcctgaatccaatcttttcctgttagtaactatgagagctcggataggctttccaggctctctgaggttccatatcctttctttatagatgcagcccatccctctttctgcaaataggagtaattgaaccaaacccacagagttgtgaagattaaggtaaattgtttgtataaagctcctggcttagagtagacaccaattaaaagctaatctcacctgccacatataaaaccactggaagaaaactgttcttgaattttgtttcatcttcatttgggggcaattatcttctgcttctttctgttatctaatggcctagccttcaagatttcagatgttgtcagataagttggttttctttaccccccaccaccatcctttgagcccaagaccgatttgcttggttgtctgctatacaaccacatggatattgttagactttgtgtttctgcagttgaagtacttacacacttccactctaaaatcttctctttgtcctgtgttctttatctcacatttgtatcatcacctcccacgttttcagtctagagacgaacacagtggttctcaaccttggctgcacattagaatcgcctttgggattttaaaaactgccgtgtccagaccacatgccaaaccaattacatcagaatgtttaggagtgaaatttctgaatttgttattgatctgtaacatacaaaaagtacaacacatatatcataagtatattgctcaatgaactattataaacttctgtttaaaggtacatggttcaagaaactgaacattgtcaacatcccaaaacctccttccacagatcctagctgcccttacctttaatactatacatttttatctgtcttgtaactgaaatatgatcatagaacatgtattcttttgatctggcttattttgttcatctttctatttgtcctacttctttcattctcattgctctgtagaattcccttgtgagaacatagcacagtttacttgtccattttctccactgatgagcatttaggtgtttgcattttctagatattttgaatagcacagttttttttttaaattttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccatagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttcaactagtttacagtcccaccaacagtgtaaaagtgttcctatttctccacatcctctccagcacctgttgtttcctgactttttaatgattgccattctaactggtgtgagaggatatctcatagtggttttgatttgcatttctctgatggccagtgatgatgagcattttttcatgtgttttttggctgcataaatgtcttcttttgagaagtgtctgttcatgtccttcgcccactttttgatggggttgtttgttttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattgctttgtacatgtctgttatgcatgtacacatttctgatggatatacacctagaagtggagttactgggttgcagggtatgtgtctattcagctttagtaaacactaccaaattgttgtccagaattttctaccaatttatcctcctaccagcagtatttgagagttctggttgttccaaactctgaacacttgatctatctctgttttgtatactttactcagattctccaggtacctagaatggcctttcccaggtctctccctttacggttcactctttcagaaagcccagctcgagcatcatctgttcattagccttcccagccttactctttcaggtggaatttgttactgtgtcttctgcagtgtaaatattaatacattacagcctcacccacactctgcctcacagcagtgagtgagcactctgactctccacctggataataagctttttaagagcagaggctgcacctcacttctttcagagtccccctagacatagcacttgcacattataggtgcttcatgaatatttcttttgctcactttatcacagagaaaatcttttaaaaatagatttttggtaaatgactatattcaaccaggcagtgaaacttcacatttcttctgtatagggaatgcataattgtttccagtgtaacctccttattgattttaatcaatttaatcttttttaaactccttggtgtgggactcgtgatttggtgtaggactcatgatttagcttgggaactctctttttcggggaaaataagagccttttttctgattctgtgagagcacgtgatcactttttgtcatcctcacatagagcagattttcatggcataatttaagaaggaagtgcttccaaagagccagattcctaagggaagattggagtgaatgatggtaaaccatatagctttttagcctacctgagaagtggaactgtactcttctgtactttacgaaatggagtcaggagaaatgaaaagactcagtggtagccttggaatccttaacatttaattagtgtgaaggaaaagcaggcctggtgccaaggagacctgctctcaaaccatcctatgagaccacagagtgagtggtgtgatcagattgtatcagcagcctctagtgccattccaaagcacagtgggcggtcatggtacttctgaacaggaaagctttacctaagggtttgaaaaaatgatgtatacagaagcattttataaaaaattaaaatgtttaaatgaagtaattcagtacacagtggggaagagcaaggaaaaactggaagccacaggcacctctgcatctttctgtcaccctctctaacgcacgccagccttcatagtattagggctgctgcttcaacttcacctcccaaatcttgcgcaacctcactttggaccaattctgatttttgtccatggaaacacgcaaggaagggactctgggcagtgcagttctctgtgcaaccaagttgtcagtagagcattccagaacacacacacagacaggggagcctggaaggaggaaagaaagaatattttccccagtatccagtgcctgttgtgttgtctgtgctggtttttgctgtttatcattgaacactgataacagtcttacaaatgagagatttctcagggattcacagctaactagcaagatttatagcctggatttttagctatgtctgtatgtgctcaaagctaatgttcattttaatggactctgctgttttccatggaaagcaagacctagtggttttcctgtttgtttgtttggattaggaaataaaaactaagatttagcagaagtactgagtttacagcatcctcagctagttgccacactagataagtagctgtaggacagaccaggcagtgactcacatggacactgcttttaggtcagaggaaaataactcaggcagggctagcagagcttccattttattctcagcagagcttagatctccctttggctgttcccagaattagaaagctcgtcagggatgctacagattatgctttagagttgggagttaagactgagcctcaactgcccccatttgtcttccttaaaagacagcataaattttaaggtcaaaaaagaaactactcattttagcagaggacaaaacagtggagcccttttgggaataggtcagccttttatggtcatcctaattttgcttcctgctgttttaattcacccaatacatttccttctgggaatcacctagaagtagattcatgggtttgaaggagaggagttaggtatgtttagaagagaagggacacagatctctaagggcacatacaacttggtaaagcaatccaggttgagagtatataataggaatttgagtgctttaaatttgtattttccaggctcactctcagtttcttaaagtactgcttcaaacaatcatttaaagataattatgttaacatttaaagatggttaatttggaggtctgatgatatttttaataacacagaagtttcattaacccaagattcttaatatgtaataaatttgtgaatgaacttaaaagctagtctcttcagatatgtgaattaataggctttttttaatcatttgaagtagataagctagtagaaaatggctttcttcctccttcttatgaaaatatagaacatatccaagatactcttagtaaaagaataaagctcttcataattgaacaacattcaaaatgatgtgtttgaaaatcagccacagtgtattaaactgtttagaattacttacctggagacagcccttaatagagccaagatataagcacttaccacatccagcttttataaaaggaatgcatccttaaatgtaaaatggcctgaataggatttgtagggattaactcatgtgtggtttcattactctgtttctcctttccttctattcattctgtgtgttttaggtgttgtttattttatttgcactgttttcattttattcgtgctgtcattcttcagtgtccccctagtaccatgatatcagccatgataatatttatcatacttgttgccactgtttatcttactcctcactatattgtgagcaccttgagggctgggactgtgtccttcctggatctcagatatgactcactgcagaaaataatgatattgttcccttaaaaatgattctgtggcattttctctttttaaaaaagagacaggctcttgctgtgtcacccagagtggagtggcaccatcatagctcactaccgcctcaaactcctggccttgagcaatctttccacgtcagcttccctagtaattgagactacaggtgggcaccaccatgccctgctaacttttaaatttttctgtagaaatggggtcttgctatgttgccttgctggtctcaaactcctggcctcaaatgatcctcctgctttgggcaccaaaggtgctgggattataggcataagccaccacacttagcctgcattttctatttttcaaacttaacatatgatcccttttatatgaaaaagcaaataagaaatgaattttatattttttccagtcaccaccagcctttacatgtgctgttagcctaactgctacatactgtttggatctaaacttaaagatacttccctccaggaatcctttgcgatgcccctccccaactgatgaggacagtgccgcatatctgggactctcctcaatcccccatcaaggcacttggcatatttacttcactctaattaattttaaaatagactctaccctcagttcattataaactttgtgaaagcagggaccataattgtcgtgctcattgtaatatccctgggacagggttgcaggatgtgctctcctgataacttttctcatctctattcaatgcctctaagactcaaagtttaaataaaagccttgtgaaataaatgtcaagattgtcagccactgaatgctggaagtaccttaagctgtgattctatctggggtttccattgaagatgggatttggggtatagtcctaggttaatgtgtaatcccaactctaattttgaacctgaggaacctaggtatcctagcatcaattaagtcataggctttaacaatttttttaataaagctgtttttgccactaacactggaattggtttctaggcaacttcttttataaaaacaaaaacaaagaaagagaaattgaaatgttctctttgaggcacaaaactaattttctctagttatgtgctggagaagtgattaagtcttttaaatgaacacagtatttttgctcttcatgggtctgtttaccatcagaatcttagttgagaaatgattttgaaaatagttctgtttcatacatggtataagtgaaacaaggcataaggcccactctgcaggaatttaccattggttccttattttaatccttagactcctagaattgaactataaaactagaataaaatttagagatcatcacataattcgagagtttgtaaaaagctctccatggaagcacccagctccacagagtcactgcaggggccaccacagtgaagggaggatggggaagggcacacagtgatagaatttgagcgtgtaatcctgcttcatccagaacagaattgctgtaattcattttaagatcttaagggaaagggagagtttagtgctttaaaaaagtggttgataagactgactgacggagagaacactggagcgtactgaaggtacacttatcagtagctgagctactttgtaggctgctctgagacctgatcctccatccagccctatttccgcagtgtcacattgcctactctgaaagcttgttctctcttcaccttcagcttccagagctaagctcagcatgatcaacaccatgtcaaaaatccgtggccaggagaaggggccaggctatcctcaggcagaggcgctgctggcagaggccatgctcaaatttggaagagagcttggagatgattgcaactttggtaacaagtgcttcctcacattgtaattctttcatttgtccatggggattttggtgctggtaagaaattctgtagggaatcggtcaaatcattttatattttggttttcagttttagatcctacacacatgggccaaaaatttgttttcagaattatttcatccgctctaatgtgatttatcttacaagttttcttcccaccccccccactataagacctcagtctttacaacagctttggttgacatatccagatgcctccttggcactttctattgggtgtttctggcagtcattgagtattgaagcagagtgagcaggcacagtcagcatgattcaaagccctccctgcctcatggcctttttcatagatctttgctcacttgtatatggtacctagttctactgcccaaggtgagacatgatttattccttcaccctgtctcccccaaaactcagctaccacacccaacatcttctattttcacccccttgtgatgtgggatctccttcctggttgaacccggctatttctggtacttgcttctgctaatagatttgccttaagctagtcccacattagggaaagctggtacttacaagagagggcagggagcttcctaaattgcttcttaaaggaaaaagtaactgttccattcttgatgagaggtatttaccctcttagggggcattgagtctgttgcctggagtgaactgaagatacctattctctcttgtctgttgtctttagaagacaagtggtaatcctttgggttttcatctgtgaagggccctgttattgcgagtgcatttcatctttattctgtaacatgaaagagctttattctctcctaggcccagcacttggtgaggtcggggaggccatgcgggaactgtcggaggtcaaagactctttggacatagaagtgaagcagaacttcattgaccctcttcagaatcttcatgacaaagatcttagggaaattcaagtatgtacaatgagtcttctggaaagtgggcagttgaaatcatacagatgcagatgccttttttctttagaaaacatttttttagcttaccctgtgtgttgtcagctctgggcacgttaattacaaaacaacccagtaagacaaaatgagagaaaccagaaatgtgatacttttcagcctgttatgactgtgccactcatgagggctgtctctggcttctctatgtttgattttcatattgaatagtttttttcagactttttctccagaggataatatacttttcctgagaatacacagttttgttaattattctatggtttgctgggctgatttcacccactaaaatgttagttgtactagttgttagcttaaataaatagttattctatcactgcataagcacatatttttatttttttccaagtctagaaattagatggatgttatgtgtttttatattaatattttcataatggttgttaggattgaggaagaataccaactagccactttttaaaacatgtagagcagttgagctgtttataataaagttcatatgtctttgagtgtggaatgtttgctcacttttttttatctaacaaatatttgttgagcttttttgaaactttgttgggtgtaaaatggattgccataacttgaactagggcctcctcctccttattctagcttaaatctcctttagcagtaccatttgctcaagattatagagttagtaagtgacagactgaccctaaatccaaaatagaactctgactccaatgctgtaccctatagctcaaatgtttaaaaaagaaagttccttccaaatgagcatttagtttttggatcagggcatggactgaggggcgggggatgcagtgtgagggaaggtttagaatattattcttcctcctttccttttcatttttttaactactccctactttgttttcatttcctttcattctgctccatacatactagtaacaagggaaaatccaggattttccttcatccattagtagtgaaagactagctatcggggaaaaacaatactttttagctttggaaaactactttgctacctggtcactagagatgatgggtggagcctgggcagccatctaccaggtatggtgcaaggaggggattgaagctcagcatggagcattagatataatcccttggtaggtcccttccaagtgagattttgttcttgagttcaattatatgtcaagtgggaggcttaaactaaatcactggatttagtttctctggtgacagctgcatcagtcagctggggcaagtgttaagatgtagattcctaggcccccaccctagatatcgattcaagagctcaggaatccatattgtgatgagcaacttacgtgattctaacagactggatgatttgaaaagcaagactgccatttctatctcacttaatttcaaggaaagagtttttcctctggcttctcatgagataccatttctcttgaagacagggcctgtggggcctgtgagtgtgtcctttcattgtgtgtagggcatgtgcattccttctctgtttctgtcatgggctgcaaaggcttagtccagcttggctttggcctgacaaggccagaaaataaagggcactgatatttcctataatttatcttttattcttaattatttttaaagatattcccccatatttagcctttgaaagcactggccccattgatgcatgtttctttatttctctggtggcgttgtattttaaaacttagcctatcttaatttggaagttaatggacgtgatggagaagtgagctcaaataagccttttccataagccctttcaaagcctattcctgcccttgacttttgcagcatcatctaaagaagttggagggtcgacgcctggattttgattataagaagaaacgacaaggcaagattccggatgaagagcttcgtcaagctctagagaaatttgatgagtctaaggaaattgctgagtcaagcatgttcaatctcttggagatggatgtaagtgactcctgtggttttcaatttaatcttatcatcgaggcacaacattaatatgttaaaggccataacccttaaaagcattaatatctgattacactatgtgataagaacttcagtagatagttatttattttaaataattgtcagtcataaagtagactgagaaatagaaaagtttcttctgcattcctgtagtttaactagattctcgactgctaatgaatcttaaagtacagatgctccttaacttatgatggggttaaagtcttgaatatatcatgtaatttatcgaataatgcattaaaagtaaaaaacagaatggttgtaagggtacttgaggtatggtttctactgagcacatatcaattttgcaccatcataaagcctacaaatcgtaaagtcagggaccatctctcttatcaatagtgggaagataaaggatatttctgaggatctatgtataactcaatagaggcctgagaactcagttgtggagcagggggcatcagtagtactggtgcaagtcccagagtccaaaggccagaaagcctagagctgtgacatccaaagacaggagcgtatgggtgtcccttcgctagaagagagagagaacaaacttgcctttcctctgctttttattctatctgggtcctgagctgagtgggtggtctccacccccatagggaagggcagctcttcctttgtttagtctactaagtgaatgccagtctcctctggaaacaccctaacagacacacccagaaataatgctttaccagctatctggggatcccttaatctagtcaagttgtcacctaaaattaaccatcacattgcctacttgccttactcctgactgtggcaggggaagtgtgttgaacatatccagactttcctaccacctggagacagtgtaggtttttgtttatgtaaaacaacttgtgtccacctaactcctcgagaggaatactgtgtgcatgaggggtgctccaaatcacagtgctccttccctgcaacacagcacccctccccatccccaaattcatgggacaacactgcttctgttgacttggaggctgctacccagctggatcataatgtgaaacataaaatcaagagaaatcaagcttagaatattagagcaagaatgaactcaagatgtcacttgatttaacccttttacattacagatgaggctcagagagcacagaagattttctgtcataccatgtcgcctctccgggtacattatgtgagatattgtcacatttttattaacagtaccgatattaacagcatgaaaagtataaggaacaaagagtcctttggccagtgtaccttcttttctatagaataaaagaagtcaaatcccagatacaagattgtagctaagcatgagactctttagagctatatggtcttcctgagggttacccatgttgcttctcctcatggtactgatacgcatgattctaagcataaggatgctttcttttatccttgatggatttgaaacctgcagaactatctatcttagttggcttatcacacagtcatcagcaccaccaaccaggggctgtgtgttgagggcagccctggtgtatgtatgaaacagtagtggctgtttagggatggtaacgtgtaaaactaaggcatgattttcccatcaatctgcagattgaacaagtgagccagctctctgcacttgtgcaagctcagctggagtaccacaagcaggcagtccagatcctgcagcaagtcacggtcagactggaagaaaggtattctacagttccctgcatttcacatttgcattttattgctataaaatgatgtataaagaaatggaaatcatagaatacatttggagacaaacgtctgccaaaattccgcttatcctacagaggcgccttgtggattgttttgattttgttttttcttgtgctttgttttacgttgttctgttgaatctaattttctgcttatgagagatcgatacttggattatattttggctgccacaggtggaacaccaggatgctactgctgataatggatgccatttgctgagcagttattccatgtgggtactggatacatatcatcatcaatcttataacagccctgtaacctaagtgtttttagcctcgactaacagatgagtaaactgaggctaagagaggtgaagtaactagcccagggtcactcagtggtgcaagtggagttcacagccagccataacctgtgtgagaggctgtttcttttcacatcttgtgtttctctgaatggcggtcaagtcctctgccatcagagagagctactttcacctcattagatgtacctcacagcagggctgtagtagtaggaaactaccgtgtgaatgtggctccgtggagttgtggggcacagcctgtttggctatataccagtggccctatgttataatatgtgttattttaatttagccagattaaacaggatgattttgctgaacatgtatacctcaaagggtcacctcagcaagcttttttcttaggccacatggccagattagactctcacagctgatcacatggctgcctgcgtgaagaagacaccaatcatacgattccacacctgttttcgttgttttccctcaggctgatctcatttcagtattttctttgattcatggtttaattgagcattttccttcggcgcagccttatggaaatttatgtaatgctgaagcctccagaaaggttttaaaaccatatacttcaaagatactaaagaaatactatgtgtctttgtaatgtctcttgagcatgaagggagccctttcctttttttcctctgaaatatgttcaaagtcagtatcattctacagttaccataccctaaaccctcgccctcccttgcatatctcttacatactttgtttattgaataactgaaactttggaaaatatttaggggtatgtagaagacaattattagccatacctttccaatttccttttgtcttccctctttcctttcctcctccctatatttcaaactgctcattcttctaagagcacacagtatatttcctccttccctctgtccaaaccttctcatgttctgaatagaatagctccctttcacattttcatctggaaacagctcctgtgtatcttttagttctctccttaaacctcctccagcttccttatggagagatagactccttcccaccttcacccacaaccacacccctgtgttcctgtggcactttgtagatatctctgacagtgcttactaaaatttatagtaatcagttgtttgtgttctgtctcccttacagaccataatctgtttgtgtcttttttaaaattgaaaaaattgtgggtacataggtgtatatatttatgagatacatgaggtgttttgatagaggcatgcaatgcataataatcatatcatggagaatggggtatgcatcccctcaagcatttatcctttgtgtacaagaactgtgttttaattcatttttgtgttcctggtacctagcacagtgcgtatttggataaaggactctgaataaatgagagaggaagtgagggattgagagagagaatgaagacagtgaggacatggccccataaagggacatcaccaaaatctcagacatatacatacaagaaaactaagggtccttttttgatttcccacacttcatcatggtagcatggtgggtgacccaagcatttcctgaatctttatatttgcttttcattttacttcttaactggttacataacctttccaccacttttctttttactgcagaataagacaggcttcatctcagcctagaagggaatatcaacctaaaccacgaatgagcctggagtttccaactggagacagtactcagcccaatgggggtctctcccacacaggcactcccaaaccttcaggtaagagctgaaactgcagatcctattgcatagcccttggcatatccattggcactcttccagaaattttaggaatagtccaatctggctgcataggaaatatgcagtaatacatttcttatggagtcagttgtcaggtagaaactctgttaaaggaatccttttgtctttttttcatttaccttttctttccttccttctcattcttctctataaaactttctttgtatatcccattttctctgtcaatcatcagcacacacgaacacattttgttttgaccctcctttgtggtcgtaaatcgcctttccttgtcagtttggtctgcgagtgtcatcttttctcctgcgtgttcgctctgaatccagcctgtatgacagtgaatgcccctggacagtgtgtccccatatgcattcgcatataacccacagacagcaagcggctccagaaatgtgctgatgagctggatttcttgagtcacagaagcatatggttaaatatatttgtagaagaagatattttgaaactcgacacttgctgggttttccttcccatgcctcacctctgatcactttatcatgctgtggcactggggttgatataataaaagctagatgacattttatctcaggaatatcgatgcataccaaatagagcatcctttaccttgtcacacttgctctccactcctacacgcagattacacaacagcctgtgctggagacattttcaacctccacatttgcttgtttgaagtgggaactgtcttatactggatgtggatgttagagataggtagctttcttttatttttcctgtatccccagtgcttgatgttctactgtagaaaactttttataagatgctctcaggagacttactaagaaaaaaagcgaggtctgagccggcaggtggtgctctctgtcctttgcgctcagcacttcagggcatgacataagcagctgtggctcctggagctggccaccaggactagtcacagaaattgtgtatagctatgcttctccctgtctgaaaaccaaccatatatttcacttttcatctggagactcagtaatttgcttctttctctaaataaaaaaataaattacattgtttcctttccagccacctagatggcatgggaactgtgtgcacttgtctgagtctgtatctacatgtgtatgtatgtagtattaatacagcgggtcatttggaatagatccctcttaagatatgatttcatccttcattattttactcaaggtggagtacattatttttgtatgccatagctccagtgcactgcatatatttatgtatgcaacagtttaccttaccaagtataaattacaaaattttttacataatctcatttagtagccacagtagtaatgtgaagtaagtcctactgttacatccaatttcagacagtgaaactgagagcgaagtaccatgtgcaaggtcacagaaagtaaaaacttgaactcagtgttttatattattccgttttcaccacattacagcagttttccagaggctggggttatcattttaaagagtgataaccgaactgttacttaaaagcattctccatgtaattcaccatactttttcagatatgcaaaggttttaaagtgctcagatgagagaattcttgccatgctgtgttattaacctacatcattatattcttcttaagtcattgtccctcctatttctgggcattatcacgaaggcaaactataatgaactgtgttgtatgtatcacaagaatagatgtgactgtttttcatactggaaacagaaacaggaatatgcagcaacttccaaaggtccgagaaagcttctgaggattggtagagggcaagatgcccagtgcagtggacactaaggtccagtagcaagaagaagcttcaacaggaagaggaatgagggaggaaagacggggagcagcaagccaggtgggtacagcaggcagcagattctgtgagttaaataccccttatccttttgtgttcttctcttctctcctgctcttactcccaggtgtccaaatggatcagccctgctgccgagctctgtacgactttgaacctgaaaatgaaggggagttgggatttaaagagggcgatatcatcacactcactaaccaaattgatgagaactggtatgaggggatgctgcatggccattcaggcttcttccccatcaattatgtggaaattctggttgccctgccccattaggatgttatgctggctggctcgcctcctcttgacccagatagttacggttaaccactgctttggcaatgctgcttataacacatcccaagtgcaggccgcagtggtccacgtcatccagccccaccaagtgactttggttgacttgtgggctcccacaggagtcatggtgatggatgatatcctcttagcctggtgggcgtggcatgtgctttttaaaacatcatctgagaccagccagtagtcacagaactgctgtttacacagttctcaggaggctgtggtttcttagaatatgaccatgagccatttcacagaaaaaccatcccaccgaagatattgtctatcaccccaggggccatctgaaggtctctttgcatttctccatgcaaagaggagaaagcttttgctttcacactgtcccttcccaaatatgtgagtcatggaattgtcaaagtaagccttccctcaccagcaaattgtctcctgatctgaatgaatttgtctcttaatgcatccatagaaaagtgttaattgtgggttcaaagcattctctgcaaataggcatctcagctcctcacacttatggctatttctgacgtatagccagttttcttccctccttgctattaaagccagagcggtaattccaaattatttttcagtaagacagttaatcagcattattgtgagagggactgaaaagaaattctccattatgaggaattgggaagaaatctggtatccaagcttaaatttcttgctatacagaaactatgtatgtatttaggctatttctgaagggcacagggaagggggaacaaatatcttcacttcagttttatttgtgaattacatgtttcatgaatccatttggcacagagacacaaggaagaaaacactagtaaccatctttccactagttcatatactgagaaacagtaaatacctttcctttccacttttaccctgtgttctttgaacatcatttgtgcagattctgccctcaatgaggaccaaataaagatgatttttgtgcttagcagtttaaggtatatggctgcatatgcaaaactctttcccaattcagtcgctacttttacttctgccctttctatccatcgtcttcattttgtgtgtacagtgctgtgtgtaagcttatcagtgtgtttttttatttgtatcagtcatgaaagtcctgttaggtatccagagttctatttatctagctgtacagactctttcagaggtttaacgtgctgcttccgatgtgccacctgcagtagtggatcatgtggagtgaaaggcaaatcttactgcttaatgtataaactctcaccacaggaagcatcgctgtttccaataaatattgctgaagacagaaccaaaggctctgctccttcattttgtgtcagttctttgggtctaacactgggtggatgggggctggtttcagtctccattgctttctcatgcagccaaacaagacctggctccaacttcatatctacctctttacacgtaggaaaagtttcagcagcaaggaagtagctagcctggacattgggaccttcctggtaaccccaggaaggaggagaatttgggagagaagaaagtaaggagaattaggtctcatagatgttaaatgatatattgttaaaagtggtatcatctgaagaatataatgttaggaaggggaaataaaatatatcccttcgagtagcctcttattttctttcgtaattgaagataaagaaatagacatggaaaaatagtttgatcgaaagtcactattaggccaggtgcagtggctcacacctgtaatcccagcactttgagaggccagtgcaggtggatcaactgaggtcaggagttcgagaccagcctggccaacatggaaaaatctcgtctctgctaaaaatacaaaaatcagctgggcatggtggtgcatgcctgtagtctcagctactcagaagactgaggcacgagaatcacttgaacctgggaggcagaggttgcagtaagccgagatcacgccacagcactccagcctagggtgacagagtaagatgctgcctccaaaaaaaaaaaaaaaaaaaaaaaaaagccagtattattttctcttgatgtatatgtttggggtgtgagtgggaataggggagcagcaaggcacacaaaatgtgtattttctgagttcccaggaaaataaacatgttctttgtgtattaggggccatttctattattttgtgctgaggccaatagtccagattttctaatctaacatgaatagttgtaattaaatatactaagtttctgttagtccattttcatactgctatgaagaaatacccgagactgggtaatttataaaggaagaggtttaatggactcgcagttccacttggctggggaggcctcacaatcatggtggaaggtgaaggaggaacaaatgtacgtcttatatggtgacaggcaagagagcatgtgcagggaaattgccttttatgaaaccatcagatctcatgagacttattcactatcacgagaacagcatgggaaaacccacccccatgattcaattaccaattacctcccacctggtccctcccacaacatgtggggattatgggaactacaattgaagatgagatttgtgtggagacacagccaaacgatatcaaagttctatatgtgaactagtctaacgtgaaaatatttttttctagctgtatgagttctagagtattacagatcagttctctaaagcaattttaagaaataccaatgatattgtgactatagaaaatcataaagaatccaaagataaactattagaaaaatcagtgaatttaataggatcactagatatgaggaatatacaaaaatctatttctatatatcaatagcaatcagaaaaaatgtaatttaaaaaaatgtcattcacaaaggcatcagaaatcaaaaccagccgggcccggtggctcacgcctgtaatcccagcacttttggaggccgaggcgggtggatcacgaggtcaggagatcgagatcatcctcgctaacacagtgaaaccctatctgtactaaaaatacaaaaaattagccgggtgtggtggcgagtgcctgcagttgcagctactcaggaggctgaggtaggagaatggcctgaacccaggaggcggagcttgcaatgagccaagatcacgccactacactccagcctgggtgacagagcgagactccgtctcaaaaaaaaaaaaaaaaaatcaaaaccatagatacaaatctaacaagattgtacctgatctctgcatagaaaattatggaacatatttgagaaagcaattgaaagatattctgtgtttttagattggaaaactcagtcttgt

SEQ ID NO: 15499 - DNA, 50229 bp, Human
atcaaacctaggcaggctgctttggactgtctctcctgggatatgcctgcttttgccccaccaccaaaacataccccagctagattcccaagagcagcagtggtcacccaggtggcctctcattccattttctgcacaaaaagacgttaagcatatagctcagtagctcccagtgtaaaacagaacatcacccgatctccacctctgaaggttggggacagtcctttctagtcactcttcagctttaggggggttggttggtatcagggacagctgacagccttatttagccaaccagctgctctgtgatacacaatgtccctaatgctcaaagtctggtggatgattcttttgtatccacataagcagcagttggaggagaatcgatgagtccctttggttgcctcggggtgtcaaggctgccattcaaatcattaccaccataattattaaccattgttttagtgagatgtctgccaggcaattgtttttatttttcaatcattaaaaaagcaatcaaatttcactagagcaatgcctgcctcacgccgcatcaacacatttattaaaccccttctgtttgccgagctcaatggaaagtcttggaggagggaatacttaaaatgctctcggatttaaaagaattgataatgctgtggggaagaggttcacacaaaaaagcaattacaggaagaagctcgatagtatacaatacactggtacagagtgtcatagacagtgccactttcatacgctggattttatttctgtggcaatgggatgcttgggaggagccgcactgtgtagaggatttggagaagtggggtattgtggtgggaaattgctttctttcccaggaggtaggaggaaaacaatcaaggaggtggacaggatgtgcactccattagagcagccaccagagcctgactttttgataagagagtacatcagttaggataacggttaaaagtatctttaaaagacttttgcttcaggatgaatgatgtggcctgtgtgattcagcgataaattcaaaagccttgtccctattgtggcttgcggccacatttcgaacccatttttcaagcatgttaaacccaagcgcagcgcagagggctgcacatggggcagtcacaaaccaagctcaataaccttgctggtggggatgtgttggatacgctgctaatgcctgtttgcgacaatgctcgctagtcccggtggtggcggtgttcacaggtaacaatgtttaccaccgtgaatggaacttgtttgattaaccctgatcagaggatgaaaacactaaagaaccaagtgagaaagagggaagagaaccgcatagggaagagcagagcgagtagacgagccgaacgcagagcccgcgaggggcgagtggaagctccctgcgggcaggtacccgaccaccgccctgccctgggcgtggcggcctcgggctcagggaccgcttcggcgctagacggccgcgtccggaggaaacgggcgctggtgaaagcctaggtgtcctggtccacgcgcgcagccggacgtcgggtccagggagagacgcgggctggggcgggacgggacccggcccctgaagcgcgagggtgggagtgaaagcaaagaggagaaaagtagagagagaggacagtggggcccagcgccgcgcgaaaggcaggaaccgacccgcggacaggaacgggtgcaatgaggtccccggcgagcgtgggaacacagggttcagcctcctgcggcgggcgagcacgcggaccccaggggcgggcgggtgcgacaggacgtgacctggaagcgcggcgcgtgccaccgccctggagcaggcatccggcctccgtggagcgggcaggcgggccccgggtctggagcctgcgactggggagggcgccgcgtcaacagcagcggttgcggggcggggccgagtgcgcgtgcgcggctctcgcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggtgagtggctcctcgctcccagccctgcggctgctgtcgcttcgcccccgcgggcgtgtgggctgcgccccagccagcccggcggcgccctgaagagggtggccggggcgcagaacactcgggccctgagcgcccgaagtgcagacgtgggagggccccacggggaatcgggcgccccccttcttcctcccttcctttccctggtcgtcttcttccccctgggtgagagcggggctcatctcctccacccggttctccatctccaaatgcacacacacaggaagactccaaaccgcgcacctcgcgcaaaaattaactagcaagaaagggcgcgatcagaggcaaggggctgcagctgctagggatccccttctttcgcacccctctcccttctcagtgcttagacgcatttggggttgagggagggagagtgggagggcccgggcctcttgcgatggaagtgcgcattttggcgaagtcggtgagaaggggtttctgccgtttgcctcccacatgaacataggagcgaagaggacgtaaaggacacaattaagtttcattttcaactcagcattcaatcagaagaatcttccggccgtgtaatttttgctgtcgtttttaatcctaaaaataagcttgctggaaactcttcctttctcgtgaccctcacgccccatcagccacttgcatacattctaaattgtacgttgaagtttttcccactttatttgggggaaccgttttaaaagtaatctggttttcgcctgaaataggaagacagtaacctccagtcaaaacatgtgcagcagaatgggatttggtgtttttcgacgccaaagaacctccacccccccacccccaccccgagcttttggaatccatttcgcttttgtaaaacgtgtgcttcgtctgtaaaaactgagcaaggaatagaaacattcgtagctctacagtgagtgcctgtcacacttcacatccatagagccttttgtgaacttttataagattcagaattcagcttgagcaccagtgacagcaattgttacatttattctagaatgctaaattaattcgattttaaactgattattagcctcggtgtgccgttcctaaaggcttgtgactttaggtatttccaagatgcccttaagtctctgcttaccactttcctccctccccgagcatcctggatgttgggactgtgaatccaggtctccgttatctaaatggttgatgttagtgtttcctgtcatcacgtttagtatgcttgttgcctttactatcattatagctaaaataatactgctttcagagatgtgttgtataatcgcataataatttcagaacgccttcatattgaaccagatatgaagtgatacagtatcatttattcaaactgcctaaaaagtaaaaagtataaaccatatactatttttaaaacaggtaggttagatttaaatcacgtagtttagaactgttggaatggtactttgagtgataggatttatgttaggccttctttagtaatagttaatatcatgtaattagcactcgtttacacacaattttaatgtgttcgaatccctagagtcatcgaattcagaatttatagtattttattttacttagttaatattaacctaaaaaaaaagcaaaatacaggcattatgcagttgagttgtgttaagtgtggactgtaaaacaggatagtatttgttataaaatatgtttttgtatgtgtttaatatatagcttcaaaaggacatgtatgaagaaagatgtctcagcacataggtagttataaaccaagggtttgagagactgactttagaatctagaatgagtaagaaagtgatggatctgtacattcatttgtattgaagtttgattttgctttcagtttcgttaattaagccccgggaatcagggacctttcctggcaccctctacagtgttagtggcctttgtggtaaaagaagttatctcagatactcatttcatgcaattacaggcaaactggaaggcaccttaatggtatgcaagatgtgaaatgaattactatgttgcattccactctgcccccactcatgtacaattatactttgtttaaaagtgcatagtttcagtggtatttattagctagcaaataaaactttaaataaataatgatggtgttgtgaactgtcttttcagtggttgaatgattcctctttgttcaaaatgagttgtttttttttttaaatcagggtacatatgattaaataaaatttttttccatcgtctaagtctagtagtaatttggcttgtttaaataaaaatgttttctcttaaagaatatattatttttaattacaagttgccattttaaggaagtaaatgcctatttaaaagtacgtatttatggggccgccccagcagtctagaggcagtgttttttaaagcattacactaaatgcctaccattaggacacttgctcatgctgtcatctgtgttttggcagatgttttatctttgtcactgagttgttcatggagatttgaaaggccaagttctaaagatgagagatagatgactttccccccaaattgatacatattctaaatccaaaataatcacgcatattcgcaaaactagatttgcatttcatagtatgaattcagctatagctagtatataggcattgcttttaatatagtaatgttctttttgtggcataattttcaatcactttccctgtcttaggtttctgcctacctttttatacaagataaacatttctattttcatatcttatctctcagtctgattttaataatatcgtcttgggttatcataaagttactttcactttgtatactagtgtagatatttcttctgtgataaaaagaacaagaataatagtgtaggatcagttttgttaaactcattgtagtactaaagtagaaaatacagagcacccaggaaatttgattctgatatacctagactaagacaatagaatctgggtttttcctctttacgattatacagtgttgaaacagaaatcaagctacacccacctctgaatatttcattccaaatccatggagcagttgcataagactcagaatctggtcaatctcatggtttgagattcagattaggagaattaatgtgcatatttgaatatatatcacacttgtaggttaaaaggtaaagcaaggggtttggctagttcaaggcctgtcaaaaccacttttttccatttcaagcaagtatgagcctatactacacaccaagcagtttgcaaagccctctttggcatatagacaaatttcagacagtatgtcagtatgtctcttaatgacttaagatgtagtatatagacagtagggatatcttgtttttattccctcatggtacttaggtgcttgttaaggccataattctggatgttattgactttaaactgccctgccctttttaattctaagttggcctcttccattcttataaggccacttttaaattcattagggggattgcgttgggtcagaactaagtacaacttgtggacaccccactctaccccagacctttattttagtgtccattgaggagagatctgacttcatcctttttgtacgtaacccagtgtagctagagactccagttcttcaagccagacactagttctaaggggcaaaagtaggtaggattgctttctggcatgtgtctttactgatgatctttgcttctttacctaagaggctgctgagacttcttactccattcctgaacatccattcccagcagataattaacttcctactctactgcaaaaaatagtggtgtgtggtttggactccctctgcttccctcccaccattactaaactgatctataacatcttagataaccttcgtctcattctcttccgtcatccagcttcagaagaaaacctactcacttttccaacgaaaggacaacctgtctaccaccttttcacttctaccatcttggagacctgctcagtcagcataattcttcagtcttgcatcttagatctttccctctccattgactccttccccgtagcttgcacacatgatcaaattttaccccatattaaaaaataaaacaaaaaacctcaagaaccaaaatgtccttgcccttcttcctgcctgcacattgtcagttgttgccttctctgctttcttacactgccaaatttattgtaaaagaatcactgccacttaatatattttaagtgcttgataaagccatcttgtttctctctcatttctcaaacatagtgtgcatcagatctcactagtccattgacagatggaaagatattctccccaaatatttaagcctcttttctctataattagcctaccatctaactagctacacatactattttggttcacaattttaattttcccctctttatctcccctgcttcccacaactaacttctgttgattactgtaagttttaggtcttctctccagttgttctttacctggactattgcagtagtctgttaacggatctccctttctcttttcccttgctgccctcagtccttcctttacactgctgtcaatgttttttttttaatgaaattaaatctgagtggtttacagttgtttatgttatcaagtctaaactcagcatgacattcaaggaagccctttagaatttttcttattcatcttttccaacctcatttcctagagctcacctaaataattctctgctttcagttcttcactttctttatctggctgtacacgttactctgcctagaaagccccttctttcccataacattcttactcatcctttaagacccagtttaaacatcaccctctaggaagatcattcatagacacattcttgtgatttttaaggaacttttctatccaaccatacaagtgacttgagattttccatgaaaatatgcagcttcatgatttcataatcaagtctatacaagtgagaagcagtggcaggttctcttgaaatacagaagaaaaatctatcttctcccacatgatttttagatttttcttctatggaatttatactttaaactttttacattcacaaggaaggtattgaatcctactttctggaccctgtgttagattcttaggataccaaatgaagacagtgtcttactttctgagcctggagagatcagttaagtaaaatagtaattacacagtagtaggtacagtgacaacatttgaacacaaggcaatgggagcaataaggaggggaagaatacaattgagtaatggtagggaaggggaacaagattgaacaactcaactgtgctttagtaggaagagcaaaagttagcaaactgtagctgccatttattgagtacttgctgtatatgtgaaaggtgatacaaaaacatgttatcttattaaatcttaacaatatctctatgaggtatataccatcactatgcacattttatagatgaggaaactgaggagcagaggtaagtaacttgcctaaggttatacagctaagaagtacatgaggtgaatcttaaactagggtcgaccccttaatgtgtgcacttaactattatacaccctatgtactcagtggggtaatagtgtataacagttaagaggctatttaggtttgaggaacagtatgtgctaaggcatggggatgagagtgcatttgcatagtcatggaattgcaataacgtcattatgattggagcttagtgtggaaatgagggagtacaggaggtggggctggaaaggatcttgaaggacctcgtttgtattccatgctaatgtacttagaatttagcctgaaaagggttgagggtgttgttaaagtatcttaggcaaaggagtgcacatttgcatttagaacagttattttgggaactgtagaaaatacatcagggccaggatggagaaaccttgaggatggaggcagggagctggttagaagggtatggcagtagttcgaggggggaggatgagtgtctaattcattcattcaacagacattggatttaggaactattaattaggttgaacctactaagaattctccatggctaaggagagggagtaatctaatgtgattcttaggtccaggtctggttcactggtagatgatagaaaatactttagcaaagtgatttaggctgagggtaagaagtgggggtacgtaagtttttggacatactgactttgaagtaactgtattacatccaagtggaagtgcacagcagacagttggctgtccaacatctgcagtttagaagaaaggcagtgcatgattcagttttttatttaaaagtttgcaggtgaagaaaaccatgggagtcagggaaaatactagggggcagagggtactgaatctgaagcccttagggacactaacatttagtgtgagtcaaggaatagatttcaacaaagaaagcaaactaggatggggtggacaaagcaggaggaaattcgtaatcaggagataccatggaggccaagagagaagagcaagaaagagactgcccactggctcaagaactgtggaaaagtcaagacagaaagtgaaccatgcatatttgatttttcacaagggattggtggtgactttggcaagagctgtagtaatgaagaagtaggggtgaatgggtggaggccacgtaacagatttaaggagtgaattggaagtgaggaaatgcttatagattgttaatttgggatgctagggagagagaaagtatgagggattttttttaagttggcaaatattcaagcaatttttaaagacacacacaaaaacaacaccttgtaaatggaatgggggatgtgggaggctgataatcaactaaggaaagtcgttgaggagactgatgggtatggaggcagaaatggaaactagctttcaggtgatgggattcatttcagaaaaggaagcaaaaaaaaaaaaaggtgtggatagttggggttacaggtaggtttatagggaaggagtattggaagcttcaggattctcctctgaaggtttcagtttgtattaagaaatagggagagaggactgttggagagtatgggataaagggcagaagggagtaatttaagagttgttaaaaagaagcgaacatttacatgaaatatgtaaaatggtaaagattgaaggcccggaggagcagggactatgacattcttctgtttttgcctattagcaacatgaattttcttagaaatctgtaagaccaattactcttctgcccatccataaggacgttgtccatgcagaaaagataacacttgtaaccttgtattatatacttatcatcgcccatttgagaattgtaagctcctaaaagataataactatattttttcatcactatatccccacatcctatcacaatatttcatcacaggtaattcttgacaaatgttgattgcatttttaaaatttctaacctgaacttgtgtgctgtgaccaccatggattgagtcttctctgccactacaaagctcttttctagactatgatatgagatggtttgggctgatagtctatattcaccaatacttgtacagttccaatgaaggtttcaagtctaatacttttggcatttgatataaaatcattttcccattttatttgctaatttatctataactctggcattactcttggttacatttgtctgctgctatctgatttagactgctataagcatatcttgtttattcagagttttcttattcatgttaattatctgtgtttctttatttgctctctacattttaaatagtttcttcactttgctgttttatgagaagggagtaggcaaaaggaaaaaaccccaaatcagacagttttactacttaatagttttttaatgcatctttatagagattgaagttgtagttaacagctagagtgatatttttggcctgcccttatttattaattactagtgcaaaggttattcaaattgtggtttatccaggtcaattttactgttatttttactaatagcatttattctacttaaattgcttcagctataaaatgtttttattgtaacaaataatgcagtataattattgctttctgtattcctttgaaaattcattctctaaacatatgttatgaaatggtggattgttcaccaactacttcttacttacttaattaaagcctttgcaaaaagtttcataggatgactgagttcttcattcgtacctcttttttttaagaataatctcttgaaagtcaaaccatgattcatacaaatataaaatgaacatgtgtcaaagattttatttcactaattaattaacaagcaaactagcaagaaggcaaaacccttttaaaagaaaattggaaaaacagacacatttataggcaatcaagaatgcctaaatgaatttgctaataaatgcaaaattggtcaatatcctcagggcagtaaaatgtagtcttttggaatcctctcttccaccaggtggaaatcaattgcagaacaagatttatttttatctgtatggacagcaatccatttgaattactctcagttttctacaacttatgaaactgtaaaacagcccagtcaaagtcagtgaaaggcacaggcttctatagagtcagataattccaaagcgtctgttagacattgcccagcacttgactgaaaggatacccagtagtctttgtatccctttcaaaatcttcaccatattttctgatactttccttcctttataatttgaacatcttcacccctttattcttctctggtatactatgtcctctctccctcagtgtttctctctcaggggaaataattcacaattccaaagttttaaagaatgcaacggaagtccaggttttgccttgggcttcctagtatttgggtggctagaaatgtagaaaactgggaagaggtgagctgtggatgcccacaatataggttcagactgcaatttcccagaaatataacaatttggactagtcaaagagggcccatatcattacattaaaatgccagattatctagtttttatagtatcaccctacatttttacagcatagtattgtttagagagcacttgccgctatgttttccatgttaatgctcaacacagttctgtgaagtagcccggtgtttgtttttgatcctcctacttaagagatcctcctattttagagagtaaaccaaggcatagaaaagtgagttgcttaaggcagcatattaaaaaggggcagaaatagtatttttactcaggtgttttgaacattgtccagtacctatattccactatgcatccttgcattcaattcatggggtatttattgagtaaacatagtgttcttacaatagaaacattctatgcctctgatttttattccagtttatgtagaagtaaatcttaagtgtgaactattaacaaagttgatattttatttatatttgttagtaatttgtgttttgtttttgtttatgttttgaggggaaggccaagtagctacttaggtaaaagagttgctgagtggctgaagaatatggaagacaactacaattcctacacattcttgtacattttagttgaacaatgagtgattacatttatttacccagtgcctcttctataaggcaacaactggtagtttatcctattgagaagcgtagataggatgcttattagcagtaactgctcttggtttcaacttgcatcttacttagctttttcaccgttttgtggtttcttggaggaagaatacccataatatacatttggagactgttgttctgtagtgtcaatgaaatgtgggggtgggaaaatgtcattcaagactcccatacaaaatgtctattgctgcctatattttgctatgggaaagtagccacagataatgttttttttttcctcattagtattttaagattttccatcctagtggaaagatatgatttgattcatcctatttactttgtatattaaagtacagtagaacctgccactttttttggaaatgcagcataaggataaagataaatttcatatcagttcagcaagttctatttagcagtgtgttgaagttgagactgaataaaatatttggtttggttttctgttcaaaattttaccttgataaggacaatatttttctacatatatcagtaggcagtaatgattacttcaaagcttccaaagccagatactacacctgcatgttccaacatagttgctgaatttattcccaagatgcatgtaatgtatactttgtattattgagaatgaataaagaaaagtcataatgatgccttccagctgtgcaagttaatattaaaatataatttgtttgcatatttcacctaataggtcttcttcattgctatactgtttacttaagtgaacaatggaaatgttgctgtttatcttaaggatttgtaacatgcctaagatcttacagtacagacttctataattaatgaaacatttttctttttcctttccaggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttggtaagacttctatgaaagcttctttttttatttgtcctggtgcaacctgatcctctttcgagaggaggccaaatggggataggtactcctttgaatcaaaaagcaggctgttattaataaatgttgatgtaatgtttagcaagtttaagattgtgatttctatcctatttgttaatctactcttcatggtaaaacacatttactatttaatttgtattacttgttaatttgtatattgtgtggttctcaaacttttggtctaaggaccattttatttggctgattggtcctggggtaatgtactcttcatttctgtttgctgccatccaagtgctttctttcctgtgactaattttcaagtctctttccaattattcagccttctgttttttgtgttttttttttttttttttttttttttttaaccttacactttgaccaagggatgacaagtcccagccatgctccctctggagagaatagaggagagtcaggagattaaatcacgttatcatggatgatttcttcagattttctgtgcttagccttactttggtcttctttttgttggccaaaatatgagagaactagagattcaaattcatttattcaaattcagacttgatgatagcaccatgattctgccctttttatcacaaacttgggttgctgaggtgtagaaggtagtaaaattagctgaagtaaatagtctcctctccttgctgtttcctgctgtgctagctgagttcttcaaccccatatgagtatgttctttctgttttgaaatctctatttagaattacctgtcatattaccgatcatggcttaaccacattttgagaaccttaactctagataggttcagttctgttcagttggatcaactatttgcctagcttttataaaataatctactaccagattaggaatggggtgtttggtttgatgaaatgtttgcacattacttaggattgagaatcaggaggtctgagttacagcccctgttcagcaacttactattcacctgtgtgatcttgagaaggtgcttaaccgagtccaagttacctcatgtccgaaatggagatgacaatagatacttgcttttatgtattctacagtctaatgagcataaaccaaagtgtgttgtaaatgttagttgttttcctgggatgtttattttatgaagtaaggtatcaagttgttgaagttagcctagagcattgtgagagggatttgtgtgcagtgaggaatgggcaagggatggctccgagtaggcaaggagaatttgaaaggtctttctgctcagaaatctctcttacattgtagcttttactattgatattaatttgggcaaaggagctttttttgttgttgttaagtatacctttaatgaagggtgtaatcagtcagtcatatccactgcaactaactggtattagatcatctaatacctagttgaaatttttctgaggtaatgtacaattttgtggaaatgaaagaataagatatgggggaacagtaacttttggggggtaatgcaggtcactgagaggtaaactggaaaactcaaaatatgagatttgaaaggccagaagatgaaatgaagatggaagagaaaggaatgccaggatctgagataaaaacagtttattattttgcgtgtgattgaaagactgttttatctttgtttgcaaaataccctataaaaataaaaactagacttattttgggagccattaaaaggagaaagtattgttttattatagagaatgtagaaaattctaccagaggtttgagacatttggctttgcatccattttaattttttgaaataattattgatttacaggacgattcaaagatagagagcttccatgtgcccttcacccagtccccccaatggtttcctcttatgtgacacaatatgaaaatcaggaagttcacaatggtgcagtgtgtgttaatggttcgctctcattttatcacgtgtttatttgcgtaactacctacacaatcaggacatagacctatccatcataacaaacatctccctcatgcttattcttactagtcataccgccacctcccactgtccctaacctggcaagcaccaatttgtcctccatatctataattttgtcatttcaacaatgctatataaatggaatgatacaagatgtgaccttttgagaagggctttttcactaagcacaatgcccttgagatctatccaagtttttgcatctatcaatagttcttttttccttacttttttttttgctgagtagtagtccatagtatgaatatatcacagtttgtttaaccacttacctatagtaggacattttggttgtttccaagtttgggctgttacaaatgaaactgctctgaacaattgtgtacaggttcttgtgtagacacagttttcatttctctgggataaatgctcagaagtatggttactgggctgtatggtaagtatatgcttagtttttaaagaaactgccagacttttccagagtggctatttcattttacatttccatcaacaatgtaagagtgatctggtttctccacatcctcaccagtatctggtgccactatgttgtaaccatttttaactgaaaaaaacaacaaacaaacaaaaaccagttaaaaagttatctgcacaaaaaggttaaatggggcaggactcttactatggagtataagttcttttctaataagaatacttacttgtcacggactttgaggatttaagcattagaaaccatttttactatgtcgtgatttttgcaaatacaggcataaatgagaaacagaatttgctcaatagagaagtgaattctacttaatagaatgcagataatagtgaccattctttgtgcctttttaaattttttggaggactaggactgaatacatggaaacactataagatatagttttatatacctctgtgcctatgtatgatatagtccattagaaggagcactggacttgaaattagaaagctgttttctagacttcactgtttaatagcttaagaaaagttggataaaaaactcaacctatctgtccctcaaattcttcttagtacagtaaagatggcatcaccatcatggaaatgtttgagatataaataatacctctcttacttaacaaaattttactaagtgcctaccatgtgccagtcaccgtactaggcatcacagattctgtgatgaataagacattattgctgatttcaaggaagtggttgcagtacaaatatgaagagtgaagtgacctaacatttatttgcacatgtgccacatactttatgtaagtcgtgtcctgttatcctctcaagaactctaggagatagatggagttcttaccatttaacaaatagggaagcaaaagagattcaaggtattgttcaaggtcagagtaatagccaagaattaaacctagatctctttggcatcaaaacccagtatttttaccaccgtaatatgtggttcatgtgaaaacaccttgtaaataactaaatactgaatgcaaatactagtaatcataaaatttatcattaatatttctgttctattagcaatacaaaaacttgaaaacttaaagtttatttttctctaagctattagagttttgtttagaaaggtcagttcaagttccgcagtgttgccaattccattattatcaacaggacatatggtctgtttataatgaagacatgaaggcattgcaagatctttgtattagttttctagtgctgcataacaactacaaatatagcagcttaaaacactacccattttttagctcaaagttttgtaggtggcaagcctggtcatggcatgactgggttctctgatcaaagtcttaaaagactaaaatcaaggtgttgcccagggcatactttatttggagtttggggtcttgttctaggctcacataattgtgacagaattcaattccttgtgattgtaagactggggtccctgtttctttgctaagtatctgccaaggaattgtagcagctcctagagattgccctcatttcttgccccatggccccttgcatatttaaagccagcaaaggagaatcttcctcttgttgaatccctctcacatattgagtttattttgccaggaagaacccagacccttttaagagaccacttggttaggtcagctctctctccctcaaaaataatctctctttcttaaagtcagctgatttgggatcttaattacatcagcaaactcccttttgctgggtgatataatcatgaaaatgaaatccaatacattcacagtcctagtctcccacacacaaggggagggaattataaaagatgcatggctagggcaggggttttgggaccaccttagaattctgggtttgattaaataaataatgggactgtagcctagcaagtcgacacatcagaaaagccatcacaatcctgaaacatcaagtaaaaatttggtttgcattttaggattgtaaatgttactgtggtgtatgcgtgtgtgtgtgtgtgtaacctggtgttccctatgtttgtgggagtttgaaggagacactttgttgataggaatggtgtcttcacttttttaggttgtctcatttttgtacagtgataagacaaatgaggtcctgggttttaataacacttcagcttgaaagcaaaaattaaacacttattcattgactacacccttgtaatatcacttctttgcctttccactagcaagaagttcattttcgtggaagccattctgcctgtccaggaattggaggagagtgatagacacagttgtcagccatagcttgggtagaataaggatgtgaatgtccttggcttatctttattaatcttgtgatggaaaaatatctgacattgttcttagtccattttaagcttaatttatgttcttagtggcatagaaattcagagctgaaagaagtatcatgtctcactctccccttgaggaacaagagttaacgtcatctgacagtactaccataacaaatcaatagcttaataggcatataagtggctttatataaaatgttggtttttttcccccagcatctcagttggttcttaaatatctaattccatgatcctcaaacttttcccactgtaacaaattagagagaggaggaacatgttcatcagtgactgtagttcaaatacagcagaaatgtgcagcagtgatttcaaactgagagaatcctggatgcccttctccattgtgtgccccccccccccacccgccccacatatcagggaacaatttaaaatcctggcacaataatgagaagggagagtgacaaactgataagttccagttaagaatcacttagacaggccaggtgtggcagcccacgcctgtaataccagcactttgggaggctgaggcaggtggatcacctgaggtcaggaatttgagaccagcctggccaacatgataaaaccctgtctctaccaaaattacaaaatttagctgggcatggtggcgcctgcctataatcccagctacttgggaggctgagacaggagaattgcttgaacccgggaggtggaggttgcagtgagctgagaccacaccactgcactccagcctgggcaacagagtgagactccatctcaaaaataaaaaaaaaagaatcacttagacagtattttttgttctgtaatcttcctctctgtcattgaaatgtctcatatttcttgtttcacatagaatctgggagtcatcaagtagtcatctagtctatctcatcatctaatttacgaattatttctatcacaccccaagtagctggcgattcagattttttactgaaagcttgacatgatgagacattattacttcccagaggatcttggtctgttatcaggcaatttcagttcttccttaaatcaagctaaaacttgctactattctcactcactgggagggctgtagtatttctctcaagtttatacctctctgtgatgaaaatctctgttcttttagccattgctcatggtttcgggatccccattctagtcatcttcctttggagcaattccctgttagatcttcaaatgtgatgagtaaaactgagctcaggactgcgtttgttggtcacacccttctcccttccaaatgactgctgctgtaactttctgacaggtcctgcttccctgtaatccattctccatgtggctgccaaagaagatttgaaataagtcaggttatttttcttccctatttaaagccttccagccgcttgtcattgctcttagaataaaatccaaactctcccaacaagcttttaagactctacatggtcttgccccagcaaactcttcccatttgatctcatcactgaattccagtcacaatggccatcctttggtttctcaaagttgccgttcctttggcatctcttcctccctgtcttcacaatgtaggctccttcccatcctaggcttagtttcgttcctctccctagaggcctttccttactgcctcagcttctcccactctgcacactcagggtcctctgcattgttcactgctggccttcaagagcctagaggagttcctccccatggtgggctttcaataagtgtttgtggaataagtgaaaaatgagtggtcacaccaggatcgaatgcacctcttacttttgttaatatattcaaattaatattaatatattaatattctattaatatatcctaaaattttgttgtgtataggggcagggaccaatgaaagaacatttcattgtcagctcatcttgactatgagatcagatattggctatattttgaaggtagagtcagcaggatttgctgtttaactagagtgggatgtgggagaaatcagggagtcaggtataactccaaggttttcagcctcaagcaactgaagaaatggggtcaccacgactgaaatgaggaaaatgagagggggagtttagtgggggatggggtgatgaaaatatcaggattcattgtggaacatgaacagttaagattaactgaagagcctgaattcactgttcctcagtttctacaactataaggaggggttaataatttctcacatcataattgtgaggatttgaggagttgaggtacacaattaaaaacaaaagcacaggggaagtaaggaaaaatacatcaattaagcatggctattagaccatacagccttaccaaatccattggggattagatacaaaaatccaagcatgatctccaaaattttttcctggtagggttttaggctatactgaagtgacttttctttggcataagaagatattcagttatacagttggaaataaaggtattgatttggagtatccaaaaacatctctcagtagagatccacaaccaaagaagcataaaaaaaagtcttccattcactcgcaaaactgtcttatgaccattgcaaccctcaacagcaaacatatggagtctctactacatatagaggaaaatgctagattctgaaaagctaatatctataaaacagagtttatgatgttgttatattctggggattgatgtaagcattttaccaggacttattatagcattataagcttaacacaagaaatatgtggctatcattatggagtgaaaggctggaaaattcctcacctgtgacctgagagatagtgcgtggtagaatttgaaagaagtgttgatttcagaggaatgctagtgcttgcttagggcagtattcagaagaactcttccaatcacacagccccttgtacaggcaaactccggaatactttcagtacatttacttggctttattgttagagcagaaacttcacagctaaaattatggtcttaggggtttataagatgcaattaaacttaatttttaaaagttctcacaaatcttatttgaagtcttaatatcttaatttcctttatataggatatgtggatatatttttatgataaaagtaacatgtgaccaacttaataacagcttcgttaatatcctaaagccactcatcttactttacatataaacagtccttctgaagcctaattatgcatggataattgcagagtgagtttgggaaaagaccaaccgggcacatctctctccattttaaccacaatgagaagagagtacctagtggtgcatcttcctcgcttaggttccctgagtctgtctttacaggaagacttcattgttacttgaaggtacattcttggaactttacacacccagccactcaacacatgaatacatacttattttagttaactgagtacttagtgagtgctaagctttgttttaagccctttgcatgtagtttattaactttgttaatagttacaacagtccttcaagatacatgtactgtgttatactagtgtaacagttgaggacaccaaagaacaaagaggtgttgacacgtggtcacggttccatagagtgttaagttagagttgggttcaaaccctggcagtgtggccacagagccttgttctcagccactgcactgcactacctcctcccgtgaaacataagaaaaatgtgagaaatgcttaagtaagtgtagtttttattcataaataaaatttacataagtacattatgtgtaatttgttttatgtatatgtgtgtatgtataaataaatacatgtaaaaataaggccacagttttaatttttttccatctctataataaagcatgtattatagaccattagcagaatttaaagtgttatagtaaatattaattgtgacttttgttttcttcttccccagtttcatggttttctccaaatgaaaatattcttattgttattttcccaatttttgctatactcctgttctggggacagtttggtattaaaagtaagtattatttctacttttcatttatgtttcagtgatgatatagttatttctacgagacattgtcagcgaaatatttaaagttgtactaggaaaagtgctattatgataaatatgagtatgtaatttgaatactactagtctccttgaagtatatgttgtcgcccacattttgctgcagttcacttttaattcctaagaaggttgttttcacttggtgtttttttaatctcttaagaatgaatagtaggaatattagtaccaacaccttaaactcatgtcacattttaatattcacagaacatctacacacacattatgttattaggtaaacaggtggtgacagcctgcattagttttaaggtaggacgttatactttggagcatttagattcccctctttttattttcccagtttgattttctctgtgtacacgtgttcacccttggaaaagtccagtcggaactatgttttgtcatcctctgcgtgcagttctgcagcctctaaagaagcagccaccagagagttaggttctttgatcttgctttcctataatagtaacgtaaccagacttctgaaggcagatcttgatgctgcattagatttagcttcaacaacacagaattgtcattactaggcaaataggtaatatgcattacggttaatgtttaatcaaccatattttcatattttggtaaagaaaatttacaaaattaatgaagttctgaggtgacagtctaaacttttaagctttttaaatacaagatttattccttctttccttgtagcatcctgaagaccagtaaacatttatataagcaaggaataaatactgcttatttaatttattctgcaacctttaaacacacaaaagctagtaaactattgcagtggattgccctgttgtatattttatgaattttacttttactcagcagtttaagctgtctatatctatggtggtgtataaacatggaagggagatgactgattgattatatgttttaagcgcttttctcagtgtatggcattctggaaatgcttagtgatttcagaaatgttctcaacttttgtctgaaaggaaaaaagggggaagaaaggggtggcagtggcaactgtcaagacattttataacttttactttcaagatagtgtctagacttcttttggaaattttcttataatctcttagttttttatgtcaagaaaaggactggtgtagcattaagacctattctggcatcaatgatattagggaaagcttttaaccatattggcagagccagactttaagggctaagtcatatgacttgggcagggaacagcctttttcaaagatcatgaaattatttcacatagtgcgattttttgagtttggcttgatggatgtttgctgatccagacgttatcattggtgacattatttttagtgaaatgaaccaggagtgagtttgttcactgttggctgtatttttacaaaatgagctttacaatattttttctgacttaaaaaagtcatacatatcactttagaacacctcgtacaaagtagggagttatttaaaaaaaaaaaaaaaaaactcatctgtagtccccaaacctagaaataaactattggtatattctggtgaatttcctgtttccctttctgtctttttctattcatttttgttatcttttttttaaaaaaaggtaaccataaatggactcgtacagcttatatgcttgtacgttctgatgttcccccatgtcttcagaaatcttgttatagctgcctgtgttctacttttgtggatgcactataatttacttaactctcatcttgatggattttaaggatgtttccaatttttttgatactatgaaaataactctgctaaagatatgaagcctggaattggcagagatattttaagactctagatacatactggcaaaatgttttccagaaacgtttgtatcaactactattgcagatgagaatacctgtctttcacctcagttataattctgatattataacgctaaaatctctgcaaatttgatgggtgaaaaagcatcttattgtaattgtaatttttgtgttagtaaggtggaatgttcttttttatattttttgtactggtcatattttaaggaacgtgcttataaacctaaagaaatattttggtgggaattttttgttttggctcatcttgaaacaggtagatgtgtgtgtatgtgcatggaagaggtatgtctatacatgattcacccagcctgcgctcacatttaaaggtgttgatgataatagtagctaaccatttgtggagctcttgctctgcttgacaggttctgtgcaaagtactctatatctgaaatgacatttatttctcccagaaactctatgggcatagacactgttgttattcccgttttgtagataagaaacaggcacagatagattaggcaatttgcccgcaatcacccagccgtttcctgatagtactgggatttgaactagtactgtttaccactgcactgtactgcctccccgttttgcatttattttgaggattttatttccatgaagggtgaacctatatctaagcacataatactgagtagctaaaacttattaggagagcagaatgttgacctgatttgtttacttattctgcaaatacctagtgacagggtgcctactgattgctggacaccaagctacatgcctgaaatgtgggtgtgatgtgcatattgccctggttttgtagcacccacatttaagccagggagacacgaatgtatgtgcatcccatgccttgtcacatctttgagatagtcatggatccaaatctaacttttctgttagtgcctctgttgatggcctgagcattccaccaaatagaaatagaaagcacctctattctccacctgcttagatgtatattttttagaatccagtatggtaaatcttctaaagcattcataataactcagacccatgacttttattttatagatttctagttctgcttaacttttcctgattaccatttatggtctgtacttggctacaggggatttctctcagtggtttttccagctctgcatgtgagtctttgtggtccaagacaaacctggacctttaccaggctaaactttcagtaaagacagcaggttatgccctcatttgctcactctgaggagaaagagtttctttataccagagctgtatcttgaaagatgtctcaggatgccattggtcctactgaggaagaagcctgagaagactcttaaactcccagagcccagccagcacttggtgagccctggaccacgtttcaaagataaaggcctcttacagggaaatgttcctaaataccttcacctttagcttagctttaacttaggaacttttaagcagaatctctatgcttagcaaacagctcagagattgctagaatcaaacaccaaggcttaactgatagtattgaatttcagacgctttgtttgtgttctgaaaactacaccaactcacagtttgccactctactgacaattaagttcctggctgattttcaggattcttctttctcactctgatatcattttaagtgctgtccacctagtcctccagttcctgcaggattaaggtccaactgtatgtaaagaactggctaacattttgaaattctttgagataggcctatctgttctttctttgcctttgtaactttgttttatacaggcaatactggcttcgcacaaaaccgcaagaccataaacatgaccatgtaagctgaaattctgcaaaacaatcttcatgatgaatgggaaaaactattattatattgttccatgacctttaaaattttttttgttgttaaaaccttaaaaactctgttattatcaataacaacggcattgggaaatgaaaaatagtaaagctagtatttagtatgtggtaaattaaatcattagaaacatcgagaatgaaagtgtgttatcaagagtagtttgaacaacacttgtgtgttcttcttgcataactttggatacagagcaagcatcttctctatggcttggtgaattgtcatacccctttctaagtttggatcggtttctaccgttttatcctttgcactctcaatgtcatgaaagaattcctttaatgtttttttgaatgtttaaagtttattttattgccagtcacttcctctgggacatctttattctttttgttacatcctcctcactttcctcatttatatcagtaagtccaccttcgctgagttcttctggcttcatctctagagtttcttgcattgcagtaatgtcgacattcgcacaatcagctatttcttctcttactccatttatggtctattcaaatttcactcctagcatttgtcagtttttatttctttactctttcatctttcttgcctagtttcctcttttgatttatccattataaaatgtcacatgggtttatcactgggaaacaaggaggtaacaaaactccatactttgctgtctgtgcatgacctaaatatcagatgtacagtgactagtcaccaacagtcttcaaaagaagtgacatggttgatcactgatcatgatgggacatctgctatttacatagttatttttgaactgaagaaatagcagtgaagttgtactttatgcagttactcagttaatatattgtggtaattgaaatttggactgtttatgagggatttatttgattaaaccatggtaactggaattcatatcagaatagtgcaaagtgaggactgctgtacttgattccaaatttaaaactgtattctaggcatctttaatttttttttttcaactttcccctccctgctcaaaattactccacagagattttggttacggctcagatgtctttgagtagatgttcctgtagaaatcattgttagaaaattcaaggaaaaaagttctcattacactaccttgagatcctaccaagtccttgagttttgacttgaggacagcttaataatgaaagtaattcagccatgaaagcatatttaaaataagtaatggaacaggaaatttcttcatagattagaaaaattattctgaaaaagtgaagacatagcctatcttggactaggaaatttccatccaagaaagtaaaatatacaataaatattatcccaaagaatcattctgtgacctggttgatggcccctggtaataagactttgttattaagtttactgtgaattctttttttttttttttttttttttttttttttttgagacggagtctcgctctgttgcccaggctggagtgcagtggcgtgatctcggctcactgcaacctccgcctcccaggttcaagcgattcttctgtctcagcctcccgagtagctacaggctactggcgtgcaccaccatgcctgggtaatttttgtatttttagtagtgatggggtttcaccatattggccaggctggtctcgaactcctgacctcgtgatccgtctgtctcggcctcccaaagtgctgagattacaggcattagccaccatgcatggccccttacagtgaattctgttcaataatcttgaactcccagtgctttcccttggtcctgtccatataatgatcacattctgttattaaataatgtgcttatgtgctgattttattgtaggaggaattgaacaaatctatagctcagcattttactcttttgtagaaatcccttgaccctttccaaatccagacatcacaaccttctccatatactcaaaaattgtgaaatccacaaggcagggaaagttgataatgaaaaaaaggaagtttggtctgttggacatcctcttctttcatcttttatgttcaaagtacttgatgcacaaagcctggactcttttatctctgtcctatagactgatgtctagtcagtattcattgtgacaaaattgtttcattagagcaagttggatagtgtatggagattattataaaatgatttaacttgtcttctgtcaagtaattttataattggtattaatgttcatttttttccagtaccagtttcagaagctttcatttgtgtatgcatgtgtgtgttaaataagtgtattagatacttgaaaaatagtaatttaaatttaaacaatttaaaaaatgaaattgtaattttatgtgtaaaggtgtctgatgtgctttattctgcactgaaaacaatattcatttacagctcaacagacaccaaatatattctaaaattactttcctagagttatcagaaaacagcactgtaataatgaaatcaaacccatctttctttatgatttattcttagtctgatacgcatcagcctggtaagccttcctgtctctctgcttacttaccaatcactccaaatgtcatgtctttgggcaggcattaaattcttgggttttgggttttgttggatggactgcagtctgtgtgagcctatatgggtgtgtcaaatccagtctttggggtgtcatggaaacttagcatgatagacttgattttatccccaagttgacttggtaatttcattagatttcatcagtcacaacctgcattttatcttgtatgtgctgtctattggtcacaaaatcagaaaaccttcttgtccattcataacattagctgttttttcaggtggctagagggacatgtcattgcttcatctgcatgaatttgaaagattaaatgcataaaggaattttcttagagtagagtaggccttcaccatctctttaactgggaaagaagttttgggagtaacatactcatcactcacacccccctcccctcaaacacacacactcacccattagaatgtaagggccttgaggcaggccttgtgtttgcttttcgtgttcactgtcagcatttagaatagtgatagtcatatagatggatagtgctcaatcaattattgtcaaataaagtaatctacttgttccttgatttagactagcaaaaggggctggtacattgtaggtacacagtaaatatttgtagaacagatgaatgaaccaacccaacagatttcttagaagtagcctgcttttggttactaattattttatagaacatataaaagaaaattttagaatacctaatttgttcacaaaaatgttatattgtctcccctgatacttggtattcctgtgtcaggctgagcactaaggttatacattttttgttaagcatgtaattactgttatttctcatgtactttattttgtgtattgatttcagtagttgtagctgagggtaatccttaagagcatgcagattttaaaaattacatagattgccttgccaagccgtctgaaagtcatactagaaaatttgataagagcctgctgttaacaacacattgagttatttttatcttaatgctaagtggagaattacttgaatttattttttttgctgcatttaatgttttgatacattcaataaataaggataaatccacttactgaaggacaagaaaagatcaataagagatccttgaggttattgggttctatggcatctattatatcaaattccttgccctttcactatactgagaaatttgacgactgggctagcaacaagatacctaccccacattagctgtggtacctgctgaaatgtgaccatgtgagcaaagaaaatgagccaaaagaaactctttctgaagattcactgaagaaaacctggagatactctttcattagtagaccccacagagacaggtggagtgtccgttatccagaatgcctgggaccagaagtgttttggatttcagattttttcacacttgggatcctcaacatgtgtatttgttggaaatggctacttaatttaaggaaaagtttaaggtggcctggaaaataagtagtagttgaactaatcaacaggaaccaaaactactttcaatatatagtgtacttatactcaaagagagacggaccattttatggtggaaccctgtctatggtagtattttgtgatgttttatttttgttgctattgtttgcactgttttctcctataacagctcttctaagccttaagaggataaattttatatgagattcaaactcttatttttgttaagaaggatgtaagtcaccaggcatggtggctcacacctgtaatcccagcactttgggaggccgtggcaggtggatcatgaggtaaggagctcgagatcagcctggccaacaatgtgaaaccccgtctctactaaaaaaaaaaaaaaaagaattcaaaaattagccaggcctggtggcgcatgcctgtagtcccagctactcgggaggctgaggcaggagaatcattgaacctgggaggcagagtttgcagtgagccgagattgtgccactgcactccagcctgggtaacggagtgagagactctgtctccaaaaaaaaaaaaaaagaaaagaaaaagaaaaatatagaagaagaacataagtcaacctttttccatgaaattatactgtactctaaggcaaattcttgttgcttgatcttagtagcttttttatgcattgacttaaacctggaagagtttcttatgaatgtttgattgactgtgaggtgcatttgaaacagcttctactttataaccctttgcagaactttcaagctctatttagataacaatatatatgggattaaaatggaaaatgtgacatatgtctagagaaagttcctttttctgtgtatgtgccttttgtgacttatacactcagtttcattctagccagcatttgagcctagaaaatagggaagttatgaaaactctgtgccttataagaaggcaaggctatgactgagtattagacacataagtccagggctgggcggaagtaatgaatcaaataaaaacttggggaacttgccataggatgttttctgattaatatgggtttctcttctctgattaatgtggatttcagttactcaactgtgtaactgaaatccacattaataaattggttatttattgcttaggacttatctccccataaagagactaaaattgaggttataaattatgggtagatagaaattccagaaatatttaggtacctgtcatataccttaaacatagatttttatcacaatcatttaggggcttatttattgcttttactttatttaatgtttgtcactgtagaagaaaaaaaactaaatgctaaatataacatttaaaatattttccccttcatgacagccaccaattgattactgtcatggagactatctctatgtggatgacacacagcagcatttcaatcacacgctgtttctttccgctactcagtttgcttttaggttgccttaaacaacttccttggtgaaaaaatcaacttcaatattaaccaaaatttaaaagattcatatatagtaaaagaactaatattcgcagattgacccattccattctttcagagaaggtatgagatacttgacagtggagctagcagcagaaacaataacatgtatgatgaatcccattgagtctttgcagtttatttttattaaaatattttaattgaacaatttaagctttttttcttcatcaggatttcacaagggtgtaatctgcccagttttattctgtcatttttttcaaaacaaaataactagatttccagattgtttactaattttttataaggtaggacaaaattctctttttctcaatattgttaattaacccattatttcccattagtattatgtacatcagtgttgtgttgtcacttggagtggttttgctcatcgggggcattgacaatgtctgaaaacagtttgattaacataactggcatctagttactagcatctagtatgtagaggccagggatgctcctcaacattctatattatgcagagcagtgtcccccctccccccaaaaacttatctagctcaatttattagtaatacatcaaccgagaaagactgatgtatagaacctcatttgttagtgtaggaaaataaggtgtcacctataaattcaccatccatatttatactgccgtgacgttatccatttgcttatgaaagagatgtgaggtgacttgatgatattaaggagttgttcctcataagttattacattatagtacttctgtcagtttgtctctgtaccttacaagttattaaaatggcttcacttgtgattgagttcatataattctttgtttttcttttttaagcacttaaatatagatccggtggtatggatgagaaaacaattgctttacttgttgctggactagtgatcactgtcattgtcattgttggagccattcttttcgtcccaggtaagatgtgcagttcctaggcaggaacgcaggaggtagatgagtgcattccaaggtgaggagggctgcattagtttcctagggctgttggaacagatgaccacaaactgggtggcttaaacaatagcaattccctttccatgctggaggccataagtctgaaatcaggacgtcatcagggccacactccctctcaaggctgtatggaagaatccatttcttggctcttctagcttctggaatttgctgaagaatgacagtgtttatcattccttagtttgcggcagcataactccaccctctgcctctctggtcacattgcctcctccttcctctatgtctttgcctctgtgtttttgttaaatctccctcagcctctctcttatgagcacatttgtcattggaattagagcccactcatataatccagggtaagctcctcctttcagatccttaacttcatcatatcttttgccatataatgcagtattcactcttttgctgtattaggtaatattcacaggttttagggattaggaggtagaaataattttagggccatcattcaactcactacagaggcaaacttcattggccaagacatgaaagtagaatgaatgtgggaaccaagtctggaaattggcagttgcatttggaggatgggaatgtgagtgggaaatgaggatatgtagcacatgtaaagaaaagcaaaggaaggctgggactcaacctaataactatagcacaccatcgtttgtggagaagaatgcagtgcaggtgtaatatttaggaacatgggcttggcagctctattggtatctgaagttagtgaagacagcaggaagaaggaggtgaattcagaagacaacttgaaggaacaattgatttgactttggggcatactgaatacagcagatgaagggaacagtaaaagatgaatacacagtttctcactggaattctgtaaactagttaagaaggaggcagagccaattcaaggtttcagcatgttgaaacttaaatgttgagatttagatgtcttaagtttggtcttaatcaaaaaatagtcactaattttgtgtgaggttttcagggaaacgtatatttttaaaattttcacagttgtcaagcacagaatttagattagtacatttaaaaagtatgtaggaaaatattttaaatgtttttatttattgacaggtgaatattcattaaagaatgctactggccttggtttaattgtgacttctacagggatattaatattacttcactactatgtgtttagtacaggtgagttttcattgttacagtatgattttgtctacctttttcatttacaaaacagcagttttggtgaaaatgctcatataaattttttacaactcaataagagtaggtttattaaaagatttttcatgctattcttagtgacattttcccattcatattaattttaaggttattctaggttagctgttttgtaaaaagtgactttcatatgtatttgatgccaatcagcataattttaaattatgccatataacttcttaatgattattttcatattctaatttcagttttttgaagttataagtggatgttaaacgcagtctttctcttcttttgctaagcttctgcttctgcattaagaagactggttctataaaatggaattatgaatcacaaatagtagaaacatatttgttttaattattagcaaaccttaatactgtagttttaagagatggtatggaaatccaaactataatcagtatcattttcactgcattttgaaagtagatcactaccatatttagttattactattaaagagtcacatttaacacttggtcttagagcctatctctggctcgttgtacattggaaaggtattagtttgttataaaatgacatctagagatagagagcatgatgtttacagtcaggtatttgcataatggttccctcagcaagagcaattccatgtgcatgtggagaagacattcataatagccattcatattgtaaaatgcacaagtgtggtaaaagcagcattgttctaagatttagggtaaaaacttccagtccagcttagctgactgtgaaaattaaaggctgccgaatgtgtgaatttggagctgactacttgtgtggaagggttagatcactgagttaacatctaccgtcaaacaatgaactccagagtcagtctttggtcttaggagatccctgattataccaaatgcaagtggaagttattgctttttaaatactcttgacatgcttctgttacatccttttccttcctccagcgattggattaacctccttcgtcattgccatattggttattcaggtgatagcctatatcctcgctgtggttggactgagtctctgtattgcgggtaagagtcatctttctgtagacctaatttgggttacttttggacagagctcttcttcctttttctttttctttctctctttttaaaaatatatagacttgatttttttttttagtgcagtttttggttcatggcaaaattgagtggaaagtacattcacatggatatttttatgtggacataagttttcaattccatttgggcaaataccaaggagtgcaattacgggactgtaaagagtatgttgaaataaactgccaaactctctgtatcaaaatagctgtaccattttgtattatcaccaccaataaataagagtttttgttcattcatatacttgacagcatttagcattctgagcttttctttttaaacttccaatttaccccagtggtaatagtgctttcctcctcgctacaaagatattagctgtatatatggcttggtggctgattgttctagcacccaaactgatatgcctgtatttgtggaagagcttttaaaataactgggctcaaattggttggagccttagacttgaaacaccagttcccatttcttgatatgataaggtatgtgttatgcaaaggagggctttgttcttctaataattttgagtcattttactggttaagttaataaacatatatggataatttttgttttttgatcattagaataactctcttaaaacttgggattattactgttttttagtaagttatttcatatgcttttctaatacagaattttatttgtttttacagcgtgtataccaatgcatggccctcttctgatttcaggtttgagtatcttagctctagcacaattacttggactagtttatatgaaatttgtgggtaagtcaatcttattttcattaacctatgccaataatttcagatatatcacttagaaaatgctttttagtttgttcttccagtttaggaccaaaaatgagaaaatacaattggagtgattcgaggataattaaagagggtagaagacatataggatttttagttggttcttccagtttaagaccagaagtcagaaaatacaattggaatgatttgagggtaattaaagagggtagaagacatataggattaatgaaaatttggtttccaaagtagtttaaaggaaaatggctttatctattagaatgtgtacctttttatactaagtaaaaggggagagatctttgaggatccattttaagtaatagaataggatttttaattgttccagtgtttctgtgatagagctgtcctgcacagacctgtttgtttgtcacttgctctttttcttgcagacatagacaccccagacaggaattaaaattcacaatctatcaattttgttcatttaaagagcagtgacctctaatgcatgactttaaaacagttctagttaaaaccaatataatgaaaacattgagtttcaaaatttaggcttttactccttttaaaatcaattattagtaagtatggaatttacttcattgtttctaacttgtatatttaatctgccaattttcaagtaacatttctgcataaattcttattttttattgagatatatgtacacagagagatattttcaattgtgcctgaaactaatgttatcttacctaagctcaagatgttcccaataatgtaatttatattagtttccgttttttaaaaaaattatatttttatgaaataaaacatactcttaaccacctatcaaaataatcaaaagttataaattaatggagtaaaaaaatagtgtttctgctttgctttaggtaaactttgctgtatgtgtttctaaaacttaatacgaaacttgaattgttatagtcaaataatttctcatatgactcacataatagtttcaaaaaacttttacctttatttctgaactttggttcttgatgattgttaattgaattcaattctgtcatatattctgtgtctttctttaattaatgcttattagataaataattaaaatacttaactaaaatctgcgtatccttagcatatgagttcataagtcttagttgttgctcaatgaaattttctaattttataccacataatgccataaaatacaatggagacatctaaagcagaatggaattcatgtggtagctacagtgaacatcttgaatgttggtgcatattctatttttgttacatcttccaatcaccatgtgtctggttctggaagatgacactcctggttttgttgctccccacaaatgcctgagaatagtgtgtgatttgcagtatccatacaactctggtgaagtagtatgagatacctttggctgacgggcagcacgctcttattttttcctcactatctgggttgtcctcccttttactcccatgccaccccatgccttccatatctagcatagaatgatcttcagtacagttgccagcaggtctggtgacaatgtctcaagtggaactaagcattgtctatctgccacctccttaacttcactctcctgccttctccatcacttacgttcctccaagcctgtgaaaccactgtactgtacctgtcactgttctgacattaaaattaaaatgacttaaatcttgacaagtaccccaaattattttttctttgtcataggttagcatataagtatactatatgctaaaatttatgctatatgtttaaaatttagtgcaattttattgatagtgtcctaattttattgatagtatcctaaattaactttttaaatcaacttgtctgatgccagggttcagagggacacctacagtcagttgaaaggcaagaagagacaaggtacaggaaagttgctctttagataacatggtagactaggaggaacattaatatggtttgcttatataatctgactgtgtaaatctgaatctatgtaacattaaggttgcaaatttgagcgtttatattaggaagttaaaattttaagtgtctccaaaataatttttactcattgcacgtgttctgttttagaaaagcctaatgattgtgttttgatttaaatgcaataaaatcctcaaatagttaaaaatccaagctttctcttcaagaagaagttaatgtcgctatgagatttttaacttttataatttttattatttccaactttaaatttgtagccttaatttgctattttaaagagtaggcctttcactttctacaactttctgtgaaagtgactttcactttctattttttaactttttaaactgtgttgtattttttttcttttattggaagcattttaattttataagatgagaaaaaggactgggcacaataacttaatgtgaaagcatagaaaagattacaagaacctaaccaaactcactaaagttgggcttgttgtttgtagagaacgtttatataattataaggatcaatactttctcatttttaaagccattaccagttagttcaatataagggcatatagtgttttgatacaaatcaatctggtagcagtaagtaccatatttaccacaacatcccagatattttagaatgatgcagatgcagaatatatacgtagaatttatatctatgtatagatacaaattcagatattttcttgttcaatttaaggagaggtaaatttggtatcaatagaaaaaatgtttctgaaaaatttaaaccctggaaatgtatttatggcatggagtcagatgtttcagggagagaagaacaaatcaagaagcattgcaagtatgctcatatggaatgcttaaggcttgtggttaaaaaatatatatatatggctgtcaatgtcttaggctcatggtagcagcagaaatcgtaataattcttttgtcacatgggttatatccatattggagagaattaactcaggtgaaattaacttgtacactgtttggttttataatatttagagggatcacaactgactgatgtccctttgaagtaccattcttcataaatctttttttttcagaatgggccagccaactgtgacatcccttggatcggagatttagaactagaaagtattctttctacattattagggaagaaaaggagttacttggcggttagcaatattctattttgttttgttttgtttttagagacagggtctcattatgttgaccaggctggcctcgagctcctgggctcaagcaatgctcccacctcagcctcccaagtagctgggactacaggcatgtgccactacacctggcagtgtttattctgataaatacatttatgagctcaaaaatgtaactctaaaaccttatctctgaacttccatattaccatcagaaatttagatagttgtttagttctctttttctttgtagaacatagatataaggcatggtttcattgaagtcagttgtatatacatgtaactatcctgatgttcccaaataaagctctgtatttctgcttagtttattggggaggctgctaaatgtagtgcatcccaacccattttaccctgttctactttaaaaagaggttggcttcttgtttggatacaaggaccaagtcactcccccaggttcctccacagtaagggaggcctatttaaagccgcccatggcactaacagaaactggactcctatgagctcagatacataactgggcctcacaggggtgggacagtatgtagtctaggaattggaaggatccattccatatcaaagaactgaagcatcgtgttgccctctcagcagcaagagtaaggtgatgcccctgtcagttatagttcctgagttcctctgtctttgattctttgcctattagccagctagctcaccctcttgtttatgccactgttttttatcctattcatgccttctcacagacaacttttcttacctacagctttggactcatccttgtctcctttctgtttctttttcactttcccttcccatcaccaactttctgggtttttttctgtttcttcttagagtccagtggcagggagaaacttgtcagtccagtctgttgccatttttcctgtttgagaaagactcaccagcttttggctggctcacagattggctttccttgggtcaggacccacccttttccctgccagctttggaagcttgacagaattcgagtgtgcagtggtggtaaataaatagtaaggaacacagagcagtcctggaggcgtgcctccatctgctgatgagaaaatccagtgctgtcatccagcccaggtcccagcggaatgggcctctctgttcagtaggatccccctcctgctgagtggttcatggcatgtttctgttcaacgcttttccatctgtaggattcttattctgtatttatttgtttttttgggtttttttattttttgagatggagtctcgctctgtcgcccaggctggagtgcagtggcacgaccccagctcgctgcagcctctgcctcccaggacgagggagatcctcccacctcagccttccacgtagctgggactacaggcatgcaccacaggcatgcaccaccacgccagctaatttttgtatttttggtagagacagggttgcatcatgttgcccaggctggtcttgaatgcctgagctcaagcaatctatttgccttggcctcccaaagtgctgggattacaggcatgagccaccacggccagccttctcatttgttttttttataaggaagctatctcttcttccctccccaactagggtattctttttccctttcgtcactttgctcatgtactgtattccttcaacttcattaatgaatccatttggaagcagtgaaaaaggcaactcagaaagctaagaagaaatagatagaggaatactcagagctatctgagtattttctttagtttgttagctctttggagctttgaaactggaaagacccagggagtgatgtggagaaagagactgagcttgtaagacacaggagcagtgagctaagggagatggagtagtggggacaaattctggcacattctgtctacactctgggtagatagaggagggaggatggagcacccatggtgggggtatgttggtgacagcattttcccaccagccagtgtaacaagtggctgatttgggggaaagatggcataaacaaatgagagaatgtgtttactatttgatgtagatgggttatttgcttcatttttcaaatcagtgtatataatcaagaatattcagcatgtttgaatagactgtcagagctggaactctttcattaacatctctggcacctttagttttagccctgaacattttatcttaaaattaaacattaccaaatgccttagtttatttcatttattaaatttatattcttatttgttatttatatcagcttccaatcagaagactatacaacctcctagggtaagttaaagtttattaaatgaattgtgaatgatcatttgagggattagactgaggaacttggtaattgagatattttgctatctgttttgtctcacgtcaaattaagagaatgttgaagtcattgcatgacctttgcatgaatgggtccagttctattttaaaacctgtgtttggtcattttagtgtcaatgggatggaataaatgatttcttaagattgtactgacttctcacacccaaaactggaaagtaggaataatggctatattatctctgcaatcagaaggaagctgattccaatatatcacctcacctgttggattcattggatgtgcatacacagaatgacaatttcaggcttaaaaatgaggagaaatctatactaagttgacatcactgataattataatctataaaataaatgtaaatattgctgaaaacatctgttcggagttatgattcgatcctctcccatacaaatgttttataaacattttttcccttaaaactgtgcttaaggtttcattgtaccttagataccttattaagccatctgaggaaattgcaagaaaggagtaattttaggagggcataaatgaagagaaaagcatatttataaacatagacttatcacagtgacaggcccaagaggtatgttgtggacataagctctggaaaggattatattgtacttagcttcctataacggagtgatgatagatgtatctggaatgccaaagagagtcttctgtctgtggccggaggtagaggtcacatatgcttctaagtctgacaagcctcattgtgcctaaagggcaggtggggcgggtatgtgtgtctaccacaggggtatattctagaaagattggtgccatagctatgttggtcacaagaggccagcaacttaactggacctgtgaatcctaacacattttctttcccagttactgagttcaatttgcgatacttaaagatgattctgttttgcttccacctcttcactgtgttatttattctgttgttgctatttatgcttgcactttcatatttttagaagttagaatttcttgagctgagagtggtgaagtgggaaattctgtttagaaaaataatattaagagaataatacagttattattaaactattaacccgacttggcaagctttgctttaacatttacaggcttatttcgttgttttgttttttcttttttttttgactgtaggatttactgcttactacgtaatttaaatattagcatatataagttttactataaaatgacatgacataaattatatttttatgtaaatatattttaaatatttttcagaaagctgtagaggaaccccttaatggtatgtggttatttcactcttaatcctttaccagatcataatttgatctggcccgcaaaacagttagaatgccctgtctatgccttaggaagaatctaggtttttttcctctttttttctttccttggcatctctactcttgattattcatcaagaattatgggctgggtgcggtggctcacgcttgcgatcccggcaccttgggaggccaaggcgggcagatcacgaggtcaagagattgagaccatcctggccaacatgttgaaaccctgtctctactgaaaatacaaaaattacctgggcatggtggtgtgtatctgcagtcccagctactcgggaggctgaggcaggagaattgcttgaacccggaaggcagatgttgcagtgagttgagatcatgccaccgcactccagcctggtgacagagtgagactctgtctcaaaaaaaataaaaaagaattatgaatattacttttataatattctcaccactgggaaaaatgcactattctgtgtctaagtagctgcttaccttaaccaagtgatatttgggcaaggggatcgttgccttttgctactggttgagacgaagcatggcaccccctagtagagaaggatcccaattacttccaatttgtgatgtacacattttagaaagatacaggctattgccacagagatagaccaaaacatctcattttctttctttgtaaacctagatctgatttcccaactaagtctgtttcctttgtgaatgctgtgggtatgatccacagaaaggctacataatgaaatgatagctttacaattaatttggctgtagagttgtagactagttagcatatcattgcatatttgtttatttagaaatgatttccaattgtggaacctcactaactgcctgcttggcttgttactaatcctagcattcaaagaatcaaaaggaatgatgaatgatggtaagtataaaatgcacttaataattatagatcagttaaaacatggacattggaaaacaaaaaagcttcttgaaaatgtggctcttttttagtaaaagggacactgtcagatgataaaggttcacatttcttgatgtatacaacttaaatctactttgctaaaaattgcaaaactactactgtaaaaactgtagggtgtcacgaatcagactccagtcatatggctcccagcaaagagaaattaccactttttgtaaaatgtttttcagattccgtgtctggtgactgtaactttaagatgccttttataaggcacataaataatctggcacaaatctttatcattttgacagagtttcttttatgcttgtgttggtgattttgttgcatttaacccatggggacttaacatctctgcttttccaatcaggagcttggttctaaccttttgggagatgattaaagagagaggttgagagagagagagagagagagagagagagagagagagagatgtttcgtcctcagcttttgcttccattttttttttaagaactctgggctaataacttctaatctttatagaatatttcaaagaaatatatttgttcttaaagatacataggtttgagatattgagtgctacaagcatttattttggttttaccttaacatattatgattcctcagttttgttggcatttagtaattatgtttatgtttttatcttatcaaaaaatgtcttcttacctttgatatttataatcactcctcggtcatgtaaatagtttgctttatattttactgttttaaagtctgtgaccttacctgccctcttctgtagcaaagtgcagcatttaactcaggaagctatattccccccaagtgtcattaatatttgcataagattaaaaacactccagtcggccgggcgcggtggctcacgcctgtaatcccagcactttgggaggccgaggcgggcggatcacaaggtcaggagatcgagaccatcctggctaacacggtgaaaccccgtctctactaaaactacaaaaaattagccgggcatggtggcgggcacctgtggtcccagctacttgggaggctgaggcaggagaatggcgtgaacccgggaggcagagcttgcagtgagccaagatcgtgccactacactccagcctgggtgacagagcaagactccgtctcaagaaaaaaaaaaaaaaaaaaaaaaaaaaccactccagtcatgcattggtgaacaaagtttaaaacaacgtgtattcagcatggagtcacagaatgatcctacttttgtatgtttgtgtcacagcctttaaaagcatgtcttgttatataagccattaccctcctaaaaaagactatagttcacaggaataagttaaaagacataacaaaacataaaatgactagtaccaggaattgtgaccatggtttgttctggtaactgtggcatggcatggtttgttccaggaattgtggcatggtttgttcatgtttacattctgatgtcctattttttttttttaatttctatgtcctttccttttccttggtggtgtcattgttctgtagctgtatgaagaaactaaacttttctccattttcaggaaagcaatctaagaatcttgagtgcctcttcctttgttaatttctcttaagatgtgacttttttaaactactgcatcaggaaatattgtaaaacagttttgccttgaatatttgtgatgaaatctacgatgatcttcaagattctcttaattttgctaatattcagctgatcagaatttgtttttaaaatgtctggctggtgggtacttcccactgacaactgcttattgcttacagtatgtctgccttgtcaatgaatgaggttcagggtgcttcctagggatcagagtcagtaccatttttctctttcatctacagctgatcagatgtttattttacttacattaaatgaatgatggagatccaaagtgaatattatagaatattattctaggatcaacatcttttgctttgaaaaatcaacatctcttggcttttcctcagccaacccagcaaacagagattatcagactctgttgattttttactttcatttggcattggcctttttcttactgaaattaaaaaggctaatgatttgcctggtttctgtctctgacctttgcaggtctattttcttaatttttagatactatatatctgaaactttttttaatgtgtcaactttttaatggatagaaaatagacacgaatagtgattatgtgttcatttttcaattttccagaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagctattttgttgggctatttctattgctgctacagcagaccacaagcacatttctgaaaaatttaatttattaatgtatttttaagttgcttatattctaggtaacaatgtaaagaatgatttaaaatattaattatgaattttttgagtataatacccaataagcttttaattagagcagagttttaattaaaagttttaaatcagtccaatgtgtttcataattattttttaattttctccatggtgcagtgaaaacatcacatgagaaagcaggagacctgggtgctagtcctggctacactaccagctagcagaggacctgggaaagctacttccctggatctcagtgtccgtctctgcctgtagaatgagataagtctcttcaagactgaaatgtatggttctccattttaattatcagttaggactattgattacaagtgaaagaaaacttaaatctaagaaaaatgggatctattggctaacataacctgaaaattcagacacacagctggatc

SEQ ID NO: 15500 - DNA, 5932 bp, Human
ttaatactgaattacacaataaataaaataatccacgcctgtaaatcccaacactttgggaggtcgaggcgggcggatcacctgagatcgggagttcgagaccagcctgaccaacatggagaaatcctgtctgtactaaaagtacaaaattagccgggcgtggtggcacatgcctataatcccagctactcgggaggctgaggcaggagaattgcttgaacctgggaggtggaggttgcagtgagccgagatcgcaccattggacaccagcctgggtaacaagagcaaaactctgtctcaaaaataaataaataaataaataaataaataaatagataaagttacaatttacaatttcattcttctttgattggccctcttctctcccccacctaattgctgttgtccttttggtcacactgccctttgtgacatctccttcctttcagggctgcccagactgtagcaggctgcagtggctggggagaccctactcattcctgtgcccctcctaaccagtcctagatagggctaaagaacgtctataaaccttttcagaagcttccagttgacacattctctctcttctctgaaatcctacaagtgctatctcatgatttacaaagacccaatacatgtgctgtctcattctgtcattgccagtcttaagtcttaagccctttgaggcctgattctacagctgagacatcctctatttctccaccatctctctgtctcattcagagcacacagtatgaatgaggtcaataaacacagtgttttttgttttgttttgttttgtttttgttttttttgagacagagtcttgctctgttgcccaggctggagtgcaatggtgtgatctcagctcactgcaacctccgcctcccgggttcaagtgattctcctgcctcagcctcccgaatagttgcaattacaggcgcccgccaccacacccagctaatttttgtatttttagtagagacggggtttcaccatgttggccaggctggtctcgaactcctgacctcaggtgcttcgcccacatcggcctcccaaaatgctggtattacaggcgtgagctaccgtgcccagcccaataaacacactggttttttttttttgtttgctttgttttgagacagagtcttgctctgtcgcccaggctggaatgcagtggcgctatctcagcttactgcaacctccgcctcccgggttcaagcgattctcctgcctcagcctcccgagtagctgggattacaggcacccgccaccacgcccggctaatttttgtctttttattactgatggggtttcaccctgttgtccaggctggtggaactcctgagcttaagtgatgtgcctgcctcagcctcccaaagtgctgagtttacaggtatgatccactgcgcctaaacatactgttgagtgtaacctcaaataggtcatttaacccttcagggctttgtgtatctgtaaaaggcagacaacagtccctaacaggctattgcagataatgggcttagcactatgaagcagctgttttatggggctccaggttcaccttaggtttgacaattgaattatgaaagataaaggagaaagacttgtcagcctctccgagtagatcctttggccgaaggagtgtccatgtggggtggtatctcggcctggtggagggggatgcgatggtagtgagaatattagggtattcatatctttcctcccgagtcaaacgttgccaggcacgttcctttcgcccctcccaccctccattctgcattaattccaagtttaattccaaatattagagtgtggtagaaaaggtcaaatagagcagccacggattaagcaaacgcccctccgcgtatggtgggggctgcagcgcccgtagctccacgctccgccccgccgccgctgattgtcccgcgccttgtgacgtcacacgcgggtttttaaggccgaaccctaggcaggctctgcagaggcagcggttggaggcgcggtgggtgtctgcgggggtctcgcggggcggctgcggtgtttcaccgggaaaggctcgaggagagcgcggctcacgagaggtaaacggaccctgcagaccgtgctgaggcggtcccggtgccgggccgctggagctggggtcggccatcggaggagggcgggcgggcaggagagtgtcgcggggcggtggggcgagggtcgcggagtaaggaagggcaccgtgtcaacggcttggggctgcggagggcgggtgggagccggactcaatctccggtctcagcgtctgcaccctagctcttagtttgggggcactgtcgacttcccccgtccctcggggatcttgcctgggggatggcgccataagctctgagaagaggctctagaagcccactgtccatggatcgagccctcaccccccacttgagtggcccaggacctgggagtctctctaggtcccatcgcccccctcacgacccccccagggagtgggggaacacctctgttatgccttaaaaaaaaaaaaaaaaaggaaaggaattttaaaaatgaaggatgggagggtgatttaggaagggatcaagaagttgcaaatcttgtgtgtattattaaacgtctcctttttctcccatgaccttttcttggttcagataacccagctgtgctccctggaaccttcaatttcaaggcctccctgcctctactaggcgccttagctcactatggggaaccacttgactgagatggcgcccactgcctcctccttcttgccccacttccaagccctgcatgtcgtggtcattgggctggactctgctggaaagacctccctcctttaccgcctcaagttcaaggagtttgtccagagtgtccccaccaaaggcttcaacaccgagaagatccgggtgcccctcgggggatcgcgtggcatcaccttccaagtgtgggacgtcggggggcaggagaagctgcgaccactgtggcgctcttatacccgccggacagacggtctagtgtttgtggtggacgctgcggaggctgagcggctggaggaagccaaggtggagttgcaccgaatcagccgggcctcggacaaccagggcgtgccagtgctggtgctggccaacaagcaggaccagcccggggcactgagcgctgctgaggtggagaagaggctggcagtccgagagctagcagccgccactctcactcatgtgcaaggctgcagcgctgtggacggtctgggcctgcagcagggccttgagcgcctctatgagatgatcctcaagaggaagaaggcagctcggggtggcaagaagagacggtgacccaagccccccctccctttcctcccacctagtaggggtctgcacacttggacagcagggtgggaccagcctgtgacctctcagtcagactggggtgcaggacctgtccacctcaatgaaggagagaggagcatggggtgtcccgttttggtgccacactggggtggggatgggagatgggatgtctttgcatatctctctcatcctctctggagaagtgggcgctgcaggactgtggagacgtaaatgtaaactgtgactctacctcgaccctgtttcttatttttcttctctggctaaaaatttttaattggatgtgtttgggggcggggggatggaagtgacttggagaatgtgtttgggatgaaataactatctccccttcctctgtcccccaactggggagtctccccaggctgcttttctaggaataccagtcacatagtttttatttttgtgtctgtgaaagtgccaagaacccctccccacatttgtagatccatgaccctttttataagctgtgtgtgtcctctgtattattgttattaactattttttagcatttgcctgtaagttattaaagactgataactgtagctcttaccttggtctggggcattttcctctccttatcttgccccagagacaattcaagatttctatatggggttgtggcgcagggggagggagatttatcttgaagctgaatttgcaaagcaagcacttataaaaattagattgtgtgttacgggatggcttgtgaaaattataggggggagtggaaaacccctcaagctattgcctgatctctgtagttttttgggtggggtcacttcctttttctctgatttaacacccctcccctcatcctctgggtcttacttgtcccttatatcaactgctccttgcagatttaacttcaaattttgctagtctgagctactcctaggttcttgaccttggtgacacctaagtctatataggtaagtcctcaaagagccattctgttcccatcctccccacttccccagtcttaggttggtttgatttttttcctccttgtaagatgtggtgagagtggaaagtaattcctccctggccttaagtcacctctgtgtactcaatcctgctgactggctcactggcatgatggcagcggctggtgctagggaggcctgggctggattgagccagcctggccctggtgactaagccatgagttttccagctctgggaatggtagctcttctcacgagaggggcagaagtagtagctgtttgtgcttggtggcagagaggactgctggacatacaccctccagactccaagatagaagggggaagacataagcccccagtatttgtggtgattgtaagaataaaatgctaatattacaagggcttgagtgcccctactcaccagcaccagggccagctatgtctgataacagaacccttagatcctcttaatcttctgggtgggagcagtgagtaagaactaagcacaaggccgggcacagtggctcacgcctgtaatcccagcactttgggaggctgaggcaggaggatggcttgggcccaggagttcaagaccagcctgggcaacatagggagaccatgtctctaaaaaagaaaaaaaaacaagcacaattctttccagttgtcgagccctccagccaccccctgccaccttttgtgcaaacacacaatccccagagcaggttcagcgttcacaccctgcttctccccaattctgtctcctcttctccggaatcagatgaaaggacctggggagaaagagaaggtgccggcaacccccacttctggggaaggtttcctaaagaacttgcttcttcctacccagcgctgccagaagctcagatttggtcccctccccatccctgtagctggcaggattggggtgagtgtgcattgatccggaagggtgcccaagtgtgcgtcagtgctagggcctgcttgacagaactgctgggctggttctgctgggaacatgtgctacctgcccctcccccagacacacctgcgactcctctcccagtctttttggggcacagtcctatagcccaaggacaggttgaggccccagtccaggctggaaaggaactggccagaactgaccctctgtcctgccaggagatctttcctccccaccccaccccacccaaattctgctcttttgtcttaaaatcttcaattatacattttcatttcttgtcacttggtgtacttaggtctccagatttgggggaagaggtgcagaggtgttccccaatccctagcagaggggcctccaagatgtcagctcctgattctggctcttccaaccacactccttccctacctgcttaaaacaggtatcttctgcttccccatgcccagccctgggggcggtcagggatcatggtccacaggaggcctttgaatgtcccaggctcttccccagtccctctggcctgactgtccagctggtggcactaaaggaagatgggggcttgtgtcagagagagacggagaagccaactgctctgccagagtagtggggagaggggaacactggggaattctgagtagaaagccacaaat

SEQ ID NO: 15501 - DNA, 56904 bp, Human
  misc_feature (1)...(56904): n = A,T,C or G
caagagcagaatattagtaataataattagcttaaaaaaataaacatataccaatataaagaacagcacaaggcaagcaaatatctgggcctatattaacagacggtattcaaggatatggctagaatttccaaaatgcctaataatgtgtaattcttggcattaagccgccaatttgaatatggccctttaatatgaaatgctatataatgacagactttattatagtctgatccaaggcccctgaactttccaaaagggcaacaaaacagacagatactgtattttttcactagttggtactggtggcacccttttgagtgttatttttggcattacgtgtagaggttgacagattcaagacaacactaaacatgttagcagtcaccacacgcaggctgtccagcagaatgacagcgcttcccagatcctagaaagcatccagagtcactgcacccatcccctgggggccctgtagtcctgcatctccagatgatgggagctgcaaacttccctgatggtgccctcttggatgctcatgaggcctgatctggtaccacgactctagcagtaggtccattcaatggcagtaaaaatacatgttgtatgttgatcagaatttggcaggacacatgtggaaagttaatgacatcctggccgagaacccctgtgatatacactggttacatcctgtccaactggagtttttatgtgctgtttttggcagagccaagtgaagatcttgttacttagccattcctgaggtactgaagatacccgggtttttgtcattacaggataggctagaaagtagccagggtctcataaccaaggctttctctgaaacatataatgacaatgctagttatttgaccaaagatatccaatgctttaatccacttggaatttattcttgatgtgaagggtcagcatcatccactggtcgggagcctgatccttggagccaggcagacctgggttgagtccatctccgcctgtttccagctgtgggcaaggtgtctgacttctctgagcatctgtggggtttgtttgtttttaaacctgaagaattgggataatctgtttcctcacagaatcattacgcagatgcaatacagttaatgaaggtaacatggcacataggaagagcacaatacacgtcagctcttactcttcatggctagaagatgtggactaaacttccccctttacagttttgtgattaacaccatttatgaaagaaataaatgaaataaattccttttcctgtcatgaggggaacttacctgattttattgaattatttggtgccattgagttccttattgtttccctctgacctagatttctgggtgtgcgccagtaacacgactgtgattgttgctgctttataacattgtctgtggtcagtccaaacaagagtttaaaataattgaatgaaatggattttaaacaatggtccccccaccctcaccccgtggcactcggccaaaggaagaggaaaagttctctgttaaagaaaatgaatcagagaagaggcccagaccgtgcctccgaaaattctcattgtagggactaagtcctctcactctgaactcacacccgtctgttcgcagcctgacctcatatcctggtctggatgtgcggcctcaccggggtgtcgtgcgcacgtgtggttgtcctgtgggtgccagctctgacttcctccccagacacccactgcctcagccttaatcacaggacgcgcgttgagtagaaatgagaccagttagtattggtaactgcagaggaatatgcattttcaccagcgttctcgggtcagagggtttgcctggcaccgcgtactgggaaactcgccaaaagcggtgcaggttggagacgccccaggccgcggtggagttgcgcgcggcttctaaagtggagtggagcaggcctgcaccctccccgccggggctgggacggcgcttccaggcggagaaagacctccgcgggccgcgcgcggccttccccctgcgaggatcgccattggcccgggttggctttggaaagcggcggtggctttgggccgggctcggcctcgggaacgccaggggcccctgggtgcggacgggcgcggccaggagggggttaaggcgcaggcggcggcggggcgggggcgggcctggcgggcgccctctccgggccctttgttaacaggcgcgtcccggccaggcggagacgcggccgcggccatgggcgggcgcgggcgcgcggggcggcggtgagggcggctggcggggccgggggcgccgggggggcgcgcgggccgagccgggcctgagccgggcccgcggaccgagctgggagaggggttccggcccccgacgtgctggcgcgggaaaatgttggagatctgcctgaagctggtgggctgcaaatccaagaaggggctgtcctcgtcctccagctgttatctggaaggtaagcccgggccgcacgggttgggctgagtagccgcgcgccctcccgctgctgctgggcccttcctaggcctcgccgcccgcgcgctcccgcctgcgccctccccgggtcttgtcttttttttctttcttccctcttctcttctcttctcttcagttctcttatattctgtctctctttctttctctctgtgtctgtctcttttctcttctcttgtctctctctttttctctctctctgtctctttctctttctcgcgatggcccctaggcgccgccggcggagcgtggcccccagccccggcaccagccccggtagagccacgccggatggtgacggcggcgtccgggaccccacagtgcgggctcccccgaaaaagtttgagaaagccaactcgccaggccttaacatccctgggatcccacgttgtggaatttccaccgttaattgggactgtgtgttaaaaagatcgacccgtgtttgtgaaaacatgcgatttccattaagcatcatgtacacaaggagcaccactctaccatttatggatacagaatttcaagtgatctttccatctcccccacccccatcttatctacagaccacgaagaggtcttaggaattcgctctcttttcaggggaggggagcccatttaagaaggcgtttccaaggagtcccccagagtactggggtgtcatgttcgtttccttaagtgaagctcagggccaggagggcttcacttttgcgttctttctacctactctccttctctaattacatctgttttattttatttttctttcctgttgtagtctttagttttataaatggaaaaaaagtaaattaagggttatgggtcttcactttcgtagcttctaggtgggtatgaaattgatctgatttgagactggtgctcccagaccattgccttcagcagaaaggctatctgtgcttcagagatggagtggcacttggacttctctgttgttttcaactaagaatataagagtaaaaatgtggccgggcgcggtggctcaagcctgtaatcccaacactttgggaggccgagacgggtggattatttgaggtcaggatttcgagaccagcctggccaacatggtgaaaccctatttctactaaaaatacaaaaaattagccgggcgtggtggtacacgcctgtaatcccagctactcgggaggctgaggcaggagaattgcttgaacccggcagggggaggttgcagtgagccaagatcgcgccactgcactccagcctgggcgacacagcaagactcggtctcaaaaaaaaaaaaaaaaaaaaaagagtagaaagaaatgtgaagctcactttagatcaagtaggatttctgctagaatgccatgtttttctttttaaaaaagcaggagaaataaacaggcctcatttattttctaacctatttttctttccttaacctctgactctaccctgaaggcctgcttggagtcacatatgcagatcgcactagtgatgtgggtgaaacctgtttgcccttcttgccacagtttgtgtacctcactcctcttctgtctctgggattccagggggctgaatggcccagagaaggctcatctaggtggagtgggctcacagagcctagcatttggagggtggagattgtttatttgtccctaaaagttgatgtctgagcattccaaatcatcttcaattaatacatcgcttattttttccaagttgctcaaaattctgagcacattctcatttacatctgtatcgagttagtgttaggcatcatcatctccactttgcagatgggtgcctaaggcggggatgaatggacttttgtaagtgcagagctggagcaaagtttaggtcacagctttgccaagtcattgttttgttttcctgggagtaaaccggagatttagtatggacctggctggtttaattattgttttgggaaaaaaatctaaaactcattccaacatgtcttgaaatgaattataatgttgactctaaagtctcaaaaaaaaaaaaagttctagtacagcagactgccttgggttaaaccttcttctaggaaggtgtcactctaggaattctttcttactgagttttcttcttttcgttgttatagttaattagagaaagtaaatggaattatcattttgtagttggtagactttaacaagcctcagcgatagtcttttaaagactggaagtgctatttgtcttttgggaaaaatagttcctaacatctggatgagtaatccaggctttccactttcactgacagcctaaatcagtcaatcagtgtcgatcagtcagtcagtgtttattgacgcccactcagggtcccaggcattccctgtcagggagagaattgaatgagatcaagtttttcattgttctatcaaagaagcttccaccataaatgtggtttgatggtgcatgctacctgctactcagcctagctgtcaaagcaacactggtaaacataaagatggctagcaattattaaatgcttactatgtgccaaatactgttttattactctatgtgatctgatatagttatatttcatgatagcactacgattatttccattttatagatgaggaaactgagtcaccaaaaggttaggtaacttgtctagggtcacagagccagtgagtgggggtactggaatttgaactcatgctatctggcttgggagagcccacttttagccactggatgctctactgattgtgacaatttgtctcttttggaattcactgtgattttcaaaatggtatctccagaaactcctccaattaatccctgaaatgtaagggtagtctctttttcttttctagaaacctgatcctggcaaaatgattagctttaacagtaggattaattttttttaaatgtatataaaaatacttgtatgtaagaaatcctaaaagggtatttagtgaaaagtaattccctctcctattcattttccccacctagaggcaatcaccctggagttttatgtgtgtccttctagaaatactgtgtgcacatataagcatttattataacatgtgaattttgctctccagctttttgtgaatatgcatgtttatagcagtatctattcaccaggaccgcatttagctttgcaatattcggtctactttgaacactgaattttctgattatttctttcccctggagacgtcaaagaaaacatgaacactagccttttgaattcagggttttcttttcattttattttcatttgttcatgtgtttgtatttacatacattgtgcctgaatattgtacatgtatgtgacagttgtgtactgtagaatcaaaaactaatgtctgtgaactgaactcttcttgaactttttgttgttgttgttattgttgcttttggagatagggtcttgctctgtcacccaggctggactgcagtggcacaatcacagctcactgcagccttgagctcctggtctcaagcaaccctcccacctcagcctcccaagtagctggggctgcaggcatatgctacctgactaattaaaattttttttttttttttgtagagacagggtctcactatttttactagtttgcccgggccaagccagtgttgaactactggcctcaagtgatcctcccaccttggcctccccaaagtgcatccctacaggcatgagccactgcactcagcctgaactttcgaaatttattttaagggcccacttttaaatgcttcttttcagcagctaactttccagcggatgcttcatgtggtgccagccatacagatacgcttttagaacttgagctttggagaagcttatgcttgctttctgctctctcctgaggtcatcagatacttcccttgttcagtaacaaagaaagtgagactctttctgttacctaataaaaggccagtctgtccatttcattttgggtgctattaacattgttgaccatttacaatgtcacaggccctggcactgagcacatcatgtgcagcctcacttaattttcacaccagtgccctgaggtttctagaaaagaggaagggccccagtttaggtggcagtacttttcaatttggaggcaggagatcccagttttcctctgacctctctgagcttccgtgtttttacctctaagacagagagaccaatctctgttcagccaccttagaggattgttttgagggtctataagatgattgagggaaagctctgaaactggtaagagttaaatgtatgtttgtgttatgttgatacgagattcctctgagatgctctttagtccaggcaggtttatggctcacacagcgttcctagggtctcattcttctgcacaggcaggcagctcccgagccagccagtctggacccaaatgccacctgtgctcttggctggtcttgcgcattcaccgaggctcactgtaccttggtgttcccatttctaaaataaggcctgtagtaatccctacctcactgagttgttgagagacttcatgtaaattgtttagcagggagcctggcacagaacaagagcctagcagaaaagtaagctgttgttactttaagcaaatatttagcagcctaaaatggtggctttaccagtttctgtaatggttgaagtgatgacagaattcagccaatcccacccatagtttttcttgctaataaagcagtttgtttctaagtgtgttttgatgcgtataattaatacttcctgtccttgatttttggctgaaaaatgtcttctcttcctcgcaccctctgttattcccgtagtgaatattttcattgtggaagagaaattcccattggctcatggttggcattttatttctcctgtccagagacaatatttccacagcctcaaacgtgaaaactgaaaatctggtgccacttaccaccttgtaaaatcaagtcattgtaattgtgccagtataatcattgatctgaaataaaagcagaaaataaatcaatgggtagctttcttaaatacataagaactaaagatcaaatgggatattggaagactttaacttttcctccataatggtggatcttaattaaacacacagaagaacaatttataaaataaattcataggtttgtttgttcttttttagtgtcaatttttaaaactatctcttttttaattaaaaaaaatagagatgggtctcactatgtcgcccaggctggtctcaaactcctgggctcaagcaatcctcccacctcagcctcccaaagtgctgggattacaggcatgagccactgcacccagcctaaaactgtctcaaaagtagacagcataatgaactcccatgtacttatgatgtggctttaacaattatcagcttatagtcagtcttgttttcttacataataaagttacagtttcaaagccattaggaagaatagcttgctaattataattacttagttttgatagtgtaactttgtcctcagatgggtagaatcgttactctggaacaggggtgtccaatcttggcttccctgggccacattgggagaaaaattgtcttgggccacacgtaaaacatactaacgatagctgatgagctaaaccaacaaaacaaatcccacaaaaatctcatttctttttttttttgagacaagagtctcactctgtcgcccagactggagtgcagttgcacgatctcagctcactgcaagctccgcctcctgggttcacgccattctcctgcctcagcctccctagtagagggtactacaggcgcccgggggtttcaccatgttagccaggatggtctccatctcctgacctcgtgatccgcccacctcggcctcccaaagccctgggattacaggcgtgagccactgcaccgggccaaaaatcttataatgtttttaagaaagtttgcaaatttgttaggccacattcaaagccgtcctgggccatatgcagcccgtgggccatgggttgaacaagcttgctctagaaattggttttcaggccgggcgcggtggctgacgcctgtaatcccagcactttgggaggccgaggcaggtggtcacctgaggtcaggagttcgagaccagcctggccaacatgctgaaaccctgtctctactaaaaatataaaaaattagccaggcgtagtggggagtgcctgtaatcccagcactttgggaggctgaggtgagtagatcacttgagaccaggagttcaagaccagcctggccaacatggcaaaaccccgtctctactgaaaatgaaaaaaaaaaaaaaaaaaaaaacttagccaggcgcagtggctcacatctgtaatcccagctactcaggaggctgaggcaggagaatcacgtgaacctgggagctggaggttgcagtgagcctagatcgcaccactgcacttcagcctgggcgatggagtgagactccaactcaaaaaaaaaaaaaaaaaaatttcaattggcttctattaaagcttttttatgtttgtcattgttttctagtaataacaacaatccacattttttgtgagaaatataccataatatagagaagtataaagaaaatgtaaggccagacacggtggctcacgccgataatcccagcactttgggaggctgaggcaggcttatcacctgaggtcaggagttcgaaaccagcctggccaacatggtgaaacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggcagctgatgtatggatgggtagctggagagagaggccatcaggtaacttcacatctctctgtttccatttcctgccctcaaatgccttcataatagagtctacgtaataaggttatagggattcagtgcagatgaagtgctggcacttgatacgggatcagtaagtattagctattattctatcacattaagttgcataaactttaacctcattactcttaaattctctatagaaacctagtctttatctgtcttacaagccctcaaatttagctaatagcgttgttcattgaataccttaaaattgtatttaaagacaggccgtgaatacaattaggcattgctttttgaagccaaaataccatgagggtggggagggtcatgttcatttacccagatcagcaataaaaatactaatggctaacaaggctttctggggaaattgcctgtcattgggtagcccagtgcctctggtgtcagctgaccccggagtccatgaagacatgttaaaagaagaggaaatgtgaatgctttcaaaccagccatggctggcagcagaaggggaggcctttcagtctgttgcaaatggcctgtgacaataaaaatgcctttgtgggtattagcaggctgactgtggacagtctggatctgcggccactgcagggattcctggaacctgttgggaaggtgtccggcgagctcactgtggtgtctgttaggaatctggagcaaatcctatttcttttgaaagcacagagaactgtgtttttacattatacctttaggattttggccatggtttatatttcagtcaaaacaaatcattatgttccctaggcttttatataggttttcctggtcaggttgcatttgtttttcaactttactatctgtcattattgctgctcttattacaggttaacagattattaaactgcacttttcagtaccttgtagctaaagacagacaagtgcagggtgttccacatctgagttcacccagcagtgctgtgttgttgcgttgcactgagcaggcacagaaggctctgagatatgagagacttggtctctaccccagaggagtttacattgttgtggtggcagaagagaaggcgtggcataagagaagacgcggttgttctgtagtgagcatcccagtgtcaggtgccacagttggcatccatgcagaaattctctgcatgcaggattcattgagccctcccgacagcccaactaggttgatgccatgccgttgttgccctgttgtgcagttgagaaactgaggctcagaaacaaatgtcttcaagacatgctggtgctgaggtttgaacaaggcctgtccacccagagcccatgctttttgtactgctggggacatgtgaacagattgcttactgggtgatagatgcagggtggtgatagagacagacaccaggtacccaaatgggttaaaggagaagcatcctgttgtgggcgaggtgatggggaggaggaaggaccggttagagaaggtttatgggagatggggaggccaggaagagcagaagaggctggggaacgaactctagggagagtaaatggcacttgtcacagtgcagtcaggagaggcaagcaacaggaggcctgggggatctgaaaggagtttggagaggctggaatggaaagcaggagtagagggccagatgctcccagtctcaaccctgaagagcctggcatgcctgcttcaggagctcagacttttactatagtggtggaaggaataacaaccccagccattttttgagggcctgtgcatgcctaggccctcaaaaacatgtcccatgttagctgcaaactgccagctaccctgcaaagcacatcatgatcccagcattgcccccgatgacactgccagtaagtggtagctgaccattgggagacagggccacctcccaagcccatgctctcttctgcctctcggctggcagccatctctaggggatttgaagcaagagagtgacctggtcaggtctgcatttgagaaagatggccctgatagtagggagtggaggtggaatggccaaagggggacccagccaagggcgtggtagagcatggaaaggacagaagtgatgagagattgaggaggaaaagtgccaagatgcagggtgggaactgacagaggatgacttccagcctcagtcctgatatgggcgtcaatggcaggtgttcagaatggccttgaagatagtggcatctctatttatgagtgtctttgtactccatttccagtaattggagactttttcaccgtagattcttggaaggtgacacaattttttttttttcctttttggttgagggagggggacagggactgtgtatcttcagaaaggttaatatttgaggccaaggcaggcagatcacttgaggtcaggagttcaagaccagcctggccaacatggtgaaaccccgtctttactaaagatataaaaattagctgggcatggtggtaggcgcctgtaatcctagctactcaggaggttgaggcaggagactcacttgaacccgggaggcggaggttgaagtgagccaagatcgcgccaccgcactccagcctgaatgacaagagtgaaactcggtttccccaccaaacaaaaaaagaaatacctagtttctaccagagacagtcacaggcactgtacttctactctggtttgttacctgtgttcttaaaaaaattaaatgctacattttagtaagaggttagtgaaataaaattttaatttttcccatcagaggacatggagcccttgaattctatcccagactcccagggtcttccaggttaacaagtcctgcactaaggaattggctcagtaaaacctcagcattctcacaggaagagcctaaaaaggagactgggataaattagtgagaggtccaaattatgcaattttcttttaaaataaatgcagttttattactttccacttgtagccattataggcagtagattaaatgagtttctagagaaacctcctttaaaaataaagttatttaattagtccaaggtttaaatatttcccctggaatcttttacatgacaatgtcttagccagacaatttttaagaaacaaaattctccatcctaactcctatccccatcaacagtccaaatcttaacctttctttttttttttttagacagagtcgagctctgttgcccaggctggagcgtggtgatgcaatcttggctcactgcaacctccaccttccgggttcaagcgaaacccctgcctcagcctcccgagtagctgggactgcagatgtgcaccaccacgcccagctaattgttgtatttttagtagagacgtggtttagtagagacgacctcccaaagtgctgggattacaggagtgagccaccacacctggccagaaaccaggtgtttgatatcaggtgacggttgtgatcattgttcgcaccactactttgaaatgacatagttgccactggaccttgttatttaatgtgcgaataaagagacagttatttaaggcattaataagagctatattacaagtttttaaaagtcttttgaggactgtttcaaaaagtcttttgaggactgttctcctttgcaatcctctgtaaatgcaccattgcattccaacccgggcaacaagagcaaaactctatctaaaaaaaaaaaaattcatccacaggacagcgctggccttccgttagacttttgctgttgagtctgtaagttttcagcagctgtgtttctccaaggagcggggctactgctggttctttacgtctttcccccactgccctgcccctccctgcaccctagcagctgacacagtgttttgggatttgaagataacacaaaggctgtgttcagttaaacgtatgtctgtgtgtgtgtgtgtgtgtgtgtgtgtgcttgtgtgtgtgtgtgttttaataattttaacttctctgggtgaaggtgtaaattacaaaataaaggaccatgtagaaatagataaaatgactttcatcaagctcaaaatgtgggaaataatacttttcctctaagctcatattttgaaaagttgtttgagactgttataaaataacttgagaatagtctgagcatgatctcatccgctggaacggagtatgaaataaaacacgaagcctctttttagaaggatctgttttatagatttttaaattacagagattccttgaactggaggataatagcgaaggacccacaaaggaaatatgaataaagcagcacaagtttaaataattgaatgtgagcaaaattaaagggaacgtttgtcacgtctgacatgctccatcctcctgtcccccccacactgaaccgtctccaagaaccttccggagagcccacagtgtgaacagtaatgaatgctccatagctggccgccttgcactctagtgggaactatgatgttgggcacaagtgccagcaggaaggtgggaagcttcccggggatgtttttcctggaggtcaagtccccccttgggctgtgaagtagccggtactggggttcatgggcatttcccttccctgactgttcgccagcgtctggcacagcaccagcagcccctggaagtctaggccagatatgccatgtccgagaatcttttgtaaacatttttcatcagtgactcacagctttgagaaaggattatttttatataaaacgatctttcaattttactttaaagacccaaaccattttcttagaatactgtctaaacaagttaatcatgcacagatccagtgaattctgtggcctggttcttataaaatttccaaataattttatactgtcatagacagagccagagctttttagaggtttgaggcattttttagatgtattactgttctcggtgctcaactagctaattagtgattttttctgagtttagttggtgagtggaaacctttttgttaacattatgacaaaataacaatatggttttaagtggagtgagaggcacttttgaagatccagatcttagatccagatcttaaatctgtttaaagtatgactcagaaaggaggctgcagaaaatgttcactaaaaaaatttaagaataatagcagatgctaaaatttatttcccaagacaatagccaaaaagatctgctggaagaacagaagaagggaactagttggggcatcttttttttttgaatgaagccttcagccttctttaggggaatcttgcttcctgacagagggaccggtggaaagtttgtgtcttaagcaagaaagatttaagtacattctgcaactttggccttgtaagctgtgatcatttttaaggttgacgagcatagttcactatgaaatgaagcaagtaacttggcatttatacattgtgagtcaattttgacatcagcctggattgggaattgactggaaggttttggtgttggactgtggctacacttcagtgtctcggtccagaggcatgcatgagcaatacttccctttgggctttagccattaatttgtggaatagagcaagaactggagaggaaagtcgagagactgccttggatcgcctgacgtcctgttgaatcaaaaagcagtgggaggccctttccttcctaacaaaggcctcatcctcttgcataacattcccagcatctgtcgacatgttcgggaccatcccactttaacccacacttcaagtggatggccacctctgggcggggatctgcattctgcttattccaggtgttttccaggccacttccccgattatgtaactttgatcaaatccagatgcggcagaatgtttgatagaagaggtcaaatggcatttgagaagaaaagcatttctgtattcatgactttggtttaatttcctgtgtgggcctggtctgccaaagttgtatgctcatggccacgaggttgacgcaccagagggaggcactcaagtgccttttcaggacagcctgaaggaagcctccctccccagcatgctttttcatgttaaattatcaattatgtaagtttagggccaggcgcggtggctcctgcctgtaatcccagcactttgggaggctgaggtgagtagatcacttgagaccaggagttcaagaccagcctggccaacatggcaaaaccccgtctctactgaaaatgaaaaaaaaaaaaaaaaaaaaaacttagccaggcgcagtggctcacatctgtaatcccagctactcaggaggctgaggcaggagaatcacgtgaacctgggagctggaggttgcagtgagcctagatcgcaccactgcacttcagcctgggcgatggagtgagactccaactcaaaaaaaaaaaaaaaaaatttcaattggcttctattaaagcttttttatgtttgtcattgttttctagtaataacaacaatccacattttttgtgagaaatataccataatatagagaagtataaagaaaatgtaaggccagacacggtggctcacgccgataatcccagcactttgggaggctgaggcaggcttatcacctgaggtcaggagttcgaaaccagcctggccaacatggtgaaaccccatctctactaaaaatacaaaaaaagtagccgagtgtggtggcgggcacctgtaatcccagctactcaggaggctgaggcaggagaattgcttgaacccggaaggtgaaggttgcagtgagcagagatcacgccattgcactccagcctgagtgtcaagaacgagactccgtctcgagaaaaaaaaaaaagaaaagtaaatttaaagcacttaaaatcccaccaccctgagttaactactgttcacagtttggtgaaattcctcctcgtcttctattttttcatagttgggaccatgcctatatactggaatgtaatataaacacttaatatattattgcgagtatattctcaaacttaaatattttttccaaaaatattttgagtggcttttaaaatatatcctattttatgcatgcagcataaactaacttatcctgtgttgatagatattttgtacttgcccttttctgtgctgttgtttaaaattagtgtatagaaataattgtgttgatcacttaggataaattcctagaggtaaatcagatattaaattctttatagacttctggttcatattccagttgccctcaatttatacacctactactagcattgtatgagagtgcccgtttctctgaaatcttacccacactggctgtcagcgtcaaaaagatgtatctgcagatttggcaaggaatttgcatttcagtgattattatcaagcgttcacacactttccatgtttaatggtaattttttttgtttttttttgagacgatgtctcactctgttgcccaggcagagtgcagtgccgcgaccttggctcactgcaacctctgcctcccaggttcaggtgattctcctgcctcaactccttagcagcttggattacaggcatgcgccaccatgcccggctaatttgtgtatttttagtagagacggggtttcaccatattggccaggttagtctcaaactcctgacctcaagtgattgcccgccttggcctcccgaagtggtgggattacaggtgtgagccaccgcacctggcctttaatgataatgtaaattttttgtgaattgtttattcgtggctttgccccattttttccatagtggagggatttttctttttcttgttggtatgtaaagtccttgtgtgtcaagaatgctctgcctcacagtttttctaatataatgacagtggaagctcgtaactggcttccacttgactgacttgctaaattgaccggcactcttcacttccttataaaacatgcctccatagtccctgtgccccatggcacatgggatggggtagccacactaccactgtctgctgctgcatatgttcctgtccacaagagccagtcatgtttgtttccaagcctggttctttcagatatagctgttgttgtaattacttggttgatatgaaaccaatgaaatgcaagtgtgaaaagagaattgtttctaggaaaattaagatgaatgctttagaaagactcagtaaaggaagataaatttaacaaattactacagaattaggtgtaagacaacagtaaatgattggaatgaattacagaaatctagaaagcttttgacagtgggaatgcgtagtgaatggctctaagttctccctccatctgtaggaaattgaagctggaagtgagatgatacattcattatagggaggacttacagaagaaaacatcaagctctaatcacatgtccacatttcgttttgtttacttattttttgaaatggagtctcactctgttgcccaggctggagtgcagtggcatgatctcagcttactacaacctctgcctcctgtgttcaagcgattctcgtgcctcagcatcctgagtagttggggctacaggtgtgcaccaccacgcccaactaatttttatatttttagtagagacggggtttcgctatgttggccagcatggtcttaaactcctgacctcaggtgatctgcctgcctcggcctcccaaagtgctgggataacaggcatgagccaccgcacccagccccacatacctacatttcaaaggacagtctttggccctacagtcaagactaccaaaccaatgtacactaaatgggggtggggatcacgttgttgttttttgtttgtttttgtttgtttgtttgtttgtttgtttttttgagagagtctcgctctgtcacccaggctggagtatagtggcgtgatctcggctccctgcaagctccgcctcccgggttcacgccattctcctgcctcagcctcccgagtagctgggactacaggtgcccgccaccacgcccagctaatttttttgtatttttagtagagacggggcttcaccgtgttagtcaggatggtctcgatctcctgacctcggggatcacatattttaataaaattgataatccctaatagtgatggcgctaggtgtacttttagagccaatgtaaatagtcgagaaagggggccaaacatatgactaagcttcttctacactctaggagatgtcagtattgcaagatcctgttccttgaaattatctttgccccccgccattcagaaaaattaccaaatattgtaataatgtaatttaggacttaccctttcagagaaacagttcctgaaggttgacttcagttagtagtacagaagcgagacttgaagctcttcatggtttatgttctgttggtttatcccaaagagatgttttagagcacattcatttctgaaagttctcggtcatgtttccggaagtttgatcaggtgggttctttttctttttttaaaagataattttttttttaaagataattcagaatcagtcccacccctgagatggtattattacccaggaaagaatgcgtgaggatcctctaaatccatagagaaggaaaactaaaacaattttgttaccatttgtttggctcaagcatctggtagatccttcagttcttttcaaattagaattttcctctctttttcttttttttttttttttttgagatggagtcttactccatttcccaggctggagtacagtggcacaatctcggctcactgcagcctcacctcccgggttcaggcaattctccggcctcagtctcctgagtagctgggattacaggtacccgccactaattttcatatttttgcctggctaatttttgtgtttttagtagagatggggttttgccatgttggccaggctggtctcgaactcctgacctcaggtgatctgcccacctcagcctcccaaaatgctgggattacaggggtgagccaccacgccgggcctctctttttaagataataaaaattactaaacatcataatgacatgatttgggattactctttcagagaaacagttcctaaaggtttacttcagttagtgatttttatttttattatttatttattttttgagatggagtctcactctgtctgccaggctagagtgcagagacgagatctcagctcactgcaacctccgcctcccagactcaagcgattctcctacctcagcctcctgagtagctgggactagtagctggaactacaggcgcccgccaccatgcccggctagttttttctattttagtagtgacggggtttcaccgtgttgcccaggttggttttgaactcctgagctcaggctcaggcaatctgcctgcctcagcctcccaatgttctagggttacaggcatgagctactgtgcctggcccagttagtgatttttaaattgtagttccttaaatgagtattttggatttcactccacaatgttcttcaactgtaagatctacttgaggttatttgatttgctggtttgcaagaactcgtctacacgttgtctttatcacaaagaaattctggagcgtttgagccctgttcaaaaaaaaaaggcaagaagaaacttcaggaacaaataacctatttgaccctgtaatgaataatattcacacattttctaatttaagagctgttgattgatttccaacttttagaatctgtttcagacaaaacatggaagtttagtaacagttttttctattctgtaataataattgccacaaggttaaaaaaaaaaatttacagaagaacatatttgagggtggtcgtgggggcaagaaagctggaaggacgggtggggtgtgttaatagccttgtcttgtgaagtaagtcctcagagacgctgtcctagttggaagaacaggcagtgaaggtgtgcgtctgttacggagaataggactccagtgatctagctggtacttagagaggtgggggtgatcaccaaaaaaacagctctgcctctgggagcggagaggactgggatagaaagtatttgtctttcattttaagcccttctgtacgatttgacttttcttttttttttttttttttttttttgagatggagtctcactctgtcacccaggctggagtacagtggcacgatcttggctcactgcaacctccgcctcccaggttcaagcaattctcctgcctcagcctcccaagtagctgggactacaggcacctgccaccatgcccggctgatttttgtatttgtagtaaagacaggatttcactgtgttggtcaggttggtcttgaactcctgacctcatgatccacccccggcttttttttttgacacggagtttctcgttacccaggctggagtgcagtggcgcaatctctgctcactgagacctccacttcctgggttcaagcgattctcctgcctcagcctcctgagtagctgggactacaggtgtgcgtcaccatgcccggctaatttttgtatgtctaatggagacagggtttcaccatgttggtcaagttggtctcaaactcctgaactcaggtgatccacccaccttggcctcccaaagtgctgggattacgggcgtgagccaccatgcccggctaaagcaagaaattttcattgcatattttaagcaaaggcaaatgcatatgtggatagactgttttaatttgactaaagtcatattgaatccatgaattttagaagctcaaactattggggaacaataattaccaccttggagtgaaaatacttaatttccacaagatttagtaaaggaagagttttttaaaaaccaccttaatgataatagtatgtacagatgttaagaaatgaaataggaatgtgtaatgttggaaacacaaatatttttgcttctgagaataaaactaattttttctcccaattttctcttcctttttcttttttctgttcccccctttctcttccagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtaaaagggttgtgggcagctagtggtggttgcaggagatagaaatctgggaattgcggtttgacctaccaccctttgctcgttaaaggagcagctttgaaatctggactgcagggatatccaaaacaacaactgcatgtttctaagggagtcgactctccttagaggagttcttgtacaatagccctgggcaaaaacagaacttgccctattttttatactgaaaaggacagctggacaaaatactgaacgcaatttttcccctaagaaaaagcattatttccctaaaatgtcttatattaggaacagagcacttgaataaacataattgatttataaaaactgaggctatacacttacctatctgttcagtacaaacaggaagcttcaaatgtaaacgtgaattctcatacacttataaatgcatatctttatgtggacttgttaaaatgaaattggtatttaggaatttggagatttttagtagttacacaagaatcaatgaaaaagaacgaagctggtttccaaagctgatatgtctgatttggttcctttcttctcaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaaggtaggggacccttggcagggggcgctgatgggcccagggcaggggaaccagaggtcctgctgtcggattgataaattattgcaagaaagctcaaccaagaagatgtttaaagaatctttcaggtgggagtcattccattagccttatgaagaccctttattgaggatccgttctgtgatattacaagttcctgggactggtatgattctcttattgtcttgctagagttttgttgttagcaagttacttaaaataggaggaatatctgttgggttttggacacattttttacaataagattcttcctttaaaaaaaatattttataatgatagaaatcatccccaacgagaaaaattcaaataatagataacctttcttagagcgaaagaccactttactatcccctcccccacagacgcctggcacgtgggcttcttcctgcggatgaacacattcatggagaggtgtgtggacatacgtgcatacacgcatgcagttttcagtgaaaaccgggatcaaacccacagcttaccaaacccaaagtgtggtgttgtaagggaggtggcctatatgattttgtggtcttcatataaataatccttaagagtccataaagagaagggaggagttaacattgactgaggtattgctataatacctgcatctttgcattaaagaaagggaggcataaagagatcttgcccgatgtcaacctagtgagtcactgatggaataggcttggatcccacagtttattctactgcaccaggctgtagttgaggtacagtgttgataggtggtcccgatggtgtatgtttgtttgtttgtttgtttttgagatggagtcttgccctgtcacccaggctggagtacagtggtgcgatcttggctcactgcaacctctgcttcccatgctcaagtgatcctcccaccttagccttccgagtagttgggaccacaggcgcacaccaccatgcccagctgttttttgtttgtttatttgttttgagatggcattttcgctctcattgcccaagctggagtgcaatggtgcgttctcggcttactgcaacctccacctcccgggttcaagcatttctcctgcctcagccttccaggtagctgggattacaggcatgcaccaccacacccagctaattttgtatttttagtagagacagggtttcaccatgttggtcaggctggtctcaaactcctgacctcaggtgatccacctgcctcagcatcccaaagtgctgggattacaggcgtgagccaccacgcctggccgtttttgtatttccagtagagacagggtctcgccatgtcgcccaggctagtctcaaactattgagctcaagcaatctgccctcctcggcctcccaaaatgctgggattacaggcacgagccactgtgcccagcctatattttttaaatagtatgtaatgcatgcatatggttaaaaaaaatcaaaagaacaaaatgaattacagtaaaaagtaatcgtctcctaattcacttttcctgcccagaggcaagcactggtactagttccttctagagttacctggacacagatggatggtatatagatgtttatgtggatgtttatattcaaaaaggcacgcaaatgatacatgcacgcgaatgcatcatgcttctcccgtgtgataatacaccttcgagattgttttatggcaacaggtttagagctgcctcattcttaccagtgactgtgtaccgtggatggactgtcacttatttcagtagtcccctgctggttgacttttaggttgtttccaatctttagttattgtaaataatgctgatatgaggtggctttcaaaccttttcaaaaatctggttctgctgtaagaaaaactcattttacaccaccacccagccctcacaatataacaaaagtttcatgaagtcttacctacccttactgtatgtaacgcactctgatagtttgtatttcattctgttctatttcattttttaaaaattctggttgtaatccactaaatttatttcatagactgactagtggcccatggcctggtttgaaaatgcgttgcacgtgcttctttatgtgggtgtaagtgtgtgcagataagttgccagaactgactgaaggttatgtgcatcaccaggtcaccctctatagaaattgtacaaatttgttctcccacaaacaatccatgaaagggcttgtttccccttaacccacaccaacagtttattattagacatgtaaaaacacctttgtcactctgactggtaaagaatggcatctcattatgttgaatatccatgtggcatattttgggtcatctttatgccatttagtaaattcatctttttcctacatgttagaaatataccaagtgtatatgtgtatctaggcctgttgacctctctgttctcttccattggtctgtctatccgtatgccagtaccaaacttgtaattgctatggcttcataccatgttgtggtatctgataggctagtccccacttacctttttaactttttttttttttggctgtcttcacacattcacttgtaccatatgaacatacatatacttcctttttaatgttcttatttttcttcacatcccaaagtcttctggctgaaatcctattgcccatatctgatgctttccaccactgcagaattctttagtaccaacactgcagtgtgcgtgacggacaaaagagcctgttatccctgtgtgactagacgtgggcctgtcagcttgctttttgggttattgttcttatcccagaggtggagctgcgttcttccattctgagggacgtacttcaggacattgggccctttgaaagagccttcagaccacaagggtacctttctagtgaatcagaacaccagggtgcaccgcccatggggggtgattttctggagcagacagcttgcttcccatgtgtgctatttatccaaggcaagtcatgctgcaccgagatagtcacttgaggtttgcaccgaacaggataatggtttcttttccctagagctgtttaatcagcaaccttggaacagatgcaggcaggcatgatctagtgtgacagctcattagctaggggttgatctaaaatactgttcaaatgggcaaggaaaggcctgcgtatgggatatgtgatttgcagaatttgagattcatccaaagagggagaatctgcctaagatgcctctgtctaaaagctagtatgtgccaggtgggtttgtttcattccaggtagagcacagggagcttatgtgaccaggcagtgtccaccattgggcaacacatcacacttcccttggcgtcttgcctcctccctccccgtctggcacagactctcccatcagccgtttgggcacctggggacttctgagcccacagcgtcatccagcagaccgtctgcggaggttccttcctgtgagggccgcactcgagggggtgtattgggtgggatcgtatcactggaatgagtgaacatcgttagagggagctcccacagctatgcgtgtgaccgtgtggctcgccgctgaaaaatgctgctcacatagcagaacttcgatgcaatcctttttggatttctaaggggaaattttaagaccgataggaggaataggctggggttgaataagtttggttcttatttttaaattagctcatctttagaaaacaactgaatttagaagattcttctgtaaggccccaaaggatttctttctgcctccccgctcttggctcttatttgtgtctctcctcgtgttctgagcttttcagcagcccttgtgggtcatcagccgaggaccatcagctcggggcccagagctggggactgggagttatgagctggactcttgaaggggccaatactaaaccgagccgttgccatttcctaggagccttgacaggctcaaacatctctgggtacccggggatttgactgtcattgttctgatcctttcccaaagttgtaaccctctgttgacatagcggaattgaagattgatttttcttcaccaccttctgcctaaagttcttagttctgaatgtgtccacacctcattgacttctatgagatgcccctgtcacgttcctcgattccttctagtccttaatagagtctttccttttcttgaaagaaatttgcccagttgacatttattttcatcgtctgctgaagtgacagatccaaggccctaagcttcagcagagttgcaggaagggaccatttacacagcctcttagatgtttaaggtttacccgccctgacagtggctcagcaggcgtaggcctcctggtgaaaagccgagcacatggctaacctgctctggtggaggggctttggaccgttcttgtgtactgcgaggcttgccttcctgctggtgtgtgagcagctctcgggggaacttgcttcctggctgagcaacctgtaaacagtatgtctgaggtgggactcccgggcccaaagcagccaaaggttgcacaagtctaagctccgttaggcctgtcagtgtggctgtcaaaagaaacgctgtttcttttctttctttcctttttttttttttttttttttttttttttgagacaggctgtcacccaggctggagtacagtggcacaatctcggctcattgcaacctgcgcctcccgggttcgagcgattctcctgcatcagcctctcaagtagctgagactacaggtgcccaccagcatgcccggctaatttttgtatttttagtagagatggggtttcaccatgttggccaggctggtttcgaacgcctgacctcgtgatctgccctccttggcctcccaaagtgctgggattacaggcgtgagccactgctcctggcaaaatgctgtttctaagcgtttctttgacaagtcccatccttcaggttcatgcatgattagggagaggcagcagccctgactgagcacctgagtgttcatggaaccaggtgcatagcgtaatgacatgccattcatgacactactttcttccctgaacatgccatgaattcctgatgattacacagttccccaacaagtgctgctcaaaacctggaactaatcagaaggaagcaccagccttgactgttagtgggacacggggaagatggctgtgaaccgaatatgcggtgcctttgggggagaatggttttagtatttagtaagtgtcagtatgtaagttttatgttgaaaaatgaactaagtcacaacaaggtctataaatttaattattgaaaaggataaagttgggccattcagtgaaacctcctgtaactgaagtctctaacacagtagccaatgggggaatcaaatgagcccaagaagaaattctgcgtaaactaggacttaggggagcccttagcattccactttggagtgaaggaacccgatccgccagttggggaacgctcctttgaggcccatgtgcttcctgctccgacgggagagagggataatgagacttgctcccaggtgccctgccctggagcccagcaggccacacgggctctttgactctgtactgtgccagtgatttccaagatgggagtggtgctctgattgcaggaatgtcttcttggaatggcttttctcacttctctagagtccttggtagggagcacatcatcagctgagctaacgtgagaacaggggttggagcacttgccaccggcagtgaagtaatcggacagctgacagtcttttccagagggtcggggattgggagctgaccccaggtcccgctccgttttctttgtgtgcagcacttgtgttggtgaccagcagtgaagagagtgcgtggacgtcaccgtgtggttatgaagctaacggcagccctcagcggtgccgacttccgctccccgacacattcctgtgtgcacgttcgtgggtctgagcgtgactcatggtgtgtgtccctagagcagttcactcagaggcttctcttccgtgctctcaagaataaaagcagggccgccacatcctgataagtcttgccattcagcggtcctgtcttgcagagggataagccagtgtccccaggccacagtccttacaccttgagcaagttccccagagtgaagcaatctttctagacaagttttgcgtttctcagaattttattttagtgatattgttaccaaaagattgtaaccccaaaatgtgtgcctttggcttgcctgttttaggaattcacttgtgttatctccccaagcaaaacaaaagaaagagaaaccttcctgttgacgaatcctttttaccttcttgagagttgtcaatgggactaacttgtatatttctttgctaccttcttttaaaaacatttttcttatttactattacagacgtatagtaatggtgcctgacataacccacagccaaaggccttggccttgctgtgtgtatttcaggctttttcttcccttttctttttttttaagtaataagatattacagttatagctgaagcctgatcctgttcccttttctccctctcgtcccaagcatcaccactgtcccaaatctgctccttcttcccacatctttgcagtttgggcaagtcttctgaatgcctagtcatgattttaagtcttctttccaccttcagtgatggttggctaccctgagcaagccagtagattcagttatgtgcctggagtccagatgttttatgtggatttttcatgtggaattgtttttggtaaggaagtattcccttgccacaccaatgaaaagagaagaaaacaggtagctggcacccactgcattgttgctttctgccagcctgctccttctccttcctctccagctctgttgtgtccagatgcaaactctacatgcagggtttgaccctaggtcctcacctgctgtagctctcacacggggaccgaatgctcttgtgtcgtaaatccttccttttgcttcctcgtgttggatgtgtttagtggttttcatcttctggtcactatttcattctaggtttatcccctttaaattataaattaaatgaattcttcgcttttcctaccagcaactacccaccaagttctaccatgtgttaatttaatcaacagttatttattgagtacttattacatgttgatttcctgttctcaacattggaatgaagacagcttagggttctgctttcatgaagcttgcatgctcttaggtggagacagacagtaattaagcagataaacaggaaattatgagctagtagtgggtccattgctgagaagtaagacaggtggtaggatgacccgtgccgtgtgatgactttagattgggtggttggggaagacttcacggaccttaaaactggccttggaacgggaagcgagaactgggcacggaagatgagggagtgggagatttcaggcagagggagcagcagcaggtacagaggccctgaggccttttattgtgtctttttgcttgagcgagtaacttagagcacacgtagagaaagacagcagaagtgatcttctaaacactctgtcctgtgtggagagctccttatgtgagattttgctgtgtagtgaattaaggctcagccaaactggctcacgtgagctctttgagcttgcctgtctctgtgggctgaaggctgttccctgtttccttcagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggtaggctgggactgccgggggtgcccagggtacgtggggcaaggcgtctgctggcattaggcgatgcatctgcctggaagtctacctcctgcctgctgtccgagggcttcattggcgccacggaattgacttttccgtcttatatcattcctgtgtctttgtaggagtggaatcattctcatagtccgagtgtgtttccacatatggtgagagctgacaagcatggaggggttttggtgtaaaaagattagtcatttggagaggttttctcattttatggcaaggttcttttaaagccgtggatttccatgctgttcgtgcggcatggagatcacttcctaccgagagttaaggaggaaaaaaagatctctgagttttgaaagaagatttaaccaaaatgcatttgactcttctgtggatttttgttggctgatttggaaggcaggtgccctgggcatccccagtgggttccaattctgcagctgcccagactcctgcaggcagaggtggaagtgtccccgctagaaaggcatccaggaaactcgcttttgaccaactcagatacagtctggtctttcttgttaactgggactttaccctctccactaatgaatagtgtttgtagtttccaggcaggtttttttcttcttttgaagttctttgaaacccttaggacgccaagggaaggaagttttcattttcagccctttgcattcttcaaaatgtgatccaggcttttccctgtggcgagggtgtcccctagtgttgacttacattatttccacttgttttaaatgaactttgattaccttgacctgtgcacagaaatcaagagaggcagcccctttttagagctgttagaaaagaactgaaacatccacctctgggaaaaatagagtttagtttgtgcatgtgtctcagaagtcaggtgcacacattgagactggtgcagccacatgcctgccttttagggactccttgactgacctgatgccttcacccaaaggcatagtgaaatgggaagtatgatttctgactggtatgaagtggctgctttagagaaaagatcacattctttagtcctagaaaccaaaggtggcttcctgatgctcttattcagcacgtgcctgtctttgaggcaggactggcactggggtgggggcatggtttggggttaccttaaggaccctggatatttctcagataggactttttcttttctttttttgagacggagtcttactctgttgcctaggctggagtgcagtggcatgatctcagctcactgcaacctccgcctccccaaattggcgattctccttcctcagcctcacgagtagctgggattacaggcacccgccaccacacccagctaatttttgtatttttagtagagatggggtttcgctgtgttggcctggctggtctcaaactcctgacctcaagtgatctgcctacctcagcctcccagagtgctgggattataggcatgagccaccacacccggccctggactttttcttaattgaataaatatttatcaagttcttcacttctatttgacggttcctgggctcaacactggattagaaaatgaatgggacagagttcttcatctgagacatagggtggtccaggtagtaggaggaagaaggattgcagcgcagcagtcctcgggacaccaccagggggtgaacgaaggagggacgggggagctgtgcaggtgccccagctccttgggttgcacagggttgaagaccagacccaagaaatggggccttgaccagctcagcaaactgagaatggcctagatttcagcacactttcaccaggatttgtcaaatgaaggaagattccaagcgcaaaataccctagatttcaaccagtaaaagcttgtctgaaaacttccaagatcgggttgtacaacttgacatttgaggaaacgctacttcagtagatggtgctgtggcattgttttctgaacaactgaaggaggagactccagagaagggtacctgctggagacctgtgtggtttgtggggtgggtttcttatatcactgaatctaaagtgggtgcctttcagaatgtgctttactaataatgtgttactctgcttttaattatacttctaataatttttcccaagagcctaattaacttacgatctcacagttggtaaagaattacaggatgtcattgcgtggatttctgtgggcagtcacccggagtggtatctaattagggaaaaggcagtatgtccctttctggaagtgtgttaactgaaaatacggtactaagcaactgctaaataaattagccctccttcctcctggccgtgcgcagaaacatccctgcagtatgttgcctatttgtcaaataagattagtgtaaatatggggcatttacctttgctatagaagctgaaattgccaggcacggtggcttacgcctgtaatcccagcactttggaaggccaaggctggtggattgcttgagcccaggagttaaagaccagcctgggcaacatggcaaaactctgcctctacaaaaaataccaaaaatcagccaggcgtggtggtgcgtgtgtattcctagctacttgggaggctgacatgggaggattacctgagcccgggaggttgaggctgcagtgagccgtaatcgtgccactgcactcctacctggggagcagagtgagaccctgtctccaaaaaaaaaaaaaaaaaaaaaagctgaaatccttgagtggattctaaatcatggcagtggctaacattcagcttcatcgtgcccttgctgtgtgcctggcagagacctctgtgcttactacatgtcgcatctcattgaatcctcacaaccttaagatccttccaggttgagcatcccggaccctaaaatcccaaatcctaaatgctcccaaatccaaaactttttgagcaccggcatgcagctcagaggaaatgcatactggaacatttcagattttggattttctaatttggagtgctcatctggtaatatagtgtggatattccccaatctgcaaagatctgagctccgaaacacttgtagccccaagcctttcagttaagggacattcaccctgtatcaacattttaatgctgagaaaatggaagagagagaggttaagtgactgacctggcatcacacagccaggagtggcagcatcaggatttgaactggggcactcagctccaaagctcagctcttcttttttaaaattgaacccagattcttatttctcaaataccataaaatatttacataagccacagttatgccttttaaaaaaaaatcaccttttccccccactctcccatttacttcctttgcagtttgtggctacgatctaccttcctcttcaaaacccttgaaaaatccttgcagccttgcccaagcgtccttccctcagccgatttttgggcctcagtttcctcccatccagcctgtttcctatcgctggcttctccaagggcagagccagagtcctcttttgccagcagggggagcaagggcctacttttaaccgcaactccatagtgaacaagtcaagcaaccttgggtcattcatataccttccaggcagaaggaagacagaagagaacaggaaaaaagcaggacactaggctgacccctgcagatgggaagctggaattacagcaaaggctcattgattgggaactgcacccttgaattttgatagtattgggcaggacatagtcttgctatctgtgttaaagggaggacgtgcttaagaaaaccaacagtcaagtacaagaagctctaattttttttgaggtgggggaacggggtctcactgtgttgcccagctggcctcaaactcctggctcaagcagtcctcccacctcagcctcctgagtagcagggatcacaggcttgtgccactgtgcccagctaagaggctgcaattttttaatgaactgtattcagagtttgtacatcagtgtcttttttttctatgaatcagttctctaagtaatagaatttggaaaagaccgctggtgatctagctgtggcatttagattgactcatgagctaactgacaaatttactacttaaacagtggaaaataatgtgcaggatatatttttttgaataggttgtcccaccctcgagttctgtgtctttcctgagtccgcatatgtgaaccttgttttaaccaggtgacagcatcccataggcacggatctctgtcttctgttgtccacatcatgtgtcttggcagttgttccttattgatatacataaggttgtcttgtttttgtatggatatattttaacatgtaccagtgttcagtgggcctttctcttatttccaatattttgctgttctaaacagcagcacagtgattcccctcatttgcatgtatgtgaaactatcctggtgggtccgcttccagaaactactggatcagggaccatgtgcatttatggccttgaccatactgccagagtaccttccaaggagtttgtgtcatcaatttgcactccccagtggtgttgagagagtgcctgtttcctccacccagcacagtgtgtttcggttttatttctcccaggaaatgggtgttagttggggagctccagaaagaagccgagaagaagggcagtcgtacccttggcagttgtacgcagtggctctctggccgcacaaggagggctcggagcctgctgttgccaggttgcacttgctcttgcaagacaggcattccttgcagtgggttctcctctggccagggagatgagttctgggggctcctctacgaggtggtctctcctgggctttcctctcgagcttcaagtcccacctctggagtgtgaatcgccttcctcagtctaactctatccctccagtggtttttttttttttgctttttgtttttgtttttgtttttttgagacagagtctcactctgtcacccaggctggagtacagtggcgtgatctcggctcaccgcaagctccacctcccgggttcaagcaattctcctgcctcagcctcccgagtagctgggactacaggtgcctgcgaccacgccggctaattttttgtatttttagtagagacagggtttcaccatgttagccaggatggtctcgatctcctgacttcatgatctgccctcctcggcctcccaaagtgctgggattacaggcgtgagccaccacacccagcagtctcttcagtgtatttagctgtgttgatcctgattcatctgatgggtgaaggaatattggaaataaggataatccctgtggtgtttcactgtgcctgtaacctctctcacctagcatttggttaaccagaaacagatgtggaaactgatctatctgtagataatggccctgctcagggagggggtccctgctgagagcgagacattgaaagcctgctacacagaaactgctggaaggccaagccatttcttttttctttttctttttttttttttttttttttcagacagagttttgcccagtagttcaggctggagtgcagtggcatgatctcagttcactgcaacggcctcccaggttcaagcaattcttctgcctcagcctcctgagtagctggcattacagactcctgccaccacgcccggctaatttttgcatttttagtagagacacggtttcaccatgtggccaggctggtctcgaactcctggcctcaagttatctgcctgtctcggccccccagagaggccaagccatttttaaaaacagtgttctttttcatgctgtagaatacctgtgcttgggggtgagcaaaaaggaggaaactgattagaaaatacctatgagggccgggtgcagtggttcatgcctgtaatcccagcactctgggaggccgaggagggcagatcacaaggtcaggagatcaagaccatcctggttgacatggtgaaaccccgtctctactaataatacagaaaattagctgggcgtggtggcaggtgcctgtagtcccagctactcgggaggctgaggcaggagaatggtgtgaacctgggaggcggagcttgcagtgagccgagatcgcgccactgcactctagcctgggcgacagagcaagactccgtctcaaaaaaaaaagaaaatacctgtgagatgttgagtctgggagaatgtatctgtgagaagacaaacaaccctagtattcattaaagaaccagcctttgttttctacaagctatctgttcagtctactcaggaatagagataaactgccttaatagtaataaaagcaagcaccgctgagtgagtgctggcctcatgccaggaactgctcttggcactctgtgcacaagggagatactgacattctttctgttgtgcagatgagaaaacaggctcagagaaggtgagtaacttaccatggtcacacagcagcagagctaggtcagtataatccacaagtcattctcttaaccgctccgccataccgcccagaatgttcatctgcatctgggccagcctcgtcagtccgtgcaaagaggccagttgacccatctccctccctaacaagcacagaagagaccaggctgaaaattcatagctttcactcaaagtgtttccttcacctcattcatctgagttagctttattttactatataaagagaattttcttcagcaaaatgataggaatttttttaatgaaagtaaaggaatgtcacagaattgcgtcagggatatttccagtttaacacaactacaaacgtaggctgttttgttgttgttgttttggttttctattttgagatgaagtctcactctgtcgcccaggctgaagtgcagtggtgcgatcttggctcactgcaacctcctgctcccgaattcaagtgattctcctgcctcagcctcctgagtagctggaactacaggcatgcgctaccacgcctggctaatttttgtatttttagtagagatggggtttcaccatgttgaccaggttgttccggaactcaggtgatccaccttggcctcccaaagtgttgggattacaggcatgagccaccacactcggccagctgttgttaatagttaaaattataaattggacaaggtctgattccagcagggggagacaaattcacattgatttttctataagaaaaggaattatttgtactttcctcccttgtgtgtttgtgtgtatgtaagagagacagatgagaagagggctgcctttgagagccatgttccttttgcatgtacatacctctcaagattattacatgggtcttttagaagagggtcagtagctataaaagcaaatgatatttatgaaatgatttcattgtatgtggtttattatgtagtcttcaaaacagaaaaaccccacttgcttcgaaagcttcctttgagagctactttttaaccatattgttgatcaagcaagattcttaaagccccagtcctatacgtgagcagcattgaatccccggatactggcaggcgttcactgtccagcctttgacattagcatgtcaccctggtaaatcagagcactccatgccaaaaaacagcatggtctgctgagcacattaaggagcagagagggctcagaagaattaaacggccaatggggtggtgacagaggtgagctctttccccctcggacagcttggcatggtgactaccaatgaggtttaattgacattaagagcagctcaccatttttaaagagcgataaattgtttccaagtttcagcctcacggagccctgagctaagagataatgggctgacacatagcctcattggtcacgcttcacttgtaaacaggattggccaaagcaagaaggctgtaagtaaaggttggcccgtcctctggaagcctcccccacagcagggtggggaactggggcagccatagcaagcaggaccatcaggacacggtgtctcccaaacgggccggaacatacaaggttctacgtttaatagaaagttgatcaagccttcctctttggggagcctaatttttaagccattcactctctgttcccctgcagtcttttctctccaaactctgttgaaacttggaggcatctcgcttcctcctttggcctttgtagccaggttttcgcagcaaacagaccatatcatttaacacccacctgcttcttgttctgatagtcagttcagtagacagtagcattttttaagtcaaaaagaggcttagtgatgtaggccaaggtcaaggctctgtgtcatggggctctccccagggctcagtgccacggcacttcagacttgaccccagactgaaaagatgagaggacctgtagaagtcacggcctgtctgtcccgggcccatgctcctatctttttctcccccttggcatttagataccatggacttgttaaaatgtgacatgtactgatgatccttatgaatttgttggtaggggagctgctggtgaggattattttagactgtgagtaattgacctgacagacagtgatgactgcttcattaagagcccacgaccacgtgccagaatagttcagcatcctctgttgctactgtactttgagacatcgttcttctttgtgatgcaatacctctttcttgtcatgagggtctcttcccttaaatcaggtacatttcagattcttcaggtgatgttttttaggctgagtgtgttagcaccccttggaaaccaggttccctggggaaagtgtgtcacgtttgtggtgtttgcccgtatagctctcccacacccccacgagctccaagaggtggggaagcacatgtggcctgcctagcaggcaccagaagcaggttgtcggcacatgcaagccagctttgccctgttgcctgggggagaattgaaaagtttggccccaaaggggaaaattctttctgccatcaagttgctggtcagctgtcatggaacctgtctgcagcaatgtggctgtcacaaaacgcagcccaggacgagtatgcgctgaagctccattttgcattaactagtcaagtacttacccactgaaaagcacttcctgaaataatttcaccttcgtttttttccttctgcaggaggacaccatggaggtggaagagttcttgaaagaagctgcagtcatgaaagagatcaaacaccctaacctggtgcagctccttggtgagtaagcccggggctctgaagagagggtctcgcgccgcacccccagggtgacacaggcgctggggaagacgcacgggcggctcactgcacaaaacctcgttggaatatttgtgctctgccgacgttcagccgcgggtaaaatgaggcctgtatgggatgggtgtgtgcgtgtgtgcacatatgcacatgtatgtatgagagggagaatgtgattattttaagtggatacctaaaagcagtcaaatgcaaatctgaaattagtttctgaaacttgggcattttccagagttttctcactgaagtgattctgtaagtagacacataaccatcagacctaaccattcaggggtaaactgacggtggtgaaggtcatttgaggtggggccaggtctgcgtctgaattctgtggcagcctctccctgcgtaaattcaagttcactggcttgagaagaagaaaagagcctggccatgtccctcccacacgagcacagtctcaggatgcaggtgcttgggaccatgttggaagttgggcccaggactgaggagcagagtcagaatccttcagaaggctttttctttagacagttgtttgttcagttgggagcggagccacgtgttgaagtcctcgttgtcttgttggcaggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacaggtaggggcctggccaggcagcctgcgccatggagtcacagggcgtggagccgggcagccttttacaaaaagccccagcctaggaggtctcagggcgcagcttctaacctcagtgctggcaacacattggaccttggaacaaaggcaaacactaggctcctggcaaagccagctttgggcatgcatccagggctaaattcagccaggcctagactctggaccagtggagcagctaatccccggagtaaggaatatttcatttttgaaccattttgggctaagtggaatattaaatgaagttcataaaaggcgtccttcctaataatcacagtcccctctgaaagagagtactcattgttcctccggggccagcgcccagcagtaatggcctcttcctgggagccgctggcattgcttttacgcaaactcatgggaacaaccagtacatggcttttgttttttagtgtgtgtgtctttttttcctgctttctctttattatcttttcattctccacttaacttgctgtcctctgattcagggatgtttccacaattgtcagaattgtgtatgtggaggtctaaattaagtgtctttgctgttttaaaccctgaagtgttttgaccttcaaatgtgccacaattatcttggtcttcaaattctttgctggtggaaatggcttcccagcaaagcgacggcctgtgcaggacagagcctgatgggctttgctggcgtcttttatacgagatgttctccacaccaccactgtgacctttcctacccaattagctcaagtatgaaacctctacatgagatttcatagcaaggaataagggtagcatgtgtgaaatgctggcggctccttgtaagacagattttctatgctccatgagagcctgatccagatactcctggctttcaggaaagtgaatcctctgatgctgcaaattgagattgcttgacttctggtttgcctggcacggccgggtccgttccttcttcattcaagcgaacttaaaatgctttatcaaaatcctcttaggcacaactcttctgtatttaatttcactcttgttgctgacgatcaggctatctcacgcagccatcacctcaagctgctgccccctctcattccgctcttcccgtttgccttgtgatttcatggttaatgttcatgaaccaaagattagactcctacctccctgggagaatcaggaagtgagaggaagcagattatacaggagagagttttttaggatacatttgggtacacctcaggaagaaagagggaagtaggaaacacagtttgggtaaagaatgccatgggctttgttttattttgtcccatcaagtctgaataggacaagtggagatgcactctgatagaagtttcttgcaatcaaggactgggctcagtgtttgtctccgtgcctggcatagagtagcaataactgcacttactattctcgacacttcaatcaaagcacttagcatattaattaattacactcacagcaaccctaagaggtaggtgccattattatcgtcttcattttacggatgaggtaactgagtcccagggtaattaacttgctccaggtcatgaggccagggagcccgctcccagcaccagcctctccccatgttgggatctcagggtgtgtttgctgagaggctggcactgtgttaattgccgtgggcattaatacaaacttccagggcattggactcaatctttccattgtcagcattgcacctttgctcagcagtggtggatttgtgaagtggaaggttggccaggagctctcatgggtgaacattttcctttcttagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctggggtaagggctgctgctgcactgaagtggtccttcctgactacaggagggtttttttctgcctctttcttgctcttccctttcttttcttcctttctttttgtttttttgagacggagtctcactctgtcacccaggctggagtgcagtggtgcaatcttggctcattgcagcctctccctcccgggttcaagcgattctcctgtctcagcatcttgagtagctgggattataggcacccgccaccacacccagctaatttttggtatttttagtagagatggggtttcaccatgttggccaggctggtctagaactcctgacctcaggtgatctgcctgccttggcctcccaaagtgctgggattacaggtgtgagccactgtgcacagccacccttttttttttttttttaactgtgtatttggcctgaggtccaaatatggtgcacagtgtatctgctgatctgttaagtctcctctataagccccctctccatgtctttatttcccttgctgtttattgaagaaaccatccttagagtttcgtacgttctgggttttgctcattgtctcccatggtgtgatttaatatgttcctctgacttcagtattcctagtaatgggtggctggatctggaacggcctcatcacattcaggtttgactgtttctcttttagtaagagtggatcaggggagatggtgtgcccttccatcagtagatacaaaatgcttcatttatttccttccttcctttcctcccctctccctcccctcctctcttctccttctccttccgacggagtttcgctcttgttgcccaggctggagtgcagtggcacgatcttggctcactgcaacctctgccttctggtttcaagcgattctcctgcctcagcctcctgagtagctgggattataggcgcatgccaccacccccggctaatttttgtatttttagtagagacggggttttaccatgttggccaggatggtctccaactcctgacttcgtgatccacccacctcggcctcccaaagtgctgggattacaggcgtgagccaccacgcctggccccaaaatgcttgatttgctatcgtttttttgtgggggtttttttttgagtaatttttggcagttactgatatacagtgcctagatccaatagtttgctaggtattgccaggtaggaattctctaattctgtcattcctgttaagttactagtggaaacttgtatgaggagaaacagttcctcatctgtgtggttactcagtggtacagttcatgtaggaagagcagggtcaattcttgcttctttgtttttatttaccagtttttaaaataacaaattactttttctttttttttttttttttggagccagagtcttgctttttctggggtacaaagtacaggctggagttcagtagcatgatctcggctcactgcaacctccgcctaccagattcaagcaattcttctgcctcagcctcccaagtagctgggattacaggtgcctgccaccacgcctggctaaatttttttgtatttttagtaaagatggggtttcaccatgttgcccaggctggccttgaacttctgagctcaggcagtccacctgccttggcctcccaaagtgctgggattacaggcgtgagccaccatgccctgccacaagttggtttctttttttttttttttttttttttgagacagtctcactctgtcgcccaggctggagtgcagtggcatgatctcagctcactgcaagctccgccttccgggttcacgtcattctcctgcctcagcctcccgagtagctgagactataggcgcccgccgccacactcggccaattttttttctatttttgtagagacggggtttcactgcgttagccaggatggtctcgatctccggacttcgtgatccgcccaccttggcctcccaaagtgcacaagttagtttcttaatacccttcagtggtggccaattaggtttttgctgtcattggtggtattatgaactctcagatttatatatatctgatgtgtttcagtccactgcggttattttccctgttgatattcagattgtctcgtctttggccagtgggaacttcacattagctcctagtcattttgacattaactttgtagttttccatgacgtccgcgccctcaaatgacaagctattgcaggttcattctgtgccccaggcctgaatcacccatttctctaaggaatcttatcctttaatgggaaatggaattttaaggcaataatctcagatttcaaaactttcaaagatttcataagatttttatgaaatgtttagagttagaaggggctttggagatagtcttgtgcacccagaaagcagtggtggccggttaggcacagagctggttggtcacagagctaagagttaacatggccagctgacttccggcgccaggttccttctaccacatatcccagcaagatggtcacattacctaaaagaccccacagggtctgaaactcatcatctgccctcctctagcatgtttgtggggtaagtttactgagtcttgttctgtcctggtctcctttttttttttttatttttgagacggggtcttgctctgtcgcccaggctggcgtgcagtggagcaatatcagctcactacaacctccgtctcctgggttcaagcaattctcctgcctcagcctccaaagtagccaggactactggcgtacaccaccacacctggctaaattttttttttttttttgagatggagtctcgctctgtcacccagcctggagtgcagtggcgcgatcttgatcttggctcactgcaagctccacctcctgggttcacaccattctcctgcctcagcctcccgagtagctgggactataggcatccaccaccacgcccggctaatttttttgtatttttagtagagacagggtttcaccatgttagccaggatggtctcaatctcctgacctcgtgatccgcccgcctcggcctcccaaagtgctgggattacaggtgtgagccaccgtgcccggcccctaatttttgtatttttagtagagatggggtttcgccatgttggccagggtggtcttgaattcctgacctcaaataatcctcccacttcagcctcccaaagtgctgggattacaggcgtgagccaccgcacccagccttgtcctggtcttctgatgataaagagcctggtaaaatgtcagagcctgggctgctgctggggccatcccttctgaggtctgctgcaaaggtaactgattttaaatgtagtgtagtgaaatgctacacatcttgaacagcctttctctttcggttttctttcagcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgtaagccttcctcagcctgttctcacgagtatatgtgggcattccaggaaattcaactgtgcaggagtgtgtacacaaagttgaaagtttttccatgagctctctccattccagttcttcagatgcagctaatgtagccatttgatacctattgacctttatttacagataaatagtatgtgcgtgacttgtcttttaaagcaaaaatggtattgatagataccaaacctgggtgtattcctaaatacagattcctgggccctgccttcacagacattctgctatagtagctaagctcatgaggtgattttttttttttttttttttgagacggagtttcgctcttgtcgcccaggctggagtacaatggcgcaatgttggctcacttcaacctccacctccctggttcaagcgattctcctgcctcagcctcccaagtagctgggattacaggcatgcaccaccacgcccggctaattttgtatttttagtagagatggggtttctccatgttagtcaggctggtctccaactcccaacctcaggtgatctgcctgcctcggcctcccaaagtgctgcgattacaggcgtgagccaccacgcccagctgcgaggtgatttttatctggtcgttttatactgattacatatgtgttatctgtactatgcacacacaggatgttttcatatatcttataaggtatttatatggccatttcttacactgttttcccacacatgtctttccacgtccatatattcagatctctccctctccctacctcttatttatgtatagctgcccagtactccatttcactcattcatccggtcctcttttgatgtgcatttggttgttttacacatttgtttggtttttgcccttataaacaaagcagaaacaaatattcatgtacacgaatctctgggcactttggctggtatttctaaaagttgaactgttggttccaagaactgtgtgggttttaaattttgatacattttaccaaactgttaaaaaaggttgtgccattgtatgctccagtcagacgcatatgggagtgactgttcctggtccccagtactaggctttgtcagtctgtttagtcctcatgttagtctcattttcatgagaatttctttacttcagactttgataaccgtgaagaaagaacaagatagaaggtgagctgtttggcttagtaattttctacacctactagagcgggactgggaaaaatatatttgtaaatgcagttcttgctgtcactgtctctctggggttttacaatccatattcctgccagcatctaacgtcttttcaaattcttaatgtctataacaggacatgatgacattcatcgttttgacttgttgcagcaaaagatggttagcaggattggaatgttgctttcattctagacttttccttgagaactgctagccccgtattgctagccagatctcatggatgatctgacttgggtttcatctgtccaggttggcagtggaatccctctgaccggccctcctttgctgaaatccaccaagcctttgaaacaatgttccaggaatccagtatctcagacggtaaagtacccatcccggggtacctgcagtggggtgaaagggcagccatgtgggactgcagcctgggtcattcggttcacttcctggtgaaagttcacagaccagcctgtcctgagaccagaaagctgggcagaggtgtggagtattgtgctttcttgtctgctgcagccctgcagagttctaagaaatgctaagggctgtttctccggtatccacgtgccttttctttagttgtatgcagatgagcactgttaccttacaaagaaagagaaccaccacaccaagccaacaccagtactgatggctgctggatttttgtttctgtccctgtatgattcttagaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcggtaagtcccccgcttcccccaaccccactgctcttcccttccctgccagaggctacattcaggccatcataggccaacgggaagctgtgaatggagcccgcacagaagggcagccatggcctttgtcaatggttcagcttcggaaggaggaaggttctcctctccccacctgcctcctatcccctccctctgagagtccccgaggagcataggctccagcagtgagttcagtcctgtaggcagaggtgcttctgaagcccgccaaggagctagcccatctcccacctattacccgcggcatctgtggttgctgtctcagagcagattcaacaatagtaagcaccaggctgcgtgacaagcagctcacggtgaaggcactgatgtgagaagctcgctgcagccaggtggaaccaggacacgcacatggacagaacccgtgtcctggtggtctctgggaagagcatctttctggtgccattgcctaggcgagcaagggagttgggatcagctcaggagggggtctcaagacactagcaaaaataataatggccaacatttatgtagtgtgcctactacaggccaggctctgttctatgttcatggttgacccccagaaccagcagtccaggttctgctgcagaccagctgaacaaaagcattgaggggtgtattagtctgttttcatgctgctaataaaggtatacccaagactgggtaatttataaaggaaagaggtttcaccgactcacagttccacatggctggggaggcctcacaatcatggctgaaggtgaatgaggagcaaggtcacatcttacttggcggcaggcaagagagcttgtgcaggggaagtccgctttataaaaccatcagatctcgtgagacttattcactaccacgagaatgtgggagaaacctccccatgattcattgatctccacctgaccccaccgttgacacgtggggcttattacaattcaaggtgagatttgggtggggactcagccaacccatattggaggtggggggtaggccaagcatctgggttcacagaggatcctggggatggcaatggtggactccattctaatggactgcagactgggtacatgtgaagggactggacaaagccctacttcttgaagatttatggtgggatgtttactgacagcagaatctataaacctgagttttatcacgtactctcattagtaaaaaaaaaacaaaaaaaaacagaacatgcagcccatatatatggtatataaagtacgtatgtccactactgtaggagtagagtgcgtatgttatgtaccaaaacgcacatttaaaaggcttgcatgctaaataagtccaaatttgcaatacttcccgccccgctgggccatctcactcacctacttggaggttatggcgtatagactctccagaatcttccacccttcctcctcttatcggttttcctgatttcaggtggctgagcagtagggaggagaggcctctgggaacgctgtgcttattaagaacccagtgatcagcagtcatgttcatttacgcccgtcagtttcatctgaggggtattttgatagtgatctcttggtgagccgagggtgtcaattaactgctcagtgctgaaactgagtggtgcataattcattgcaatttcactctcctggcctccttccactagattaaagttttgggagggctttggtgttccctgattcagatgtcccgcgtgctgccttgggttctgataaatgcatactggtacctctgttgagttacaggtgccaacagaaaacctcttcttgcaagctgacctctgagggagaattctgttactcactagcaggagcttggcaacaccaaaaagatttccttttttttttgagatggagtctcactctgttgccaggctggagtgcaatggcatgataccagctcactgcaacctccacctcctgggttcaagcgattctcctgcctcatcctcctgagtagctgggactacaggcgtgtgccaccacacccagctaatttttgcattttttagtagagacggggtttcatcatgttggccaggatggtctctatctcttgacctcatgatccgcccacctcagcctcccaaagtgctgggatgacaggcttgagccaccgcgcctggctaccagaaagatttcttatgagctatgattcatatttaaagagtgcccattaaaaaactgttggccgggcgtggtggctcacacctgtaatcccagcactttaggaggccgaggtcagcgaatcacaaggtcaggctcccgtggcacaagctgggggctgcccccaccccatgctccccagaggagcacccaagcgtctgggctcagacaggcctggatctgataaccggctctgatgccaccatccctgaggccaggcaagtcccagccgggctacagcactgttgtgagaatgcagatgaggttgtaaaggtgaagcacgtgtcacgcttctctcaataaagccatcattgctgttaggattgtcattaggaaaggctttgggccgggtgcagtggctcatgcctgtaatcccagcactttgggaggccaaggcgggtggatcacctgaggtcaggagtttgagaccagcctaaccaacatggtgaaaccccgtctctactaaaaatacaaaattagccaggcgtggtagcgggtgcctatagtcctagctacttgggaggctgaggcaagagaaccatttgaacctgggaggcggaggttgcagtgagctgagatcgtgccactgcactccagcgtaggcaacaagcgagactccaactcaaaaaaaaaaaaaaaccacacacacgctttggtctctttccctgaagatgggaacaaaaagctggacggccctggcctcttcatccctgcactggtttacttgaaggcagcagccccccacccacccacatcactctctagtgagtataaaaacgatgacaaggccaagcaaagggtcaaaacctgtggctctcctgccagccagctagccgagaggcctatgaggagctctgggaataaggggctgtgtcccacagtggggaagggacaatgggccattatgcacaggagataagaagggatgacctttgacaatttttttgtttgtttgtttgtttgttttgagatggagtctcactctgtctcctgggctggagtgcagcagtggcactctgcctcccgggttcaagcgattctcctctgtcagcctctagagttgtctggagttgtcagctcttccccttgcgtttcagatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaaggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaatgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaattcttggcagattgcttcggcctgtgatcctgccctgttgttctgagcctgtgcggtggcggggccgggatgtagtgggttctggtttcccgacggggctggggcccggcatcaggtcttacagagcagaacggtggcaggttgcccccagctgcccagggcctctgcggcctgggtgcccacagccatctttcaggcacttgccctgctatgctcggaccctttctgtacccttggcgcttacctgctggcagcctggccccaccggcatcactgggagtgggctgtgccaccatacaagccacatctgactggcggtatcaggctgtcgcagcgacgtggaagtggggtgaggaggtcacgtcccgtgcttcttgctggctgagggcaaatccctccccacgtgcgcctgttctctctccacctttccgccctaagcccccaggtgcccttactcactcatgttccttgagccaggtgtcttaggtctttgtgtggatgaggaggagcggaggtgtgaggtgtgctgggccttcagggcctgggaaggccatcccagactgagccccaccgccctttcccagctcagtccccaccgagctgacagcttggaaaggggcggttgggaagtgagtagcaccctctgataatgatactgatcaggccagcaggtttgtcaggggtgcacatcctgctcagcagagcatatgaagatcacagcttggtgaagctccactcgagagacctggagcgagactgctgtgcggtgggtgacaggtggaactccagccgggccggggctggtggagcccactgcgagcagtgccaggcacaagattctccccctctcatttcacagggacaaaaccaggctggggcccccaatttccttgccggttgaaccatagctggccaccagatccaccaagcctggggcttctcttgtcctttgaatggctgcttctcccaggtctgaacgaagacataggacaactctggtgacagccacagctggtggccgcttcctcgtgtcagatgtggacggtcaccccgccctcccagcgctaagcgctgagactgcgtgtccagagtcggctcctgcacgtgaggccaattggtcacactgggccagtgtggaggaagacgcctctcatctcccaaatggggatctttcatgggtgtcacctgagcttatagagcttagtttagtctagccattccaagacagtggtttcttaaccttttctaggtcacaaaacctcctgagaacctaatgaaaactggatcccagccccagaaaaatgcacctgtgtgcacacacccagcagtttccaggtcatttcaagtcctgccttcgaggtccattgttattatttacaaaacaccagcctaaggtattggacattttcttaaaaggccaggcaaggtggctcatgcctgtaatcccaacactttgggaggctgaggtgggtggattgcttgaggccgggagttcaagaccagcctgggcaacatagaccccatctcacaaaaaatacaaaaataagctgggtatggtggcacctgtagtccagctactcaggaagctgaggtgggaggattgcttgagcccaggaggtggaggttgcagcaagctatgatcgtgccactggattccagctccagagtgagaccctgtctcaaaaaaaatttttttttcttttttctttttgagacagagtttcgctcttgtctcccaggctggagtgcaatggcacaatctccgctcactgcaacctctgcctcctgggttcaagcgattctcctgcctcagcctcccgagtagctgggactagaggtgcgcaccaccagacccggctaatttttgtatttttagtagggacggagtttcaccatgttggtcaggatggtctcgatctcttgacctcatgatccgcccaccttggactcccaaagtgcttggattacaggcatgagccagcgcgcccggcccaccac

SEQ ID NO: 15502 - DNA, 11022 bp, Human
ttttgtctttggtttcttatattcaccatcatgtttgtgagattcacattgtttcatatgactgtagtttgtaaatttgtgttgctttatagtatcccattgttgattggtagttttattgctgtctagtacaccacaattcactgaactgtcctactgttgatagacacttgggctgtttccagctttttgttctcatgaacaatatagctaagaacattcttgtaatgtctctggatacacttgagcaagattttctctagggtaagtactactttctaaagcaggtgttccagtttacattcttaccagcagtatatgagaattcgcagtagcctacaaacacctgctactgtcagagttcctagattttttgtttgttttaagacggagttttggagttttgcccttgttgcccagactggagtacagtggcgtgatcttggctcactgcaggctctgccttcgggttcaagtgattctcctgcctcagcctcccaagtagctgggattacaggcttgtgacaccacgagtggctaattttgtatttttagtagagacggggcttcaccatgttggttaggctggtctcgaactcttgactcaagtgatccacccgtcttgacctcccaaagtgctgggattactggggtgggccaccatgaccagccgtatttttttttttttttttttttgagacggagtctcactctgtcatctaggttgctggactgcagtggcacgatctccactcactgtaacctgtaacctccgcctcccggattcaagcaattctcctgcctctgccttcccagtagctgggatcacaggcgcctgccaccactcttggctaattttttttttttttatttttagtggagacggggtctcattgtgttggccaggcttgtctcaaactcctgacctcaagtcgggagtcaggaggtcaaataatctgcctgcctcggcttcccaaaatgctgggattacaggcgtgagccaccaccacgcccggccagagttcttaatttttgccaatctagtgagtgtggtttaaaaaccaatcaattgaaactaatcgtggttttaatgcatttccccgattcgtaatgcgcttgcgcaccttacatgtttgttgactatctggattttgtcattgccaaagcacctgttcagtaattttatccatttttcgattgggttgtctgtttagatcctatatattctggataattgcctttgtcaatcatatgtgtaacaaatttctactgtgtggcttctctcttatgatgtattttatttcccactcttcagtcgtaagatggtatcacttgtaagttcagtcatatacttggcattttgggttcatcatggagttatgtattttgaaggtcagattatttttgtcgtaacccagtcaaatcaattgcttcaagttagttgtttttgtatcatatattcccacccataagtcctgaagatattctagaacgttatttcctacaagttctggatttgctgtacgcgttcaggtctctaagccacccgaactgtgtgtggctggaaggatcgctccatgaccacgtacgctggcggcccctcttccggcttacctcaggggctggtatcgcgggcctgttctttcatcagaaagatctatattttgctaataaaggaacgctttgtgtccaataaggttttcgtcattacgcatgaaaacgccaccttaagcttatgtcgcctgtgaatatttaagggaaaaaaacatcccggcaaccaactgctaggcgacggacgctaagcacctcctccccgcggacgtcagcacccgccttttcccgaagtcgcaacacgcaggcgcgctccggctcgctcaccacgcacggaagtgcgcctgcgccaggagacgccccgcccagcccctggccgactataaagtgtcgagcttctcctcgcgagagacttagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaaggtgaaggccccctccgctttggggtccgggaagaggttggggatgagtcccgcagggtgcagaggcgcggcctgtgtgctggaggagatggtgtttttggtctcggggaggctcggaggccgcaacgcctcgggaagagagatgagctccgggttcgcagctggtgtttttaacttctgcccttccgttttctctctccctcagacatgcccactgttgctacgggtcttcaccaccaataacggccgccaccaccgaatggacgagttctcccggggaaatgtaccgtccagcgagttgcagatctacacttggtgaggagggcggggtggcctcagggacccgggccgggaacctggaacaacagttaattgcctttgccagtgtagagttattctccctgatttcaatttcatttctccacttggggccttcggactcagctttcaggaagttagaagtttttgttgttaggtgaaaggagatttgcccgtattgtaacgcttttgtgattaatgttgcaacttttgggcggttaagaatggacagacccaagattgctgtcactgttatggctgctaggtacaaaagtgataggtagataaatatgttgtagtatctgccctaaagggactcatagtcaaataaattgcactaggacaacatggtaagggagagtgatgctgtcgagtggtatttgttattctcaaagagcatttccacataatattaagccttaggtaccaaagcaccaaaagtgaaaaataaactaccaaaacccgagttatttcttctctaagggttattggaaaagcttttgatatgtgtttagtgaagatggttcctgaatgtttatctcttgggtgtacctccctacaaactactgtgggcttgtctttagcgctgcacataactccttggattgacaccataatggctttttagtataagtaaaaggtgtgtaattgaaaaatatgtgtatatactctctctatatatttttgagacagagtcttgctctgttgcccaggctggagtgcagtggtgccatctcggctcactgcaacctccacctcctggattcaattgattcttctgactcagcctcccaagtagctgggattacaggtgtccaccaccacgcctggctaatttttgtatttttagtagagatggggtttcaccgtattgaccaggctggtctcgaactcttgacctcaagtgatctgcctgcctcagcctcccaaagtgctgggattaaggtgtgagctactgcgcccagcctaaaataaattttttattgtgatgaaaagatatataacaagccaggcacggtggcttatgcctgtaatcccagcactttgggaggctgaggctggcggatcacttgaggtcaggagttcgagaccagtctggccagcgtgatgaaaccctgtctctactaaaaatgcaaaaattagccaggtgtggtggcgcagaattgtaatcccagctaattgggagactgaggcaggaggatcgcttgaacctgggaagtggaagttgcagtgagctgagattgtgccactgtactccagcctgggcgacagagcgagactctgtctcaaaatatatatgtgtgtgcctatataacaaaatttgccgtgttaaccatttatttttattttttgaatctcactctgtcacccaggctggagtgcagtggcgtgatctcagctcactgcaacctctgcctcccaggttcaagcgattctcacgcctcagcctcctcagtagctgggattacaggcgcccgccaccacgcctggctaatttttgtatttttagtagagacagggtttcaccatgttggccaggctggtctcgaactcctgacctcaagtgatccacccaccttggcttcccaaagtggtaggtttacaggcatgagccaccgcacctggtcattaaccatttctaagtgtacaatttggtggcattaatagcattcaaattgttgtgcaaccactgtttctacaagtttttatccctccctccaacagaaaccctgtaccccatcctgcctttttttaatttttaaagagacggagtcttgctctgttccccaagctggatttgagctccttggctcaagcagctgggactacaggcacacaccaccatgcccagtgtgccggtaccctgttaaggacactctgtgcctattaataatttcccattcctcccctgccccatcccctggtagcctctaatgtattatctgtccatatatgaatttgcctattctgcatatttcatttcagtgaactcattacagtattcgtcattttggcttatttcatggtgtttttagggttaatgttgtagcatccatttagccttgtcaaggctgaatcatatttcattgtatgtgtgcatcacatatgtactcatctattgatggacacttgggttgtttcaccttttttgccattgtgaataatgctgctgtgaacattggcatacaaatgtgtttgtgtcgctgctttcagttcttttgggtatgtacctaggaggggattactgggtcatatgttaactttgtttaatttttgaggaaccaccaaactttttcacagcagctgcactattttatattccccaaaagatgtataattttaaactatttaagccctgtacactagagctaatcccttgaagattgggaccttacttgtcttatttggaggtgcttgttaaatttatgtagtagtatgatacctgtacttaagcatcactcaagggtaagtgttctaggaaggttgatttagcttatatggaagaactgttgaataatggcttgatgaaaatctcttcagaaattaaagtgtatgtttcttccaacaagagttcctatttgccaggtgctgtgtgtgcttagatcctgagggtataaagtcaagacggtactgctcctccctgtagtaagtccttttatcagggaaagcggatgaatagagtgatttttagggttaaaatggcagggtgaggttgttccacagaccttccactctgaatcaagaaaaaaaattaccaaaaaaatcctgtcctaaactataccgtccataaattgcaaccaaacaaagaaggaacaactttaagttacatctcaaaatggtggccaaagaaaagattctgaaagactggatgattggtatgggggtaacacaaaggcctgccctcattcccagaaatagtaatgagggaaaattagttaacatatactggaaattctcaatttggagaagtagactgtggggttaaataggcagtcccaagagaagttatggaaacaggagtggaagtccagaggagcccagtagaggcaggctgtgttcaccaaagtcaatcagggctcagccagaaaaacagaattgggagagatgtgttaagagatttatttctgctgggcgtggtggctcacgcctgtaatcccagcactttgggaggccgaggtgggcgggtcatgaggtcaggagttggagaccagcctggccaacatggtgaaaccccgtctctgctaaaaatacaaaaattagccaggcatggtggcgggtgcctgtaatcccaactacttgggaggctgaggcaggagaattgcttgaacccaggtggcagaggttgcagtgagccgagatcagcgccactgcactccagcccgggcgacagagcgggactccatctcaaaaaaaaaaaaaaaaaaaaaaaaaagctttattgcaaagaatttggtttacgtgattgtgggggctgtctaggcccttaattgtcaaatctgtagggcaggttctcaggaaggaaaggctgctcttagggcctttcaactaatagaatcaggcctccccagattatataggatagacctctgaatttaaggtcaattggttgttgactttagtcacatctataaaatatctcacagcaatacctaggttagtgtttggttgaatatctggggactgtagcttcgtcaagctgacacaagtactgaaccccaccctgtcctcaagcttctgactagtgatgaaaaagcaacacttggcactccaattgttggtctggaaagacagtccttagaaggtgggaagcttgtgtaggtttcacactgtcagaactgataaaaggtgtgatataaatcccccaaattaattaagagcaagacaatattgaaaatatttttagaaaggaaaaaattctttctggtatatatcatcataagtatgtactgtgtatcagaatatagactgagcatcgcaagtccaaaatctgaaatgccacaaaatctgaaacttttgagagctgacgtgacaccggtggaaaattgcacacataagttcttgacctctttttttttttttttttttgagacagagtcttgctctgtcatccaggctggagtgcagtggcgcgatctcggctcactgcaacctctgcctcccaggtataagcgattctcctgcctcagcctcctgagtagctgggattacaggcgtgcaccaaacttcctttcatgcacacaattacttaaaatgatgtataaaattgtattccagctgtgtataaggtatgtttgaaacataaatgagtttcttatttaaacttgggtcacaaccccaagatatcttacgtatatgcaaaaattctaaaatttgaaaaaacctaaaacgcttctagtcccatgtattttgggtaagggatactgaacctataattgatacagaatagttaacatcaaaatatcaggttgaaaaaaggtcacctctgagacagataaaccaatgtgacctcaggtttttttgtttttgagacagagtctcagtctgtcacccaggctggagcacagtggcacagtcttggctcactgcagcctccgcctcccaggtcaagcgattctcttgtctcagcctctcgagtagctgggattataggctacagatgtgtgccacaacgcctggctaatttttggatttttagtagaaacggggtttcaccatgttggccaggctgctctcgaacttgagctcctggcctcaggtgatccacccgccttggcctcccaaagtgctgggattacaggcatgagcctccgcacctggcaaaaaaatgtatactaggttatttctaagatgcttatatgttaaaatatttttttcagattgttctcttattagctcaggggactatatgaaagttggattcaagtcaatatttgcagggtaagaaactattgtgacaagagcctgtgcttcattgtaagaaacttttgtatatttcattggctctagtactcttatctgttgtaaaacttacaattctatctaagaaagaagaaacacatctggctgggcgcagtggctcacgcttgtaatcaatcccagcactttgggaggccaagataggtggatcacttgaagtcaggagttcgagaccagcatggccaacatggtgaaaccctgtctctactaaaaatagaaaaattacctgggcgtggtggtgggcgtctgtaatcccagctactcaggaggctgaggcaggagaattgcttgaacctgggaggcggaggttgcagtgagctgaggtcacgccactgcactctagcctgggcgacagagcgagactctctcaaaaacaaaacgtcagtatgaaaatgctttcctagtacattgattctaagatacattccaatttcagagatgctaaaatgtggaagggtacatgtcttagaactaatgggatacatctattttgcatatttggatttatttggactagttacccttaggtaaatcactaggccataaggtgttgtgtagcaacagaagatagcatatagaatctctgaagtcccttttagcactaagagtctaattaattgaaatttccagcagtaaggctggtacatggagtttttggaggcaaatagtatttttagctgctttaaaattaatctctagtataagaccctggcagtttctaatgtaaatcacaactcagatatatgtaattaactcattgttagtatcccttttaatattattgctgattaataagcaaatgtaaatgtcttttttaaaaaaaatccaggatggatgcaaccttgaaagaactgacaagcttagtaaaagaagtctacccagaagctagaaagaagggcactcacttcaattttgcaatcgtttttacagatgttaaaagacctggctatcggtaggtaacttctcatttttaagtcctgtaatctctttgtttttagtatgttttaactgatacagataactccttcaatgaatcttgttagtgggagaatatgggtttatattaatacgtggtttggcttaataaagtagttaaattttggaagtgtgttataaaatgatggagaaaatccagtgccatattcactttgtagtacatactgggtttcattgatttggatccattaacagttgattttctttcttacagagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcagcctgagtgtgaaagttaatggaggcctgggaacagggtttatactaagtagtggaggagcgtatggttaagcccaaaggggcagaacaagaaagccacgggattgtatgaaatcaaacatgagtttgtggtgtagactgctgtatgcagttggaaaggacacgtgagagtgagctcaagtggcagcagaggcagtttggaataagctgcggcaagttgaagaagctgtgttggacgagattgccccgccttgatcagggtaccatgacataaaaggttaaagaacaggcaacacaatgagcacttaagtttttaacatgtggggaatagggcattttaaaggctggaaccagttcagaggaaacaagggtttgggtagaggtagaaaggtttaattaaccctggagatctgcaaatggagggaggggtgaaggaggaatcttaagaccgagggagaagagccaaggacaaggtcaggttgaatgagtaggaggtgttcacacatcctcttgtgtgctaggtagtggcgtgcatctgatctgagaggcagtaaagcagtgatgaagacagtgcagcagaacattgaagtcctgattgcagcagtgactctgcaaccttggataaattatttcaatctttattttgtaaaacggagataacggcctataggattgttaagactgaatattttaaaagagcttagaatggtgcctgacaaatgagaaacaataaatactgattattggccataaagtggtattaaaactggatctcttttcttccatggcactactctcattttgaagtttatgaacagtacgacagtgtattgtaaattccctttagtttgttacagtagccaattgaaaatgtatatcccaaaatttaaaaaaaaaagtaccagcagcaataaaattgcactagttttatctggtacatacaaaaacagccatttaaaatctgatgattctgtggaattggtgtccctgttagcaatggcagagaccagcctggagcctagatctggtgcttcttctgtgctgtggtttaccccaaacctttaggttgtttattcattcagattagatagactggagccataaagttaatttgcacctagctttttggagaatagccatgattaactgctattcgtggtgggggtgggggggaaccctatgatttactatgcagatgaagagggtaggaactaaataaaggactttgtaagccaaagtggttgggctgctttgtcaaattccaccctttgcttggttccaacatggaatttctcctttaaagatttcaatatcccatcaaaagtacagttagagaatacctagtgaatttattgaatataatgctaagaatcaaaagacttgtactagtttacctctggctttggtaagtgtggctttgagtaataactgagctgtttccccgcatataaaatagaaataaataagtagtcatcatgacagcatcttgctcagtgctttagtgtctgccctggttgcctcatttgctcctaggtattttggaattgacgttttccctttggaatatgtgttacagtacatgatattgcctataatgtctttttagtttttcacggtgtacaaaaactgggacggttatgcccagctgatcattgactcaggtaatgttttaggtatcggttgtatgcatgtgaggggcaggtgtgaatgtagaaagaaacattattaggctaggtttaaaattctctaaagttgaacataataaggagctgaacttgatgcacctctttcttgttcaattaaacacatttcagacttgtttttgtgaaatagaaggcaacactctaaatcaagtttgtaactatgatttaagtgtttacttgtgccaaacacagatggttcccaagttatgatagttcaactttagatttttcagctttgcagtggcgcataagcgataagccattcactacggtcctcagcttattatggggctacat

SEQ ID NO: 15503 - DNA, 24317 bp, Human
  misc_feature (1)...(24317): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaggaactggggctgttgcgcccttaaggttgctaaggcgacggttctggccagagcgaggcgcattgacgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccaggtgagtggggtcggccgggggctcaggcgaggtgagcttcgtcgcttcgcagccggtttgcgggagctggaccgatccaagatggcgtcacggggagcgacctgcagggggacggccgcaccccctgcccctccccggcccggcgggcgcctccccgcaggcctcacgcccccggctccgagtctgcatcctcaaggccgtctgggcgttggctttggtgcggggctccccagccgccccgctcgcgctcgctgcccccaccccacggctcctggggccctgggccctccgcggccctccccggccgccttcgcccccgcgcgccgcggcctcttcgctcaccctcccccatttcctgaaggacaacggctctattttactggggtccgccatcgtctcgtccgccggtcctggctcttcttgtaagccggtagttttcctctccacttttgatgactcgtcattgctagcagtagcctttcctcttcatagcggagtgatctttcccccaacacgacggtcttagtcgggctcctgaatttcctcttgtcccctttcacctctctccctttcccaattttgccccctgaggcctcctcgccaccactgtggccttccgactggcgtagcttgaagtctcggcttcccttcattttgtggtcatgaccgtggcctacgtgaagtgaagggcattttcctgcccttcttctagaaaatacacggtacctattaacctcttcagctcagagcctgtggtgacgaccgtcctactccttgagagattcccaagagatccgtctttttagcagagcgaggaaagcaaacacttactcaagatgaccctaggggagccgtaacttggctggtctaagggggtgcggtctgaatcaggaacagtttctcaaagtgtttttatttatttcccagaatgtaatcctttcgaaacaattttgtcacaactgaattttcaaaagaatgaatctgagtgttttgttttacatagagacaatgcagcgaaagttttaaagcagttaaataattgtgtgtggggagggaaggctaggttgttgggctttacaaataagtacacatagagaatccgggtaactcgattaaaaatattaagactgtgaagtctggttattcagggatttacatggtgactgcattaattttggtacatttctgttcgtatactgtcttattaccggtggctatctttttggttttcgtaatacattagttgtttcaaacaaaaacacagtttcactccttaggcccagttctctcatctctaccagccaaagacctgatcttagaatgattgatcatttgaatgttcttaaaatatgacaatgctttgaagcatgaaagatctgatttatgattgttcttggtggcctttaagtattatttgaaatgcagacaattctactgaagtggattttcagttcatatgattgcctgacctggagaagtggcttgtataaatctatcctaaagtaaatgcgcgtttttgtttttgttttgcctgtttaaagtagcagcatgattatttttccatggcttctaatttatgtgcttgtcttggagccacgaactttctaatggtctgttaattagtctacttgttgttgacctttatggtgaaagttgtcaaaacaaaatgagtaacagtgtagcactttagaatagctctttactctgttaattctttctataagttcttttaaatttacagtttcatctcaatagtttacaatgcattataattggaaaagtctgattagtattgaattcagttgctgagtggaggggaccacactcttgtcttctactcttaagtgcttagtaattaggagttggaaggaaaacagtatatgaccctgttgttaaattagtaaacttttaattctagggtaaggttagctgctcatcattatctctgtttgctttactttacataaaggtaccataattcgaatcctctaaaatccattaaatgcaatttatccattaaatgtaatccattaaatgcaatttatctattgaatcttcatgcaagtttgaaacttaagtgttttaacattctcctgtcaagatgaagaaaatattttgacaattttctgtccaaatgttttacagtttatgtggtaagaattctcccctcccccaactaaggattttccttcttttaccactagtgtattatcatttaggggtggaatctggcaaacgagtctggaataaaggttgcttttaaaactcatctaattttcttgtgtgtttttaaaaattttgattatgctagtagttggctaatcagatcctcactccagtggtttgctctgtgacgttaggatactcccatgggatagaagttacgtatagggaatgtcagatattcttcattgtgctgacttgctttcgcttacagttgacttttgtgccctggtaattctgtatcctgtttaccgtttacctacttcccacgtcatcatgatttcttttgagggagaactgaatgaaattcccttaagggcctgacttcagcacccgtctctgcagaggttagtggctcatacttcctcccaggagctgaggttatcgactctcactgttgcctacagagcacagatcctgaactaaatgaaacatttacttggaataatgctaattctgtacatattttattccctagtccccacttccctgtttaaaaacaaaatctacttagaaaaaaatccctgtgaatcagttgtctaatgaatttagcaagttaaatgccagattgacattttgctttatagtttatacaagcatgtgtgtgtttttttctcgcagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggtaaaaataaatgtggggagatgatgaggtgattgtgacagttgttacatttaataactggaatgttactaatttgtattttttggaagaaaaggaatctgactaaataaaaagtctaaaacaatttcaaataagaaatacagttaaggcatttgtagtaatttaaaaattcttaattagtagaatttatcagaaaaatgaacctgtatgctaactgtacttggctaataaagggtttccaaacaattctttgtaactttttaaattagtgcgtagaactataacagataaaactgatcagaactagtatagcagttctatgaataagaaattctatagttcttaaaggcagttaatgctcctcccgttttgaacaaagcaagtaagcgtagtaaatcttatcccacttttaaaactagtgtaatgaaacatgaatctagcttgtgactgatatatcagaaattttcaattagattcggtctattttagtatagagtatatctgataaattactgtagagatattgatattgatgttcctcaaaaattttactccattttattggtcaggacttgttgcgccttgaaaaaaattaatccaatttttattcttttttgctcttcctccttgcttgtatgtcattgtgacctacgtatatggcatatgtttttctaagcaaagtgataattttacatcagggataattgaagcaaatgaatgcttcaattcatctccctcaagaaacgatgaatgaaaaagtctgggttaccaaatattttgaatagtttatgtgattcgcttctgtaaatcagtgagagaaacttactgattttcttgtgcatgtggaagttatgaggtggttcataatgattatgaattaattgaaatgaatcatataccaaaagaaatgattcatataccaaaagaaatgaatcatttcttttggtatatgattatctaattgtataatagaaataatttgctttattttccattggtttttatagtttcttataatcagtatagtttattagtaaaagaatctgtactaagctttaaaaagtatttgggtagctcattgagcaggtattttctattttctttaaaaactgattgttaaaatttgtatttagtaccatgatcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccataagaaatgtaccaaaaactcttgacagttggtcttttgaaagcttctgcattttaattcagtcatctggcaatttgagtcttcttttactcttgtatttattagacccttaggtaagaggaattaaaataacagtgaccttgtgtctgctgtgtcaggtactgtgtgaagcactttatatacataaatactcgttatttcaaatgtacgaggtatgtgattttcagcattttatagacatagcagtaaaactgagagaaattaagtaatgtggctgtggttatagactgtagtcgtcagcttttgctggagcaacatacaacccccaaatttcagtggttactacaacagaccagtcatgtgcagttcttctggtatcagcctgtcttatgttcttgacaccacatatcttgttctggggctgagcagaaggagcagccctatatagggcatgctgttctcaaagcagagggagggcagaagctcaaggtggacagagccaaaccacacaggcaaccatggtatggcatgtccacttacattccatggccagagcaagtcctgtagccaagccttaagtcagtggggtgggaagtatactttacccacagggaagagtgacagaagcagggagggaacaaataatcgggaaaacatagtagtggggacagaatttgaacctaagagtcaagaagatagtgcagaatttaatgcaaaaccgaatgcagaatttgaacctcagagtcaagaacataattaaccactgagtagactgggaggttttttctaatttttaattttttattgatatataacatttgtatgtttttatggagtacatgtgatattttacaggcatagaatgtgtaatgatcacgtcaaggtatttaggttattcatcacctcacttaaagagctgaggaggaaggagactgacagaaggatgacaacagcaagagaaaggatataaaaatatatcatagtatatactagaaaactcatgatctgagtaatggctctgagttgtcagattaggttatattcagattgctgtttttaaaagactcactagaatccatgagacactgctaaaatcagaatgcttttgttacttcaaaattaatcttaaaaattcagtgaagtagaatgtagtcccaagtgaaatgttatttgtgaaatttttcctgaaatttttgtgaaatgtcagtgacaaatttgggggtgggagaatttgtgttttcatttatactcttaaactgtgtgtgtgttttattttatttttattattatttttttgagacagtcttgctctgtcacccaggctggactgcagtggtgcaatctcggctcactgcaacctctgcctcctgggttcaggcgattctcctgcctctgcctcctgagtagctggggctacaggtgcctgccaccacacctggctaatttttgtatttttagtagagatggggtttcaccataatggccagtctggtcttgaactcctgaccttgtgatctgcccaccttggcctcccgaagtgttgggattacaggtgtgagccaccatgcctggcctgttttttgagacaggatctcactctgttgcccaggcctgagtgcagtggtgcgatcatggctcactgcagtctctaccttccaggctcaggtgatcctcctgcctcagcttcccaagtagctgggactacaggtgtgtgccaccacgcccaactaatttttatgtgtttttgtagagatgaggttttacaatgttgcctaggcgggtctcgaactcctggactcaagtgatctgccaccttcggcctcccaaagggttgtgattataggcgtaagccactgtacccagtcatgtactcttaaactttaaacttgggagagacttgagttttatacctgtgttaatatgaaatgagaaaaccttactggttattggaacaaccagaattaacatgaaatgagttttctaaaaaccatattttaaaaagtaggttacatattcacatatttcaaagttgtgcaggtacaaaggggcataataatgaaaggtctccctcccacgccattgcttttcttgaatgctgccaatgttctggagattaatatatgggcacttacaaatttatatatagaaaagaaataacgggtcaaatgaatgagaaagtagaagataacacatttttattttttcccttttacttcaggcacaacaactaattctttagatctgagaggaatttgtttttaaggctctagatgtgaaaaaaggaatgtttaatagtttatcttaggttttatttgaattggtccaataagtagtttttaaaagcaagtaaactctttttgtcttttaacttcaagtttaaaccttgattacaaagagtgatcctagctctgctgggagaagtattatagatacgatctcgtttaaattcgtggttaccatcacatcatttcattatttgtttttatctgggatcaaactggaatgtgaattccacaggctcaggaccctctcctatttgtttttaatttcctgttgcctagcataggtcttggcctggcagatccagaaaatggcttattgagttaatgaaataactcagtaatctagacattcttggatcactatgttgggcttgaattgtttttcctgataacatttcttttggcaggagggtctcttgctatctgcagtagcatccaaaaaaacccaattttcaggattttgtcttgcagtgtgttactgttgtgtgcatcacagataattgttgtcaagacattaatgaatatctgatttgttactcacatgttatgtgagtactaatggcttgtactaatgacttttgcccattaataaaggatagcatctgttatcatctgaggtacattctgttgagagtgtttcaagtgttactctctttttttcccctttggaattggtgttttcctcttaacttacattgttaatggaagaagagattggaagtgactgagatagactatcattggaacatgagagtgccagctttacatgccgaaggatctcattttgcaaactcgtaatttctttcaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggtagttttgatatttgaatatcggggggatgcttttgggacccacttggtggtcatctagtctcctttgatgaatgaatcataaaatacaaaacagggtggaacttcatccatcctgtacaattcttgggtactggaaaacaggtttctgtaatagcatgctgtcagaggaaataactaatagtgattatgaactagtgaataattgcattttggggtttgttatttccttgcagttgttttgcagtagaaggaggtgggcggtattgctttttctcttgaatcgtgatgtcctttttttgctatcctattaaatgttgtggcttttaaccttttattctacgagcctcatttgtcctgtgttctcctcttcctcagagccaggctattttgagttatgctgttagccttaaaggggaacagaattgtcctggcacttgaggcttgtgaagctaacagatcacagatttttaaaatgactaattattataaaatacttagttttgcctcagaataatgaccttggtccaggtgttttgatttgtttctttagttgttaactgggaaccaagtaccagactttatatttaggcctggctgtaggcaaggggattaattagtcaatacttgttgagtagtttatggatcaaagatagtacaagtgtgttgtagtgaaacactacaaagcagtcttgtttaaataccataatgtggcttgacatttaattgaagcgcaggttgcaaacgtgaaatgtttttggtttatggaattgtcatttgaccttcagttcttttctaggttataccaaaagattacaagacaatggccgctttagccaaagccattgaaaagaatgtgctgttttcacatcttgatgataatgagagaaggtaggaacaggctctttcttaacactatttttcaagtaagggtgtgatcccaaattgttttcaacacttgttgcaagttttagagctcttagtaattgttcaccagatgacagtctggggtctttaattctaagcttaatgtttgaaattcacggaagagacatgtgaaatgtaacacgaggccttctctcttttgcagtgatatttttgatgccatgttttcggtctcctttatcgcaggagagactgtgattcagcaaggtaagggcctctggagcatgcaatattgttacgggagaggaggcgagactagaggatttttttggttttgttttattgaagtttgttttcctctttgatcctaccacttttttttttctgttatactattggatttttctatttcttttaaattaagattttctgagatggacagaacactttgtattgggaactaatatttttgatatagttttgtttataatttaaaggaaatgcctacattgtcttaccttgaatgtcatatagaattgcagaatcatatatatctctcatgttctttatattgttaatcacttttaaagtaagaaataaatgaaacacctacattcttcattgtatagccctgtctattaaaaaggttctagggcttctatagattcttactttgcctatatagactaacatggatctaactttttgactatcttcctctttttattttcttatttattcttgacattttatgagtgggtatatattttcattttgtggcagcctgataatttgttattaactatttgagttgtttctaatgtccttgttataaatgccatagcagttaataactacacatatgtagcttttaaaaatttttttcagaggtattcttcaccatgagatgactaaaaaaattttgattaattctatgacttttaaaatatgttgcttgattttctttcccctgaaagattgtgttagtttgtaacacactctcacagtaccactgtaaaataagtttattgttttgtaataattttgataatttctttctttaatttggaatatgcttctaacttttttaccctcttttaggtgatgaaggggataacttctatgtgattgatcaaggagagacggatgtaagatttaccaatatcaaaaatatgttgatcttaaaagccaatgtattgatcgcttccgagcaataagaatagtgattttgaagggtcattacatcccttgtatgtcagattttattaataccttttgccaagtatttttatgacacagagaaactctttaaaggtaattttctgttcagaactttgctggagtggtggtgaagaagtgtgtgtagctgggtgcagtggccgatgcctataatcccagcactttgggagatggaggcaagagggttgcttgagcccaggagttcaagaccagcctgggcaacaaagtgaaacctcatctcttaaaaaaaaaaaaaaaaaaagattctagacccagccattagctagcaaaattaatatacctttcttattcacaaatgaaatggggacaataatagcattgatcttttaggattattagaagattcagtgacctaatgcaagtaaaatgtttagcatagtgctcagcacggttctctaagtatctgtgactggtattagtgcttagctgacctttttcccttacatccttacagagtgcttttttcttatcagataattaaatcaggtaaattatagacactcttaactcatttaactcgtcagaaatcacctattcttctctgttgtgtactgcaaacataatatattctgttttttaaaacaaagttcaggattgtgaccttttaaaaaggtttgagggtttttaacatttaagtgtttgtatctagaaaataaacttttttgatgtcacttgcactttaggtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatggtaagagaccatggtgtttgagagtgtgatttagaattctcatctacgtaactaatgtttgaatattaccaaattaaaaagagaatatttcttttaatgagcaaatatttctttcttttaataagcgaatatttctttcttttaatgagcaaatactttgcattaagcccagcttagcattattcattatgccattttaggcagtgatattttagaacaaaaccttgggaaacaagatctggtatatatgtgctggtcatctcatgtttggaaatctatccatttgctggtaggcacatcttaatttacctagttatacccattacagcatgataggtgctgcttttaagtgcttaaagttatttggggccattcagaaataatcagcttccctaacctgtgaaagtgggttatcagtaatgtatatgtatgtcatgtcccctctcgttaaaggaataaacaaaatactaaaaccattggaactttctggtgatagtcagattttttgagaacgttgtgataaatttataggatagctttggatgtttaagtctcagccaatgcattggtcatttttaatggttttcttaaatttgtgcagtgtccatctgaccatttgaaaatgtacagcctgatgtactttgaaatttttctgcatttgggatatatagatagattagattagatagatagtcttgtccttcgcagcaacatggatagagctggaggccatttttctaagcaaaataacacaggaacagaaaaccaaaccacatgttctcacttacagttgggagctaagcaatgagaacacgtggatactagaaggggaacaacaaacactggggcctacttgagggtggagggtgggaagagggagaggatcaggaaaaatacctgtggtgtactttacttattacctgggcaacaaaattacctgaacaccaaacccctgtgacacccagtttacctatataacctgcacatgtacccctgaaccttaaacccacacacacaaaaaaacgcttatggcaaagataagtctaaattttagaaagattggttttgaagtgatgtgacagtctactggagaagaaactgaccatacagttagttctgcatttcctctacaggaatactattagtaaaaggaaacatagaatgtttacagctttatctcattgtcaaagaaggaagaggtaggacctggaactattggtttgaaataaaatattttactttctcatagtgggcctgaaaggaaattagggcctcacaatgctttggctttgtggacaggaattaggaactgtagatatggggtgaaatatctatatagctgggtaggggaggatatggtcctttttttatagaataaagacatgtcaattgtataggtgagaagccagaactaatggaggaatctgcatttaaataccagcgttgaacaggaagaacactaggattattgggttgtaaatgacctagattacttttgtgagaaaatattttcagagataaattgggttggcagtggcacaaaatcagtttgagagtaaacatggaaattggacattggtttaaagtgtgtggaaaaatatcttgagtgataggctcaggtataaaccggtatttcgactgtatttggaagttgggaaatgctttgtgaaatatgtcaacatactggttgcaaatgctaggaattgggcataatattggcggaaaataaaaatcacaagaatgtcatatcattcattacctgtaaaataaaaatgaattagttaaaattaaactttcctcattaaaagcaacaagctttgactttctggttttaaaatttatttgaaacttaatatttattattccatagcattatgtggtgataattacacgtcttggggatatcacttttgttatttttatttttagggaagcacactgagaaagcggaagatgtatgaggaattccttagtaaagtctctattttaggtgagttgtaaagtgtgttaactttgctagtatgtgagatacccctgaattagaattggatggacttgggaaaagccttctgaaagtataattgctactcattccccctgaaaagacagaagggctgaaagtccttctgactgtggacattcacagttatttcctctgtgacttcccgtctctcttgttccatcattgagttgattggttcagaaaagtgagtacttccaacaatacatttcctctgtggaaagattaggtatcatttgctggcatcctctgaaaacatgccagaagtttgttgaaatttagagtaaagcagattaattgaagatattcttttgtgcattttgttatgtggacttggagatgttagaacttgttcttcatgaaaggggaatggggatttttataaggtaacaggcttctgccattgtttattacagtgaatttttcacctcttctttgtcttttctttgaattggttacatatgctttgtgttttggatagtagtttggccttggggaataaaagttattttctagttctttttcataaagtaaaccaagaatttaaatagattaaattatttctatgaaactttggaacgatatggatggggaaactatgacttttgagtattgtagttgtaggtttgatttgcattgatggcaatcttcaggaatacttaaggattacattttcttattcccttgccatttggtacagttggtataaattaacctagccactgggctaccgaagtaaggatctaagggctatctgcaggcagtatgagaatcctgctcagactagaggtaattgaagacaggtaccacttttaatctgagacactactagaatgttgaatgggcatggctatttggttgaatctctttatactttctttttacctttataacagcaccaaataatacagagcaattattttgattcttgtctttcagagtctctggacaagtgggaacgtcttacggtagctgatgcattggaaccagtgcagtttgaagatgggcagaagattgtggtgcagggagaaccaggggatgagttcttcattattttagaggtaaagaactcagaatttaatacttgaattttagaggtaaagaactcagaatttaatactttaaaaagttgtacgctctaagagggaaagagtgggctaattctgaactatagctttagtttttaagaatacctgaccattttattttaaaattatcttttactttgaaatgctgttgtttggttttctgccaggtcactatatttttaaatgagtttgagtcagaattcttgaagggccctagacatgaaaagccaaattctaaaaaccatttaacataacaaactgtgatgattctgcactattcttgttaaaatgcaagtgtttgggctatttggcaaataaggattaaaggtaattatttaaatttgaaaaattactgtgtttgtatatctccacattccatggaaatgtatagcagatactcttgctaagcggatccaagtggcagatttctatgaatgtggctccatagttgctaattgattttatttaaatcaggggtcaggagactgtaaagggccaggtggtaagtaagttaagctttgtggaccatagggtttcattcgcaaagtctcaactcttgtcatagtgcaaaagcagccacaaataatatgtaaatgaatgtatgtggtatttcagtaaagtttgatttgcgaaagagacagtgagcttggatttagcccttcatctacagtttgctaacccaagtgtgcaccctttaagcaccttagcttgatacgaagaacctcgctagcaggagatgctggtaaaatagaaattgaagctcatgtggtgactaactttaaagtcattttttatcatatgcacacatttgcaaggtagttaaaattgcataggatgtttaaggtgccaccctgggtttgagagtgtttgtttgtttagctttttggtgattttattataggggtcagctgctgtgctacaacgtcggtcagaaaatgaagagtttgttgaagtgggaagattggggccttctgattattttggtatgtatgaattccctcacaataaatacatggtttctttaagtcacctctcagtgagatattgtagtcttccataattttgtcttctcctgaattttattttctaactgcagtcttttttggctctgagagggaaggtgtgagattttgatctttactcatttaatgaaattactgattgtctcatatctattgtcttctttctcagaagtgcactgctttaaggaaatgtttttcatagaagttagcctgttacccatctttgctttctccaggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttattcctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggtaggtcaagtaataaaaagagatgaaataatttaaattcttaaatgaatcagtttttcttccctttctcctttccgtctttcctctctctgtccttccccgaaagtctactcgggtgggcaaaaatgaaaagggggaaagtgaattatgggatcggtgttttgaaagagcaatgtttattttcagtgcttttcagtttgtcaaagagtggatctcaaaatcttgcttaaagggtaattgagatgtagcagatttatttacttagtcatggaaagaaaaaaattcagtcaaaagctaaagatttccttttgattgaagacagattggttctgtggccttggaactttcccagacttaatggggaaacatcatttctagattagcatactctttggtttaaatttaatatatacatttaatgttacttagggatacttttatattttgcatatataaagcctcatatataaagccttatttctgatgctcttagatttctgaggagtgagatgattaagttgtattcattagtgtattggtatttcttcacatccagtgaaattggagatatgttgtatgttagaagagcattctttaaattgtgttgctttgaacatgtgtaccttttctagattcagtaatcccttccccccgtcctctggagtatgaaacctttagagtcacaataaaatgtaactaaagaaaatttctctgggttgacagtcctggttatagttgaattctctctaaacagtggcccaagtagactcttttttttgtttcttttattttttaatgatttaaatattgacatttaaaaattgaagtagcatgtcagttttcttcatactactttatctctaaccacaaataatagctgaaccttttgtacttatgttaggccctggcagtatatgtttagatgggctaagacaacatcaagaagcaatggctagataaccatttaatttgtccccaaaggtacgtttttatctgtctatttgtctatttatcgatctgtctatctaagatggtctcactctgtcacccaggctagagtgaagtggcatgatcactgcagcctctctgcttcccagattcaagtgattcttgtacctcagcctctggaatagctgggactacagatgtgtgccatcacacccagctagttttttgtatttttagtagaggtggggttttgccatgtagcctaggctggtctcgaactcctaagctcagtttgcccaccttagcctcccaaagtgctagcattacaggtgtgagccagcgtgcccgtctcccaaaggtattattataatagctatcagtaaacgctgtagctatgtgaatttcttaaatctcttccttcctatgctatgtgatttttacatagaaagcagcattgttatgtacatgtaccgctaacatttgtttcttgacataagttcagagctgtgacttcatctggactacacctaaaaccaaaaccactgagtaagattttttcattttgtgaaagttctgccaattttg

SEQ ID NO: 15504 - DNA, 8831 bp, Human
atctgggactacaggcacacagaactatgcccagctgattaaaaaaaaaaaatttttttaagggccgggcgcagtggctcacacctgtaatcccagcaccttgggaggccgaggtgggcccccgtctctactaaaccgtctactaaaaacacaaaaattagcacggcgtggtggtggtcatctgtaatcccagctactcgggaggctgaggcaggagaatcactagaacccggaaggcagaggttgcagtgagccgcgattgcgccgctgcactccagcctgggcgacagagtgagactccatctcaaaaaaaaaaaaaaaagttgttttttagagatggggggtctcactatgtgttgcccaggctggtcgaattccagggctgaagtgatccttctgcctcagtctcccaaagttctgggattacaggcgcgggccaccacacccagctaatttttgtatttttagtaaagacggggtttcgccatattgcccaggctggtctcgaactcctgacttcaagagatctgcccatcttggcctctcaaagtgctgggattacaggcgtgagccactgcgtccgacattgtcaaacgttttttgttcattatcacccttcttaggagaaaacccgaattatcctaaaattgaatttacatcaactaaattaatttcaatttaattacatttaatatctccctaaaggcagaaactaaatacttagggataaatgctgtctgatagagctggctttggaagaccacaatatctaagatttttttcctccctgaggaccagttttttcccctggggagtcatcatgaatcacttcgactgaggacggttgtgcttagagcaaggagctgagcaataaacaagtaaatgcacaaaattataccggaaagccaagaatgctacaaagaaaagaagagggagtggctgaggggaggccacttggcatctgaatcattgggatcgggaaagaagacaaggaacagtttaagcaaaaggattgttttccccgaactttggtttcttttttctttctttttctttttttcttttttagagacaggggtctcactatgttgcccaggcttgtctcaaactcctggcctcaagccatccccacgccttggtctcccaaagtgcgggattacaggcaggcgccactgcacccagtctgagcctcagtttcttcagctgtaaaatggaagtaatatcctcctcaccatgcttcatatacaataagcactcaataagtgagctttatgattattattatttattttaattttacttatttttctgagacggagtctcactctgcagccccaggctggagtgcagtggtgcgatctcgggctcactgcagcctccgcctcctgggttcaagcgattctcccgcctcagcctcccgagtagctgggattacaggtgcccaccaccacgcctggctaattttttttttttttttttttttgagacggtgtctcgctctgtcgccaggctggagtgcagtggcgcgatctcggctcactgcaacctccgcctcccgggttcaagcgattctcctgcctcagcctcccgagtagctggaactgcaggcacgcactaccacgcccagttaatttttgtgtttttagtagtgacggggtttcgccacgttggccaagctggtctcgaactccttacctcaggtgatccgcccgcctcgacctcccaaagtgcgaggattacaggcttgagccacctcgcctggcctattttaattttaaaggttaataggaccagccctgaaatcagcctctgcccccgctggccctactctggtaccagcagcgcccagtagcatacacagccgcgtgcgcctccacctccgtccgcaggtgtcgctgtgggtgccgcggctgggcccctctaggcggcgacggcggcaccggaagtctcgttttcgcccgcttccgctctctggccgggcttgggctgcgtggagaatactttttgcgatgcctactggagactttgagtgagtcggcgatcgcggaaaggggcacgggaagcggttggggtgctctgggaagtattatggggcctgggtacgccgaggctgcgggagccgggcctggctgacttaatcttcgttccccacacatttgtttccgcagttcgaagcccagttgggccgaccaggtggaggaggagggggaggacggtaagtgtacacggtcgcccggggtattcgcggccaggcccaagccgtgtgactgccgcctgcttccatctcccagtctggcaccgtgtaccccgtcacggtctgcccctgccccgcgccatcctccttgggacccgcctgttgccaactccaggtgttccccggcgggtccctcttcctcccatgccactgcctcccagctgttcccctccagggaggaagttgtaatctcccgtctcctgtttctctactggcgcctggttggcttcatggcctggcacccaccttcctacgagggatctcccatccttgccactccgagtccccacagggccatcccagtgcgttgcctggccagccctctgcccttggcctgcctttctccgcttttgctgtaggcgtcatcccaaaagcccttccatcgcagctggggagctcctgcccctggagctgactcctccttcctacgctgccttttgcagacaaatgtgtcaccagcgagctcctcaaggggatccctctggccacaggtgacaccagcccagagccagagctactgccgggaggtgagtgaggactgccactcggtgtccgggctgcctctccctccagccctgccgctcctgatccccatgacccagggctcagtctttctctgtttttccccttctgccagctccactgccgcctcccaaggaggtcatcaacggaaacataaagacagtgacagagtacaagatagatgaggatggcaagaagttcaaggtgagggtggggggtgcagggaatggggacccttgtgcttgggggcccatagaccggaatggggtggggtgtgttgaggaggttgataaaggagatcccttggtcccaggagcctgacccttctcccctcccatcctcagattgtccgcaccttcaggattgagacccggaaggcttcaaaggctgtcgcaaggaggaaggtgaggctcttcttccccagggctaacctagaggaattggaaaaccttgctcccggactttgtgtttagagatggggcttaactcttttttttttttttttttgagacagagtgttgctctgtcccccaggctgaagtgcagtggcacgatctcgactcactgcaacctccgcctcctgggttcaagtgattctcctgcctcagcctcccgagtagctggggttacaggcatgtgccaccacgccagctaatttttgtacttttagtagagacggggttttgccatgttggccaggctggtctcgaactcctgacctcacatgatctgcgcacctaggcctcccaaagtgttgggattacaggtgtgagccatcgcacccggccaggcttacctctttgtacctattttgttgaagctgaactgaggcctggggtgcttgcactgtcttggggccctgaaaagtccaaggcacagcagtcgataaatagcaactaaataaatgatgataaatatctaatcaaagttcgatgatagatatcaaattatattaataaatatcaaataacatcgattgtaaatatcgaataaaaattagattcttttaatttttttaaagacacagtgtccagttctgttgcccaggctggagtacagtggcacgatcatagcttactgcagccttgaactcccaggctcaagccatcctcccaccccaccctcctgagtagctgagattacaggtgtgcactgccacaccggctaattttaattgtttgtagagatggggtttcactatgttgcccaggctggtctccagctcctgggcttgagagatctcccaccttcgcctctcaaagtgctgggattacaggagggagccactgcgcccagccacggttagattcttattcctcttggcctgtcaacctgcaggaacggaagcaggaggtggtcgcagcagtttttggaagaagcgttagcaataagtatacttagaacagcttgctgtgcacttaattgtaacataccccatgccaagcaccttgcacgaagtgtttctcattcagtctccttaggagcccagggaggcaggaagcttttgtggttcccgttttataagggaggaagctgaggctcaggttgtctagctcaagggcccggaggtctaggtggacccctgcacatccctgagtattgcgccctggtgggagctggtccgccagactgcgcaggccccacgctgtgtagctgtcacctggacccggaggctgacagctgccctgcctcctggagctcaggcctggcgtgtactcaggaaacaactgtcgccaggactgttcagggagtgcttgaggaggatgaagatggggtttgaggcccagacactctgggggtggctgttgtaggtctagggcaccccactgtggaacccagcctgcccctgccctcaactgtcccccatccctccctgagcccagaactggaagaagttcgggaactcagagtttgacccccccggacccaatgtggccaccaccactgtcagtgacgatgtctctatgacgttcatcaccagcaaagaggtaagcggggcaatcaggtggggctggcatcctggggtggggcaaagggggtgccttagccgcctctgagctccccccaacccgcccctgccaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggaggtgtgggggtgggagggtcctgctgtcagtgcacgggttctgtccccactgctgccttcgtgctgtcatctcccgcacgacagtgcagcgggtttgatggtgccagactctcctcggggcgtctgtgccttcctaattggctgtacctcctatggttgggagacgggcgtctcccatatatgtgcgacttggcagctgtgactttgctggtggccctgtgactgtcctgatgagctgctgtctgtcggccccagggtgctgaccaccccacatcgtgtgtgcgcactgtgtgtatagtgtctccgttgcatgcctgtggctgtaccgtccgaattctttggtgggatttgctggtggcgagtgtgagagtgcagacgtgcacttgtcgcctgccacgcgagggggacctgggcgctgttcctgttgtgtgtcccatgtctgccgttgctgtgcatgtgaggctgccgcccctgttgtcctcccgccctctctggggtggggtcggggctcctcctcctcctcctccaccagtgtcgctggctgggagctcaaatggtgtcagcttctcaggtgtcaccttggtgtcctcgtggccaactggctgcctgtggtttggcacacagtgcctgcgctggctcaacactgaagcccgagcttcctggggcggctctgtccccacgcctgcgccacagtgaggttgaacttgactgtcttttggtccccagagctagagccggtgcaggccacgcagaacaagacagggaagtatgtgccgccgagcctgcgcgacggggccagccgccgcggggagtccatgcagcccaaccgcagaggtgaggggcaccccgacgccaggctggtgggtgggcacctcccggcacctcgtaattatccccgaagcgtgcacacgagggctgggcagcacacgagggctgggcagtgtcctccccctcacagccacctcccctctcccacacagccgacgacaacgccaccatccgtgtcaccaacttgtcagaggacacgcgtgagaccgacctgcaggagctcttccggcctttcggctccatctcccgcatctacctggctaaggacaagaccactggccaatccaaggtgggcaggcaggcaggcacggtggggctgtgtgagggtcacttgtcctagggtcgcctgtcctagctcgtgcccgaccccatcccgcccctccacagggctttgccttcatcagcttccaccgccgcgaggatgctgcgcgtgccattgccggggtgtccggctttggctacgaccacctcatcctcaacgtcgagtgggccaagtaagactccatccctgccccagcccctgctccctgccttgtcccagcaccttcacggagtgttgggccaaccaatagccctgagccaatttaacagtcccctggctggttttgaggggacagtcctttattgtttttttccaaaaccgggcagaggggtggcagctcttgtgcctggggtccctgccagtccgtggaccaggcctggagactggccatctggctccgtgcccgcttcgtcctcacattaccccgtcctctgcccacccacccccaagatgccacttgggtgtctggggtcttggggtgcccccagaagtcttatacctgccaccctcccctaccccaggccgtccaccaactaagccagctgccactgtgtactcggtccgggacccttggcgacagaagacagcctccgagagcgcgggctccaagggcaataaagcagctccactctctctacttggttgtttttgttcttgcgtctccagtcctgtggcgggggccagtgcctcccctcctctgggcgtggtctggtccctgaccctgcagggagccctgtggccagcgctgtgggtgggaaaggcgactgctcctgcctgggctgcagctgggcctgacctggctgcaagcacaggtgttgctttttgggggaagggatgtgtcggggctcgggccctgccctcagggttctccagcaacacctagggtgaggaggcagcttccgctaggccacatcattggctcagctcacgggactggggctctgacggtttaggggcggctgtggcattgaggggcagggcttggccagtgctcttggcgtcctctgggttccagctgtccctgtagccggggcagtgtcggcagcagcagcccaggctgggcactgcggccatgtagagtagagggtggacacagaaggccaggggcatgaggccccgcatcacctggtagcccacgtagggccccagctccagggctgctgtggcctgggctatgtctgcaaagctcgggcagcgggtgctccagcgccgccgagcatccacgttgagcacccgcatgatgtggtagggcacataggagctggcgtagagggccacaccactggccaccaacgctgccacacgcagcttctcggccacagtcatgcctgggctgcgtagcacggcccgcccgagggcgccgtaggctgccagcgtgagcagcagcggcaggccgcagcccaaccccgccagcaccaggctatacgctctgtaggccgccagcccgtggtctgctgtccccagacacttgatgcaggcctcgggcctggccacgctgcagttgcccgccccctgctgcggcctcttcaggtgggagaagctgagtgtgggcatggccagcagggcggccaggacccagccggcagcgctcacggcccaggcgtgcttgggtcgcaggtggcttcgggcgaagaaggggtgcacgatgcccaggtagcggttgaggctgatgcaggtgatgaagatgacgctgcccagcaggttgcaggtgaagaggaagcgctccaggcggcacgcggcctccccatagcgccagtgcttggggggatagaggtaggcggccagcgggggcagcgtcagggcgcagagcaggtcgctgactgccagctggacagagaagaccacggcggggtgccatgggcgctgcttccggatgctgaagcggtacagggccaggccattgctggccacggccaccaggaactcaaccaccagtatgggccacaggaagtccccctggaacccactgagtttgtcgtcggcagctgccaagaagttggcagggcaggacttggcacctgtgggcagaaggtgtcaccagctgagccctattcccccataaggcggctcctgctaccccaagagcccacgtctgccatggcgtggatccctggacacgagttctttcccctccctggagggggaccgggctccactcctttatgtggacaggattgaggctcagagccagggttatgcattgggccccaatggaccagcttaggcgggccaggcagtcttggagctcaaggtccactggtaacacagacagcggccaccctactcccccaccacacctggccccactagaggcctcctccccaaagtccagccccagcaaggcctgccggctccacttcagatctgtgccgtccaaagccccgtgggggtccagcccccactctgccctgaccttggcacccgccgccgcccaaagcctcttctccccgtggccaccagagagcacccgcgagcgctggagtcctgccccatccttttgcttccaggtgctcacacttggccagggagttgccgccaaaaagccagactcaccccacaaggtcccccaagagcgctcccgcccgccataccccccagtgccaccctctgtgctccgcgactcactccctcgca

SEQ ID NO: 15505 - DNA, 16356 bp, Human
tttgcaccgatgggggtgggatggggaccggggacagagggacagtgcaaagcaacttaggggtctctctcctcagtccccagggctggaggtgctgtgctggcagattaggaaatgcttggggttgatggggaagcttccggcgctctatccccagttctggaagctgaggctccgggaaccctgttttgctgaagctgggcagctccagtctccagagccaggaagagacccccgcgcctatccgggaatccccgacatctgggattctctccaaacacccccaggctgatgacggggccgaatccctaaagggcatacggtgggggtgggggtacgactttcctggggagccggggaaccccctaccttcctggccccctcccactgtggcaccgtgtccccctccccaccgcagctcgcagccccaagcttaccttgcggggggcctggggaggggatgccccgccctccctggcctggggggcgggaggggacgggggtgtccagaccctttgtttgctggtgtgtgtgtgtatgtgtgtgtgcgattgtgagagccgccggggtgtgggtccgtgcgcgcgcgtgcccgggccgtgacggccactgatgtgctggactgccagggtggaggggaagagggaggggtaggagatggggactcccccgcccctgcccgcccactcgcgggtttgaatgaagcgcgagggggaagggcggcagcgggaggacgtttttgtccgatggcccttcccgctccatgcaccggggaatcctcccccttctggagaacttcgctcgctctctccaggcactgcctccaacgtcggctccaggggagactaggaagaggcgcccctcaccggagtggctggagctcctcctatccagcctgacccccgagggagcaccctttaatctgagataatcctggcccaaggctgcaacacggcctattatcctggtatcaaagcgtggattgggatgcatggaagtgtgaggtggtcgaggccctgcatgcttagagtaatggagtccttagagccccggcggaggaagcgtaccccaagacgaacggggaggggctatgcgtggccccagactgtgacgacaaggaaagcccccttccacccctccacgattccccccaccaagcgcggggccaggaatacgcgccgtgggctagactctagcgacacccagcggccagcggggtggggagccgagacccgttttgagggggtccgggtgattccaaagtgtgtgtgtgtgtgtgtgtggtgcgtgtgtgtgtgtgtgtgtgcgcgcgcgcgcgcgcgcgcgcgagtcctcgctgcgaatggcaggaggtggaagacaaggagaaggctgttgccgaggcggggaaaccccagctcccaaggcagggccacagtctcccctccacgtttaaccctgcaaggggagggccataccacccccgatttagacacccccagggcaggtccagtcctcctcgggctgagaaagtccgaggagtcatcaggcgcccctctccagcgcaggcttaggtccccgtttacgaagggcagggggagggccttcccgccgtgtccctaccccttgcagacgtcactgcggcgtggctgaggggacagtcctctcagtctcatcaaccgtcccctccctgccaccccaaacgcccaccgtggagcggcgggagatgaggggggctcggagttgaagcgcgcactcatatgcccccaggagacctagcggagccccagcgcccgatgacgcggagtctctgcgggaactccagggggccggaacacttacgcagggccctttaaggctggctgggtagctagtgccgctgccgcggttactagggatgtgacgtcacacagggcggggtttcccgcgctcggcggaagcggaaggggcggggctccgcgctcctagtctccactgctgccgccgtcgccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggtaaggcgcgcgcgcccatccctttccccactcccggaccccgcttcggagttgtgatccccgatactgcccagggaccccgctgttcacacctaggattctcacccccccagtctggattttcaggagcttcgattcaactccgggaccccagtaccattgggaccctgagtccctgccctggatctccgctcccccactccctgctccgatttttgcgtgggattccctattcaccccctagaacttcttcatagtctggagtcccctagacgagtcttgggggttctccctaattctgttcggcagttaacatttatacccagaactctgcctcaaagtttggaccccaaattcttctagatgatccctcatcctattcgggtattcacttcctatctgggatctcccatcgcccccccacctccgtagtctggacccccaatactttggtctgtcccgggatctactttccgggatcttgatccggggttcccattcagatccggagtcgccactccttttctaaacggaacaaggaactctgtgctactctgatattcctgtccctgcccacacccaggacccccttcctagagtgtagaaccgtcccccttcaggatccttagtctcaccgagtacttgggttttggaatctggttcccctctggatctaactaccagctccaacccgatagagcctcacattccagcctctcctttggcctccggtagacccatttcccattataccaggaaatcctgcccacgtggcttccggcctagccagagcccctgctcctacttggtattgcagaccctgtcaccacccacttcccagactggcttcctgtatgagcctcagccagcattggaaactctcccctaactcaagcccagaaccccaaacccaccccaccttttgtccccagcctgttagctactctgtgacccaaattgtccctgctcttatccagggactctcctggtctgattctaaattcaccaccccttcttctatctgaccacaacagaggtcccgaatccagaccccagaatcccaagcctgggtgatccatgtcccaccaccctctcagtgctcacgagccaatgggatgactaagacttaaaggtttaacctcctgctaccccaaatgagtgtgcctgcattacataccagtgtctgttgtattcctttttttttttttttttttttttttgagacgaagtttccttcttgtcgcccaggctggagtgcagtggcacaatcttggctcactgcaacctctgcctcccgggttcaagtgattctcctgcctcagcctcctgagtagctgggattacaggcatgatgcaccaccatgcctggctaattttgtatttttagtagagacagggtttctccatgttggtcaggctggtcttgaacttccgacctcagttgatccacccacctcggcctcccaaagtgctgggattacaggcgtgagccaccgcacccagccatgttgtgctcttaaacgaagggcatatacctctcagaaccttctagtgaggatctcttaccccaccctcccatagggcaattccccatcatttatccagaaacaactagaaggtccctttcccatccttccagaatactctggaatacggcattagtctcttcatctagctcccagtcccacttccagacctattccttaaatcctgagtctcctgggtagtgtacctgccaagcaagccactggagtgtgggaagaaagttctagcgcttctatttcttgccgtgtgtaacattttattatgaaatatttaagacttcctcaaagctccaaagactattcttgggaagacctatttctgtcacataaagaggttaatctttactactgtggagaatggtttggtcctgccgggtgggagggcccccctcctgcagcgtagtgtacctgccacaccctcctccctctggcacagagcttttcctgtcctgccgctgagaaccccggtggttgtagtggcatgtaagggaggcagggggcttcagcgtctccagcacaggttcaaggacaggcaagcttgggttccaatcctagccccacctcttgctgcttctttctttctttgatgtggcaagactcacaagaagcctccctgagcccatgtgaaacctgggataatatggccccacctccctgagacctttgtaagaatgaattaagactgggtcaggaaaacttggggcaggtttggaaggaagcattgtggaggggaaggagagattgctgtcgttcagagcacaggcctgactaggttcaaatctcagctctgtctgtatcactcacgtgctgcgtgactgccagggagctgtttgatcgctctgtgcctcagtttccctacctgagaatctgaatgatgtccaccccataaggttgttgtaaggcttaccttattcatttaatatttgtaatccttttggggcagtggctattatcatcatcatcatttaaataatttctgttcatggttaaaaaaaaaaaaatctgtagccacatgtggtggcacatgcctatagtcctagctactcaggagactgaggcagaaggatcatttgagcccagaagttcaagtccagcctgagcaacatagcaagaccttgtctctctcttttttttttcgagacagggccttgctttgtcaccctgagatggcagtggcgccatctcagctcactgcaacttccaccttccgggctcaagtgatcctcctacttctgcctcctgagtagctgggaccacaggtacacaccaccatgcctggttgatttttgtactttttggtagagacagggtttcaccatgttgcccaggctggtctcaaactgctgagctcaggcaatccacctgcctcagcctcacaaagtgctgggattgtaggtgtgagccaccaagcctggcctaagaccttgtctcttaaaaaaaaaaatttcaaagtttccagaagcggacaaatgaatcccttttctcagccccagctcgccggctctcctgcccagagacagctgctgttagtggtttcttctaatgagttgtatgacattgagattctgtgagcctcagtttccctaactgtaaggcaggagggtagtgacatctgtgggccctgcttgctggggtggcttctcccctgcccagcctgctacagcccctccccgataggaggtgtaaagcccaggctgggcaggctgccgcccccgccaactccaagaggccttttttagctgcggcctccctggcagttgttcagaggacacaggggagactggtggcagcccagcagcggattgcagggtggtgggcaggctccagggtgacacaggcccatcgtggagaaagggagttggagaggccacagctgctttttttttttttttttttttttttaagacggagtctcactctgttgcccagacaggagtgcagtggtgccatctcggctcactgtaacctccacctcccaggttcaagcaattctcctgcctcagcctcccgagtagctgggactacaggtgcgcgccaccatgcccggctaatttttgtattttttaagtagagatggggtttcaccatgttggccaggctggtcccgaactcctgacctcatgatctgcccgcctggcctcccaaagtgttgggattacaggcatgagccaccacacccagcaactttttttttttaagagatggaatctcactatgttgcctaggctggtctcaaattcctgagctcaagtgatcctcccacctcggcctcccaaagtgctaggattataggcatgggtcactgtgcccagcctgcagctgctgtttatctcatgaggtatagctttttttttttttttttttttttttcagacagggtcatgctctgtcgcccaggctggagtgcagtggggcgatctcagctcactacaacttctgcctcgggttcaagcgattctgcctcagcctctggagtagctgggattgcaggcgcctgccaccacgcctggctaatttttgtgttcttaggagagacggggtttcaccatgttggccaggctggtttcaaactcctgacctcaggtgatccacccgcttcggcctcccaaagtgttgggattacaggagtgagccaccacgctcgaccacgtaggccttcttgaccccttatacatataggggaatccgaggctcaggctggctgtgtcagtcccctggggtattagagtaggggccagctctgcctggccctgccttagaacctggggacacagcctcagataaggcacaggaatgagtcagcagaccattcaggtggcagtgacaaggacggagatggtaacagtgggacacacctactgagggctgttttggaagcattttccatagagttagtcattcagttctcacggcgatcctgtgagactccatttcacagaggggaagaccaaggctgggaaaggtttcagtgacatggccaaagttccatctcccgtcagtggcacagccgggtgctgtgaccatgtagtaacaaccactcccagttattgagcgtgtactctgggccagaaattaaactaagcatttgaaggacatttcctttttgaggccccagagtggtccccagagagagagagagattgttctcttgcacagatggtaatgaccctggccagtacaggaagggtgcgtgctgagggcccacatggctcgggacattttactctaatcatctccttagtttcttccaatatgagcttgtgcagtcagcattgttgactgtttgacagatgaggaaactgaggttacaggaggttaggggatggcccgggatacccagccggtacatggtggctgtgggctaggacccaggggccgttgccccaaggctgtcctccagcaccctcaccacatcgtcagatggtcacaggaggtcctttagggatcagtggtgcctcaggcagggagcatttggggaaggctctgttgaagctgagttttgggtgcaaaagcaggtaagggaaccgcacatgcagaggccaagaggcaagacagagcccgtactttcggggaacgatgagggccagtatctgcctgggacccaggaccaggatgccaggatcagaagtcccatctgaattcagaccccccaagatgtagtggggaggactctggtcacgtggtcaaatgcatgggcttcacaggcctccctggtggcagctgtgcctggattggagagggtcagcaattgaaggtggtggcacgtttcagggtttcagggtttgattagtggctctggatagagcagcctccactgaggttcaggagaggtgatggtggagccacgcaggggtctcaggagaggcctgtacaatccgatggggcccagatggaggtctgagggagacagggagtgaggcggggaccaggagcctgaggagatgaggcactgttataaggagaaagaggagtgcctggggagtgacatctggggctggggtgagcgggaagcaggtagacaccaagctggggctcaggagggcatgctgggctggagacagagctaagagggccttggcagtgatcctggggcaaggttatgggtggaacaaagaaacatctagaaggggccctggtgcagtggctcatgcctgtaatcccagcactttgggaggccaaggtgggtggatcacttgaggtcaggagttcaagaccagccaacatggagaaaccccgtctctattaaaaatacaaaattacccaggcgtggtggcgcgtgcctgtaatcccagctactaaggaggctgaggcaggaaaattgcttgaacacgggaggcagaggttgcagtgagccaagatcacgccactgcactccagcctgggcgactccgtctcaaaaaaaaaaaaaaaaaaaaaaagccaggcttggtggtttgtgtgcacctgtagtcccagctacttggggttgaggcaggttgagcctgggagatcaaggctgcagtgagccattatcacaccactgcactctagtctgcatgacaacaagaccttgttcaaacaaaactgaacaaaataaaaacaaaaaaaaaaacaagcatttgctgagcccgtgctttgcaccaggccacgttcctggttctgggaacaaaatggcgaacacgttcccatatttagagagcagggcttcattcattggaggggggcagtacccaaaacgtgataaataattgtcatatgatgttagtggttgctgatgttgaggaggcagggaattccagacaggggcagcgggaagttgccatcatcaggaaggtggttggggaaggggtcctcgctaaggcaacatggagcccagatggcacgggtgccatggagtcagctgtggggggctctgaaggaaaagcattccaagtagttggaacagccagtgcgaaggccttgaggttcaagaaaaaagtgggctccgcagagtgcagtagctcccgcctgtagtcccagcactttgggaggccgagagggaaggatcgcttgaacccaggacttcaagaccagcctgggcaacatggcaaaccccatctttactgaaaatacaaaaattagctgggcgtgctggtgcacacctgtagtcccagctacttgggagactgaggtgggaggatcgcctgagcccagggaggtcgaggctgcagtatgtcatcattgggccactgcactctgacctggacgacagagtgagaccctgttttttgttttgttttgttttgttttcttaaacaaaaaaaatggcctcaagaaaaggtgagaaaagtgaggggctggtgtagctggaaggaagagttaccaggggaggtgccgaggcagattgtgtagggcccatgtaggctgtggtgacaacttgggttctgctgtgagatgggagccgccagggttctgagcagaggacggagggacctgaccccacttgggtgtgcgctggcacctgtgggcgcaggggcggaagctgggagaccagggcacgggaggtggacgcgtactttttcctggggccatctccggtgcagggattgggtatggggcgggggtaagggacagacgactccccagagttgataggccgtccctgcccgcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaaggtgtgcggggcgggcggggcgggcagtgcgcatgcgcagccagagagcctgcaaccaggacgcatgcgcacccaatgcctggtcaggggaggaccccggtggtgtagttgaagagtgtggtggggggcggggagctgagggatggacgggggccacgtgggaggggggacaggcttggggggccgggcggatgaaacaccccaccggtcccctcctctgatctgccccaaggcccatgcccacgctcccgccaccttgatgctcatggcttcgtcaccacctccgccgtggatgggatgggcgctgcgaccacggcccgcccggccgcgctcgaggcgctccgcagccttgccccagcccactccccctctcaccctaccacagagcatggtaaataccaagcccgagaagacggaggaggactcagaggaggtgagggagcagaaacacaagaccttcgtggaaaaatacgagaaacagatcaagcactttggtgagtggggcttgtgggttatggggggcaaggtcgaggcaggccctttgcctccagggccctccagcaccttgccagcatcttcccacaggcatgcttcgccgctgggatgacagccaaaagtacctgtcagacaacgtccacctggtgtgcgaggagacagccaattacctggtcatttggtgcattgacctagaggtggaggaggtgagtggagctttccccgggactgtgaaaaggcgctgccatgaggccgccacttggtgacgctgtgcctgttcttcctggcagaaatgtgcactcatggagcaggtggcccaccagacaatcgtcatgcaatttatcctggagctggccaagagcctaaaggtggacccccgggcctgcttccggcagttcttcactaagattaaggtagggtccctgagctgccaggtggctggaggccccctccccagggaaccagcccacaatgctctaggtaaggccgactcctctccactgggactcaagcccctccagtcaccgcatcctagatcaggagagggtggggccagggaggaggagagaagtgggcagattctgccagactttaaaagtggaggccgggcgcagtggctcacgcctgtaatcccagcactttgggaggctgaggtgggcagatcacctgaggttggaagtttgagaccagcctaacatggagaaacctcatctctactgaaaatacaaaattagccgggcatggtggtgtgtgcctgtaatcccagctactcggggggctgaggcaggagaatcgcttgaacctgggaggcagaggttgctgtgagccgagatcgtgccattgcacttcagcctaggcaacaagagcgaaattccatctcaaaaataaataaataaataaattaattaattaaataaaagtggaggtcaggccaggcttggtgactgagtactatagtcccaactatttgggaggctgaggcaggaggatcacttgagctcaggagtttgagctgtggtttgccactgcactgcagcctgggtgacagagcaaaactgcattacaaaaaaatgtgggagcagtaggatgtgctgaaggtacccaggtgaatatgtgggtaaaggacaaaggtgagggtgcctctagggttttgggttttagttcatttttgagacagagtcttgctctgtcaccaaggctggaatgcagtggcgtgatctcagctcactgcaacccctgcctcccgggttcaagcaattctagtgcttcagcctcccaagtagctgggattacaggtgcctgccagcctcagggtttttttgttgttgttgttttgttttttttgagatggagtctcactctgttgcccaggctggagtgcagtagcacgatctcggctcactgcaacctccgcctcctgggttcaagcgatcctccagcctcaacctcctgagtagctgggactacaggcatgtgccaccatgcccggttaattttttgtattttagtagagacggggtttcaccgtgttagccaggatgttttcgaactcctgacctcgtgatccgcccgcctcggcctcccaaagtgctgggattacaggcgtgagccaccgcgcccggcctagcctctaggatttttaacctgcgtacctggaggaacagggctatccttaccgagattagggagaccaaggacaaggcaggctgggaggtggccatgttgagttagaggtgcccatgcagggacactgaggacatgagtgtctcagatctgcagtagagcagggctcccaagcaggtggtctttggcaaatgccagatgaggtccccggcgggggagcccaggccttggggagcccttcatgtaggtcaggaatagacttggggaaccgtggggcgcctctgaggagctgtggctggagggtcctgggccccccagtccctcctgagcgttgggccaggtccagtgagcactgcccaacccccatagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggtggggctccccggcccaggcgggcagcaggaagaccctgagcgggaccccccagggccacagggacccagcccctgaccccagcccctctgtacccccaggaactccagaagtgcttcgatgtgaaggacgtgcagatgctgcaggacgccatcagcaagatggaccccaccgtgagtaacccccgcgccccatgccttcccggcgggccgtgtgtctcccccagccctgtgtcccaagtctctgaagccggctggtgaaagtgcccctccaaggcttctccaaggagtaaggggggtcgtgtcaccttggcacacacccacatatattgagcacctactgtatcccagtatccagcagataaatgctgagctttgagcgcatgtccttcgtgactgtcactgttactgtgactgagtccagcctcagtttccttatccaaaccacattttctctcaatatcagctcacaaaatgcgtgggaaagggaggtgagcacatggcaggggctggtaaacgctggctgttaattggattttgtctacttgtttttgagagacagggtcttcctctctcacccaggctgcagtctcgacctcccaggctcaagtgatcctcccacctcagcctccccaagtagctggggttacaggctgacaccatgacatctagctaatttttttttaaattatgtttttataaagacaaggtctcactggctatatttttggaagtggtaatagacgttgaatctaagtaggacactgtttgatcctattcctaccacttggctcactggttgatcacactggttttctcgtctgtaaaatgggtctagctgcaggactggccctgagtttctagaagcttctatgggcatagccatctagaccaggttctgcaaaccgcagctcccagactcactgcctgtctttataataaagttttattagaacaaagaagccacactcaattgtttccctatcatctacaaccgatcttgctctaccacagcagagttgagtcgtgatggagaccatatggctcacggaaccagaaatatttagtctgtccctttaccaaaaaaaaatttgctggcttttgttctagattgcactatctaaatttaaattaaagttaaataaaatttaaatttccagctgggtacggtggctcacgcctgtaatctcagtgctttgggaggccaaggcaggcagatcacctaagggcaggagttcaagaccagcctggccaacatggcaaaaccccatctctactaaaagtaaaattagccaggcatggtgacaggcgtcggtaaccccagctacttgggaggctgaggcaggagaatcacttgaacctgggaggtggaggttgcagtgaaccgagattgcaccactgcactccagcctgggtgacagagtgagactccgtctcaaataggtaaaatatcaataggcaggaagccagcttggggatgtgcaagggacaacggggacaacggggaccaccggctggcggccccacctcatctgcctgccttctcctcacaggacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctctctgggctgctgggagggccgttcaggcagcccatctcttgtaggtgggagggaaacttggtgggatattgggggctgagctgtgcttctctggtcctttgcccaccagccatcgtgggtcctcgcctcacacatgctgttccacaacttggaacagtcttcttccagaggcctcaaaagcccccaaccttcagtctcacccacccactcccttgtccctacttggacctccagaatgcagggtggcccaagctgatcaccaccagagggcagtagtgatctgcaaaccaagtcacattccctagggttttgtggatctggcgcacctgcccgcaccccacacctttccagcttcctacaaccttttggagcagcatcctggatggactatatctccccaccctatggccagcgctgcccccaaacagatttttttttttttttttttttgagagtccagctatcacccaggctggagtgcggtggtggaatctcggatcactacaacctccacctcccaggttcaagtgattctcctgcctcagcctcctgctgggattataggcacccgccaccacactcggctaattttttgtgtttttagtagacatggggtttcaccatattggccacactagtcttgaactcctgacctcaggtgatcctcccactttggcctcccaaagtgctgggattacaggtgtgagccgctgcacttggccccacccccccaaacattcttgattctgaccactgccttttgtccctatggccttcaggtccccatcgcctctggctctaattcctgccccagcctcctcctcattccccactacaagtcagcccctgaacaggcagcagccagagggtacctgtgaacacccaggtcagggcatgtcccacctctgctcaaaagcctcgcaggactcccctccctgggagcagaagccgaagtcctccctgcaactgaccaggcccccagcaccatctgcctgttgcctcgctgccctgttgtccccaactccatgctggcccttgagcacttgaaatttctcttcgtgtggctttgggtgatgcgctgagcctcagtgtccctgctcttagggctaacgtcgtcgcgctagtgccctcctcaggccgtagtgagggggacaagtgaggtaatggttcagacaactggcacctggcactcagattctctgaacggggaccttggcacttgctggccgtcttcaaaagtcacaaaatatttctgccacaggaaaagtcttaaagaagagtgcacggccaggcgtggctcacacctgtaatcccaacactttgggagactgaggcaggaggatcacttgagcccaggagttcaagaccagcctggctaacatggtgaaacccagtctgcactaaaaacacaaaaattagccaggtatggtggcacgtgcctgtagtcccagctactcaggaagctgaggcaggagaactgcttgaacctgagaggtggaggttgcagtgagccaggatcacgccactgcgctccaacctgggtgacaaagacttatctcaaaaacaacaacaacaacaaaaaaaaaaaacagtgctgggcgcagtggggcgcacctgtagttacagatacttgggaggctaaggcaggaggattgcttgagcccgggaggtcaaggctgcagtgagctaagatcaaagtacaataaatacccaggttcacatcagtttaagacatgaaatacctccgatccagtagacttatgcctacctctcctgggggacatcatctctgaggggactgcttgtcactcagaccacagatcaatgccacttctctgaggccctccttgacctactttaattcccctcatgctcagccaccaaacctgcctcacatgcctttcttcacacagacctgtgtattgtcacctcccatgtactgtgggtgccaccagagcacggactttttcttgcaacatacacagtgccagaaaggggacc

SEQ ID NO: 15506 - DNA, 6330 bp, Human
acctcttcagggaggccctccctgcctttgcgtttctttttcttttcttttcttttcttttttttttttttttgagacagagtctcactctgttgcccaggctggagtacaatggcgcgatctcggctcctgcgacctccgcctcctgggttcaagcgattctcctgtctcagcctcctgagtagctgggattacaggtgcgtgccaccaggcgcagctaatttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttatatttttggtagagacggggtttcaccatgttggtcaggctggtcttgaactcctgacctcgtgatccgcccacctcagcctcccagagtgctgggattacaggtgtgagccaccgcgcccggctttttgcctttccgtttcaatggctcatctggtcagtcctctaccactgtaaaaagatttaactattggcggagagcaggagctcacgcctgtaatcccagcacttttggaggccaaggcagaaggatccgttgagcccaggaattcgggaccagcctgggcaacaaagcaagaaccccaacataaaaaaaaaatctgtatttaaaagcaaaacacaaataacaaacaaaaaacaccagcctgggcaacatagtgaaacctcatatctactaaaaacacaaattagccgggcgtggtggtgcgccctgtagtcccagctactcgggaggctgaggcaggaggatcacttgagcccgggaagtcgaggctgcagtgagctgtgatcgcgccactgcacgccggcccgggtgacaggagtgagaccctgactcaaaaataaatacatatataaataaaaattaactattgtctctggccccagaccataggtgtccctgcagcaggggccgactggcgtgctctccactcgggcccctctaggaggtgctaagtaaatatttgaacgaagacctctgagtccctgtctggctgcgactatgtcctctcaggccttcccacgtggcagctgcaggctcctttcctgctggctcagtctgagcccggcagggtgatcccttcctcatccactccgtctctccgtttccctttcttcacggtgcttgacactatctaatattatttggttgtttgaatgtgcgcgtccagctcccaggacgctccctgcacacagtgaatgaataaatgaatgaaataaagcgcccagctcgtagtaagggccaacgaatgtctattagtagtggaacctcggattgggtggctccagccctgcctcccttccctcaggaggcgccgaggtcccagagcagcccgcgcgaccctgcccctgacctttctccctgggtcagttaaaccagccttctttcccgcctgccgggttcatttgaaaaccgaaaaccccgccattgccggcggtccaccggttgccacactctgaccaatcaggagcgacgcgtttcacgccgagcccgaagtttccccggcgacgcgcagccactggttatgcaggccctgtgggcggaacgccgtaaggtcgcgcgccgggcaacgcggtgccgctacacagtagcgagtttgtaagaaaacaaatcagttgcgttcggggcgtggccgggagcacgttggctccgccccctggcggctgcctcagcggcggcggcggcgcaggctcagagcagaccccgcccggcgaggaggagggagggtgagttagggggagacccggcccccaaggggcgggcgccgggcagggccccgcgggcggccgagggttgggcccggctcccagcccctcgccgtcctccggctgacagggggaggagcccgccgggagggccggggtctcgggctggggagccgggacgggagagcagcgcagccgggtgcaccgcggccgcgccccgggagggctgttcgggccagcgcccgccggctgctccgcgctgacagcgccgggctggggcggggcggggggctttgcaggccgccagtgtcgacatgctgctggaggaggttcgcgccggcgaccggctgagtggggcggcggcccggggcgacgtgcaggaggtgcgccgccttctgcaccgcgagctggtgcatcccgacgccctcaaccgcttcggcaagacggcgctgcaggtgaggccgggccggtccaggttggggcggggcggctaagcgggatgaggatcgagaccccagagctcctctctggtctcctggccctggtggtgacccactgggaaccggtccttcttctctaggctttcattgttcccccacagtcccccttcgaaggtgggtggtgggtgaggctaggttgtggggggaggggagagctttttagcatcttctctgggaggattcctggttctctgagtgccggggattcactttccctggggaggttcttattccgtgggtgcgggttcagctcctttggatgccgtttccatggggacggctcacgtttcttggggcttctgtggggagatccgatctctggaaggagaggtcctgtctctaggggttcctcattttgtagggggctctctgagacaaatctggttacttgggggtggggtcttcattcctaaaggttatgcggatccttgatatagtatgggggccccaatggaggaacaatgtcagattgcaagacatccctatattccctgggagacattttacaggggagtctcgtttctcttttattattacttttggaatcccgcttcttgaaaggagctctcaggtactctgaggtgacatcaccattatgtaggaggaggctatttcctggagaaggggttcgctttcctttgacatcttttttcccttatgaggactatcaattctttgggggtagttctccatctctgggggcccatttcctggaggggattttctgtttcctggtgattgcccatatctgggggcgtctttggtcccttgggggagagtcttaggttccttgaaagtttccatggggggctgttctctgggttggggggtctcattcttaagggagtgaccagcttttggggggggtccctattcccagaagaactttcctgggggcttatgcagcttctccgttcactagaggacccctcctctagcatttcctgtttctgggagatgcctctttctggatgacccttctctttccagtgaccccttttgtggaacctcctcccttgaggacctcctgatcctctgtccctcacacaggtcatgatgtttggcagcaccgccatcgccctggagctgctgaagcaaggtgccagccccaatgtccaggacacctccggtaccagtccagtccatgacgcagcccgcactggattcctggacaccctgaaggtcctagtggagcacggggctgatgtcaacgtgcctgatggcaccggggcacttccaatccatctggcagttcaagagggtcacactgctgtggtcagctttctggcagctgaatctgatctccatcgcagggacgccaggggtctcacacccttggagctggcactgcagagaggggctcaggacctcgtggacatcctgcagggccacatggtggccccgctgtgatctggggtcaccctctccagcaagagaaccccgtggggttatgtatcagaagagaggggaagaaacactttctcttcttgtttctcctgcccactgctgcagtaggggaggagcacagtttgtggcttataggtgttggttttgggggtgtgagtgtttgggggacgtttctcatttgtttttctcactccttttggtgtgttggacagagaagggctcctgcaggccacagccacctaaacggttcagtttcttctgcgcctcaggctgctggggcctcagacgagacccaagggcagagcatttaagagtgaagtcatgacctccagggagcctagaagctggtggccttggccggctgtgctcagagacctgaagtgtgcacgttgcttcaggcatggggggtggggggagcgtcccaaatcaataagaaggtagaatgagttatgagttattcatattctgttggaagcttgttttccagtctcttgtacagcgttttaaaagaaatggattctatttattatgctttattggaaaaaatgttgtaataatttaatgtttttacccattaaattaagacttgtgcatgatcacagcacgggtggcttctgatttttgagtctgggatggagagttacacatcccggatgttgatggggatgaggacgggggtcgcggatcgtggatgtggtgggtgaggggagagaatagtaattcccagggcgccagggtgagtgagctgggtggggcagcggttttcgctgtcggaacggaagggaagcaggaaaccgcgagtggagaaagggcccccagatgtcagctgggtgcccggagcacagggggtggggcgggtgggcggtggccgcggccttccccgcaggggcgtagccgtgggcggtgactgcggtgatgaggcgaaagggatcccggaaaagccaggggcggggttagcagcggtacgcctcgtttacaagtggatgcgggcgggactgagggcggccccgccccgtccagggcttcctcaatgcgcgtgcgcaatgggccacagagccgccatgccggaaccgcgcgggtcgtcgcagctgcgggtgaacgcggcgtttgccgcgcggtacaaccgctaccgggagcgcgaggaactgcagcggcgtgagtgcggggcgcatgcgcgcgggagcctgcgcgcgccggccggttgggaagtggggagtcgagtggccccgccggctgacctgggggggggggcatcccgtctgtgtcccgcagtgaaggatcgctacggggaccgagacagcagcagcgactccagttccgagtcggactcaagcgacgagcgcgtggtgcgcgtccccgccccgtcctggacgtgcggaggcgtccaagcccccctctgcaccccgaccccgatgtagacgggggggaacccccaaccccagagcgccctgcgggagcgtcccatcctccgctccccatcccatgagggacagacagtgccccccctctccccaggggagccaaatccccgttattttctctcccctgccacgatccccacctgcccactctgatgtgtggggcgactctgtcccccaagaaccccccctttcctctttcatcctcaagagtctagccattttttagtgtactccttgcgccacgtggggcgcccaacttctcacatcagccctgatcctggccccactgtgcggcctggcccagcccctccccgctgtctctcttgtgccctcagcccacctgccccttgtcaagtctttgtcttccccaggaattaccttctccttgcccctcaccttcctctacccatatcctgtacctacctgtggcctgcccctgcccaccccaagagggcccctctccctcctgctgtttgaccacctgtttgacctccccagccagatccacccccctccatcctaatccctacgctgagctcacctgctggcgccagggctcttattatctcccttctgaaatctatccccaacccttttcctgccctaggaatttgatccccagcaggagcgggacttttacaaaacgctctccttgttgaagaagaaggacccccgcatttatcagaaagatgccaccttctataacagaacaggtccggggccactcctgtctaaacctctccttcctctggagcagaatccggggtcctttcctgactgtggattcagagaagtgacttgacttctctgagcctcttttcctgtctgtaaagtatatctaacggtagcatctcccctcagggctgttttaaggatagattgggatttacccagtttacacagttcatctgttttgactattgaatgaattgcttcacaagtcacaagtccttagcagagcctaggttattacctggtggtggggttaatgactgtgtccttggcactattcaaggtgggaattgctgactgaatgattccaactccaccaggctgggcaggtggttcaagcatctaatcccagcactttgggaggctgaggtgggagggtcaattgaggccaggagtttgagaccagtttggccaacatagcaagaccccatttctcttttttttt

SEQ ID NO: 15507 - DNA, 134987 bp, Human; identical to SEQ ID NO: 15348

SEQ ID NO: 15508 - DNA, 134987 bp, Human; identical to SEQ ID NO: 15348

SEQ ID NO: 15509 - DNA, 134987 bp, Human; identical to SEQ ID NO: 15348

SEQ ID NO: 15510 - DNA, 16004 bp, Human
atgtttattccccttcctgaccatctcacccctcctcctgacccctgtttgtgagtttgatttgccagaggctctgggctgaaagcgggtgatgtacaggacttgtgatggagcaggtgtggttgctgtcatcagacccagctacataatttgcagggcccagggcacagtgaacctggagagcccctcgttcagctctgcattacacttctggacttagggcctcatgtgactgcaggggtcgtgtgcctgccttgctgaccatgcctgtcataccttctacatgcgctggacctgctcggagagtctcggggcatcttcagagcaccccagctctccccatgctacaggaaagaaaagcttacaccttgggtgccttttcacccagattcagggaccagggcccaggacatcacagctcaggcatcagaggccaagcacaaggggccctcccctctccaggcttgtttctcatgctgtagaatgtgctgttggacttcacagtacctggatcataactatgggtacctggagggaggggcacgatatctcttaccacacaattttgtgagttcttagctttttctttagaagaagccaaaaaccggccgctttggtagatgccacctgatgacctggcaagggcagctgtgtctgggtttcttcctcacaaggaagtcagggaggccagagggttgacatgggaggaagaaaggccccctcttggcaattctctttccactccttttatgcccagaggttgggaggcctcgctcccacccccaccgccagctcaagcttggggacttctcccaggatggccaccccaccccgccttctgatgactgatggacactaatggtttccatgagcgacttgccaaacaaataagagacacatcagtaggtagagccccggggccacactttgcctcagtgaccactttttggggaacaaggactgaaacttctgggctgacgaagcagctctccagccttgctctccactccgacagtcatgcggggattccatggccacctcagcgcttccgggaatggtcatggaagcttctggaagtcaggaggcagccactgtgacttccccttgcccacgtggcacgcttggaatgtggtgagtgccactgagtatggagagagtcaggcaagctcatctgtgggccctgtgccaagggcccccagcaggggcctgtcaggtcgcagcccagaatgccgggccctgttcttaccagagaagaaggccatggtgtgggcccaagggccatgacaaacagaggggccgcagggagcgagaagccctcccccagttacaaaaccacgtcctggggggccacttctgcttttggttcctcatttgactaagaagagtttcgttagcagaaaaccttttcaaggcgtctttggaagtcacattggataactcctgatgcctgcgccaagtggaatcttcctttggggcattttctagaaggatccctccttccttctctgcaaaagggaaccgtccccccgaaagggcctgggcctttgggaaaaggggtttagaaagccaggcgcggggacccttctttgggggcggtggccgcatcccaggatcccttcctaggggaggcctgggcccagatgtgaggctgggggcctctccccagggctcagggccccaggaatgcagggccaagggggcccatgagcctgcggccccccaccccgaagccaggaaccccggcaaatgagtccagccggacagtcccgcgctcagggcggcggccggcggcggggtcaggcttggggtctgcccggcgacctcgcgcctggcccgcgagttcaggtgccccggagccagggagggagcggggcgcggagccgggcggggagggcaggggtcaccgggcggggcaggagcagcgatgggacagccccgccccgggggagtgtcccggcctggccgccgcagccttaagggccgggcggggcaggggcccaaagtgcggggtcggccgggtgctgggccgaggccgaggccggggcgggatccagagcgggagccggcgcgggatctgggactcggagcgggatccggagcgggacccaggagccggcgcggggccatggcgaggcgcgggccagggtggcggccgcttctgctgctcgtgctgctggcgggcgcggcgcagggcggcctctacttccgccggggacagacctgctaccggcctctgcggggggacgggctggctccgctggggcgcaggtgggcaccggcggggaggcagccctggggggacgggaggcccatcgcccgggccaggcgcgcgctctgcctcctgggggccctgcgtcgccaacaggccttggaaggtcagatccagccgcttcgttttgggggtcgctccttctcttccacatccagggtgagccctgatgtttgtggggttggacaagccccacctggccagaaagccaggccagccccacctcctcggcctctgggggtggcccttacggcgcggcatggctgggggagcaacccggttccctcctttcgggggtgccctgcctccttcacattctgagagcgctggagcctcctagtgtgaggtgggcccacacctggctcacctctggtgattgtggccccactcccatgccctcaggtgttgggaaaggcgggagggccctaccgagggcttcctgggcccacggcccccgggagccccagcaccgatctgggtggggatgatctcttctcagcacatacccccggcctcatgagtacctgtccccagcggatctgcccaagagctgggactggcgcaatgtggatggtgtcaactatgccagcatcacccggaaccagcacatcccccaatactgcggctcctgctgggcccacgccagcaccagcgctatggcgggtgagtggccgccctttgactgtgggccaggaaagcccatcccggctgcctgtttataggcccaggcagctcagcccgcggttccaggggcctgtgattcaaggccaggtcagcctgggctggggtgctaaggccgaggagcgcgggcctttgccctctgctgaggtgacccaagctgggtcattctggggcttttgggtgacaggcaggactaggactgaatcccagtgacaagtggctgccaggtgccctctctcccccaaagcttgtgacctcagccattgggatagaaacagaaatgcaaaatcactgagtccccaggctgtatttgaggatacagaagtaaactgcttctcagcacagatgaaagcctgtcctgggcttggaatattgggtgaggctagttggctacagcccatggcctaacctggtcactacctccagcctggtgggtttctatcttaggcttttggcaggagtagggtagggaggctcttagcaaagaggaaggggaaactaaggccctccctatcaacgaggctgctgcaccctgctttgggagagaaggcgggagaagggacagctgcaaaccagccccaggcccaccccacagcatttggaagggactctgctatcccctctccagtcacagcacagggtccaggagcctggatttcccctggagatgggacttgcgtggcctgggagtttggcccatgagcactgtggtgctgttgcctcttccctggccttggtcctcatgggtcaggcctgctgtacacccatgtgaaaaggatagactacagtgtggctgccgctgtgggccaaggctgggggacatgcgtttgcgtgtgctccatctcactgacgcctcctcaatgccatgattgcttccagtttgcagatgaggaagcaggctttttgcagagagatggggaggcttgagcatagtgtgagtgacagctgagatttgagcccggaagcctgggctttgtgccaggatgtctgatgggctcagtcttgtgaatgaggggttcttgctctgggggtagggtctggaccccagagccagccagctgaagctgtggcatccgtggcgtctcccccgggggctggaacacacttctgatcgttcaaaggtccctttgatgtggatggagctggaaggtctgggagaccttgggcgggctgcagggtgtgggtggggctagaggcagaggactgggcagagtctaggggaagtgtccaggcctggcacccgctgaggaagtgaaagagcctttgagggtggggtgagggtgaggggaggatagaaaggtcaacaggtgcctgtgggaagccttgaactctttgagagggagtcaggtgacaagatgtgcgtctgtgaaggactgcgggtagaaaggagatggctttcagatggatgcgggaccctggccaggggtcagccctgccgcatttccccaggggactctctctgggcggatgactgcttcaccccactttctcctgaaacctccttctcagcgcacccaggcccaggcactcgcttcctctttcactgaggaatagaagccaccagaaggggacttccacggggccctggccatttgccagccaaggcagcaggtcctccatttgtcttccctcctctcccccaggatcaactgtcttgtcccctcactgagcccgtcccttcccactcagggaagctctcccacctggaaaaaaggaacacaaagcccccggccccaccccgccccaattctgggctccctagggaagtatctggagtccctccacttcctcttctctacccttgaacccactccagcctcagtcccacctctgccactccaccggcactgttctttccactgccacctggggcccaccgtgaagcattctcctgatcacgtctccccaggatgcttccttctcctgcaccatactgcccgcctccacctccctggccactccttcccctctccccagctgtctgctcctcagagttctgagtgtcagcttccccaggaccaacccttcacctgaactcagcttgacatccacctgcccactcgcccgctgtcccggtcacctgacacctccagcctcagaccttcaggtctggatggctccttccactactgtcacctgacagcccatttcttccccagtcctccctggctgtccttccggctatgcaggcaaaagcctggactggtacccgactcctctgttttctgtccctcatataatccacccacaagtcttgtcggttctaccttcgaagcagatgcagaaatcacgcaccgcccaccgcctcctccaggtctaagccacaccgccccactgccgactgccctcactggtctcctggcctctgcccctgaggccacagtgagcctgtgacaacccatcagaacatgttctttggcttgaaaccctctcaggattccactcagataaaagacagaaccctctggccttcaagagccttcaccatcgggctccctcccagtccccccttgctcccctgctcctgcggagagtggagcagggaggtagcttctcccaccaggcacctcctctctccctgaggtcccatggctccctccctccctcctatggatgtcacctcagcggggtcttcctcagccaccctatgcatatgacaccccacttcctgaattatctcccggatttatttttcttcatggtgctgtagactttgcacagttacagatgctccttgacttaaccgtggggtcatgtcccgacaaccccctcgtaagttgaaaacaccatgagtggaaaatgtgtttgacacacccagcctcctgcacaccctggcctggctttgtctgcgttaaacgtattcaggacacttgtgttagcccacagtgtgagtaataagcccgttcccagatggggctggtgggatgaaggattgagtttggccgtgggagaagcttgtgcatacctcagtgagctggttaggccgggtccagatgcttcaggcaggagtagacggagaggccagaaccgaaactgctcatccatccgagctctgcctctgggccaggactgctgtcgccgggttgggttgggcatagaaggatagggctcgggggcaggccatgggacgccctgcactgccaagtggaactccagaagcccaggcaggaggtgcttccagaaggatggagcgaccgctgtgctgactgctgccggagagtggtcagctcggatgacagtggagaagtgacctttagcaagagagaaagggctgaagaggagcggggcagtaggggtcggggcactgtctcaaaccattgagtgaagcagaaaaccgtgatagtgagtgggaggggccgggggcttcctctgttgttgtgagaaaggcaagtttggggtgtgcagatctgcttagagggggcatagctgacaagggagcggggagaaggaaagctggagggagccaagtccttgggaggaaacaggatggaacctagggtgggtcggtcaggtgggaggggacaaaccagccaccggctgctccaggaagagggtttggggtgcagagcatgggcaggctgggtggcggcaggatggaggtctgctttgggacttttcagtgatgcgtgaagtcaccggagcagggacagttccagaaggcccctggctgggcgaccgggaggaggccaggtggaggagcggactgtggggcagtgtgggagagtctggaaggtgacaagagatggaggggatgtgcaggtccagagggggctgccaatgggcagagggaccccctgctcattgtgccctgggggagggacaggtgaggctgcaggaagagttccgacttgaaggtggggtcaggagatgaggcctgaggcaggtgcaggggtgtgtggctgtgaaatcattgtcctgggagggcagagtgagatgaccctgaacatgggcccggatttccttctaggatctgttttattgcatttgtgcatgggaagggaagcaggtccctcggtgaccaccctgagctgtccctggctgcaccttgggatttagagcccagccacctgggcagtgagggcatggtcagccagccgctgggagccctctgcatcccccagtgccttcggggctgggtccctgctggccttccccagccctcaggaccgcatctggcccctcactggggctcatgcggctccctgggctatactcgttcacagagctgacaccttggccccctgtccacgagggcagggacggtctctcctggctggctttggggtgtggcccacttgccatgggtggctgagtctctgtccattcagcccttcattcagcaggcacttctcaggtgtctgcagggccagatgctggtgaccgcctggccctggccctgctctcatggcatttgtagcgggaggtgtggcagacaggacagtgcccaaagaaggccaggagaggcctctctgcagagcgacgtctgagcggagacctccatgaagaggtcagcagggagaaggagacacaggcagctgggcagagctgaaggcaggccaggctgggcagcgcctgcatcccgcctgaggcgtccaggtccgttcggggaagtgggtggagagtgggtgagtgctgactggcaggtgctgactgttgcagatcggatcaacatcaagaggaagggagcgtggccctccaccctcctgtccgtgcagaacgtcatcgactgcggtaacgctggctcctgtgaagggggtaatgacctgtccgtgtgggactacgcccaccagcacggcatccctgacgagacctgcaacaactaccaggccaaggaccagggtaggctgctgcccgtgcccccactccaccctcctgccctccactccctcttccacaggccttcgtggctgaggacccagcctgaccccgtgctcctcacattggctggtggctggggagctgcgggagggcagaggttgcagcccccaggggcgctggtgctcttgaccatgaggggtagtgttcccagtgccagctccagcctctcgctgcagaagccccctctgctatcttgcacccgcttgggctggggatcagaaaactggaccccgtagtccctgttgagaagcccaacgaaaaagcctgctgcaggagcggtctgaagagcatccttggccacgcgcgtggtggctcatgcctgtaatctcagcactttgggaggccgagacaggcagatcactggaggtcaggagttcaagaccagcctggccaacacggtgaaatcccgtccctaccaaaagcacaaaaattagctgggtgtggtggtgcacacctgtaatcccaggtactcgggcagctgaggcaggagcattgcttgacccgggaggcagaggttgcagtgagccaagatcgcgccactgcactctagcctgggtgacagagcaagactacggctcaaaaaaaaaaaaaaaaaaataccggccctgtccccatgtctccagcctcgtggaagagtgtcttgctcctgtgcccctttggctgggcctgaatgtggtgtttgagttctgacatgctggcattttggtggctttttgggcctttgtaggggagaggtgtagggggccttgtggagggagagttcattttccaggagctttggtggagagcaggtggggaggtgctgccccaaactggaaggagccattggcttggttcctgttctggtgacccagggcccaggtcccccacattcaggtgcggctacagccaagggggtgctgtgtggatgagcagacccaagctagcctggaatccctagagctggcacattcctttcaggctgctcccattagaaacagaaggaaagaaaagtccagaccctaatcccataattggtaggttttgtttgtttgtttgtttgtttttgagagggagttttgctcttgttgcccaggctggagtgcaatggcacgatctctgctcactgcaacctccgcctcccgggtttgagtgattctcctgcctcagcctcctgagtagctgggattacaggcatgcgccaccacgcccagctacttctgtattttttagtagagacggggtttctccatgttgttcaggctggtcttaaactcccaacctcaagtgatccacctgccttggcctcccaaaatggtgggattacaggcatgagctgctgcgcccggccataactggtagtttgttttttttttttgagacggagtctcgctctttcacccaggcaggactgcagtggcgcgatctcggctcactgcaagctccgcctcccgggttcacgccactctcctgcctcagcctccggagtagctgggactacaggcgcccgccaccgcgcccggctaattttttgtatttttagtagaggcgggatttcactgtgttaaccaggatggtcttgatctcctgacctcgtgatatgcctgcctcggcctcccaaagtgctgggattacaggtgtgagccaccgtgcccggccataactggtagttttaagccacctgactcagatctccctcacagccagagcagagagctgggaaagcccagcagctgcttgctttgctgcctccacccctgccccaggctatataggctggccccagcgccctgtgcactctgaagtggcagaaggtcctctgggcaccaccctctgccaacggggctcccttgccttgcctctcaggccttattgttcagccagaaattctcctggactggctgagtgagtccttcgagaagggggacagatggaaggtgcagagggaagggctatcagatggctctggaagcaggaagcaggtatcaggtggtctccagggccacgcccactccacgccaaagtgctctcgcccagccgaggccaggcccctccaacccacccagcctgacaggagcagatggagctcatcagaaacctgattgtgtgactggtgaccgcggtggctcacacctgtaatcccagcactttgggaggctgaggcgggcggatcacttgagaccaggagttcgagaccagactggccaacatggtaaaaccctgtccctactaaaaatacaaaaaatagccgagcgcggtggcatgcgcctgtaatcccagctactcaggaggctaaggcaggagaatcacttgaacccaggaggcagaagttgcagtgagccaggatcataccactgaactccagcctgggtgacagagtgagactctgtctccaaaaaaaaaagaaaagaaaagaataaaaaaacctgattgcgataaatagtcatctttgtagtgttagcaaaagtgtggccacacatccaccattttcccgtagtactgggcactgggcacttggtgtgcaaggaacaaattgaaccagtgtctgagcctcaaggtgctcatgttcctgggggaggaatcccgacagatgtgtaactatgacagacaggtcgcgccaaagcagcgaatggcaggccgagggccgccgtgtggatggagtgaaaagtgggaacacagtgactctgagccttgcaaaaccgagagctgtactttttcttttttttaaattaatttataaaattttttttctgtagagatgaggtctcgctctgttgtccaggctggtctcagactcctggtatcaagccatcttcctgcctcggcctcccgaagtgctgggattacaggtgtgagccaccacgcctgtcctttctttctttctttctttctttctttttttttttttttgagacggagtctcgctcttgtcgctcaggctggagtgcaatggcgcgatcctggctcactgcaacctctgcctcccgggttcaagcgattctcctgcctcagcctccactgagtagctgggattacaggcatccaccaccacacccagctaatttttgtactttattagtagagacaggggtttcaccatgttggccaggctggtctcaaactcctgacctcaggtgatccacccacctcggcctcccaaagagctgggattacaggcgcctggccctctttattttattttttaagcctaattcttgataacctcttaagtcgaaataaccagaatttttttttttggtcccctcagcgtgggcacagaagaaaatgcttttttgtggttgttgttacccaaagtattggcctatttattcaccagccagcaatagagacattttattaagtgctaatcatttgattatgctccattttcagctagaaagtattgtggaaaggtccttctccagccattagaggaaaaaggcgaactcctgggtgcctactatgtgctaattaatgtctgtctcttttcttctctgccaaggcctggggaagggcttttcataactccctggcagctgaaagaagagcgtcattaagcagcacctaatagcaagatgatttccgttcttagctgctgagtggtaggctgcatgatgagagtggagagtgggcttggcgggcttctttgtcagtgggttgatgaggagacggcctcatgctgacttttcttgctctcccccagagtgtgacaagtttaaccaatgtgggacatgcaatgaattcaaagagtgccacgccatccggaactacaccctctggagggtgggagactacggctccctctctgggagggagaagatgatggcagaaatctacgcaaatggtcccatcaggtgaggagaggtcccgcgggcaaagagaggtttgcgggtgaggaaaggtcccgcgggtgaggaaaggtcccgcgggtgaggagagatccgcggtgacagcgccagtgtgggctcatgtcggtgctcatgtaggcatctccgtccttcgccactttccttctggccggttgtactcagtaggctcgagacagccacatcatttcccctctaagaacttcagttttctcagagttaacactcagctgatagcaagtctgcccctatggatggttgtgcggaatgcggatgagacgctccaagctgtaccgagggggcagtttcagcagggaagacactatgtgaataacaacagaagtttatccagaaccgtcagatatacactacctgagtcgggtttacactttgttgtcataccagatttttttttttttttttttttgaaacacagtctcactctgtcacccaggctggagtgcagtggtatgatcttcgctcactgcagccttgaccgcccgggctcaagctatcctcccgcctcagccccctccaccgagtagctgggactactggcgcacaccaccacacccagctaatttttgtattttctgtagaggtggggtttcgccatcttgcccaggctggtcttgaattcctggactcaagcgatccacctgcctcggcctcccaaagtgctggaattacaggcgtgagccacggcgcccagccatatcagattatttctaatgacggtaaattctctcaatttaaaagtggtaattctttaactgcttgctctcagctgtggaataatggcaacagaaagactggctaactacaccggaggcatctatgccgaataccaggacaccacatatataaaccatgtcgtttccgtggctgggtggggcatcagtgatgggactgagtactggattgtccggaattcatggggtgaaccatgggtaagatgttttcattttcttaaggtcattcctagaaaaaaacgtcctggtactcctctcgcttgaatggttctgtttacgtttagctaaaaactggggccttgacagagggttccttgctccagctgtctcagccaccgcgcgagtggcttttggggccagacccttctctgacatgcgcggctgccgccatcctgtgcactttgggtgttcagcagcatccctggcccctccacccactaggtgactccccgcaatcccagtgtgaccaaaaccgtctccagatggtgcctggtgccctggggaagtccctgtgagcactgctggagaggggctctgccaccctcttcctttacaaccagctcattctttttcccatcatggtttttgggctcccctaaaatactgtgtcggtttttcaaaaatactcgagttgggccaaaaatccaggagagagaaattaactgccagacctagtcttagccattaataatttaagacacagaaattcatgattaagaaatggggggaaagcggttcatgtgcaggtgatgaaatgtcgtcattttttactaggtgactaatgggggtagtagtagctggaggaggcaccagtctagagtcaacatgttttgtgagatgaattcacttctggcatagagggccctcatgttaaacattaaccaagtgaaatgtttcacaaaaggtatttcagaacaggggtcatgggaaagctgaggggcagctgagtgggctgtctggatcccccaaggctggcctgagagatggaggcagaaagcagggggcagggggctgacggcagcaaggggagcgggagacggctgcagatgggctgacgcgcgatcccacttctcacagggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggtactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatgaataaagtatctggctctgcacgagaccgaggctgcccgtgccttattcgcacacaaaaacaatgtcacatcaggacttaatccaacccagcagaaaggctttttaaaaatttacttattacttgttcttagcaaattaagacaattacaataaaacatcagctaactgggttcttgtgagaaaactgaggtcagcttggaaaggagttccccgagtggagttcccagcggcccgcggctgacggccagatctgtcctgaggggtcgtgggagcccagcgcctgccttgagggaaatgaacactgaaaacaggatttgggagcagtattggattgacagcagagaagggactgtttgtaagggcagtttctcactgaagctgctaccattttcctttgtaaagaagtcatccacctcctcccagcggtgcccattttcaagacgctgcccgagcctcttaaaacagcttcttgaaagggtttttccacaacgggttctggaatgttctgcttcagctctggaggatgctctaaattagttcaccatgatgaagttagatttgcagtgagctttaacgaggaaaacagtgactgtgttagaaacaggaagtagaacatgacattttctttcttttttttttttttttttgagatgcagttttgctcttgttgcccaggatagagtgcaatggcgcgatcttggctcactgcaacctctgcctcccaggttaagcgattctcctgcctcagcctcccgagtagctaggattacaggcacgtgccaccatgcccagctaatgctgtatttttagtagagatggggtttctccatgttggtcgggctggtcttgaactcccaacctcaggtgatccacccaccttggcctcccaaagtgctgggattacaggcatgagccaccgcgcccagctgacattttctattgtagtaaagggctaggcagtcggcctcacctataaactccgtcacagggtcatgctcgccttccgttttgatggtacctgcgatgctgtcattctccaggatggggaggaaaagttgcacgaagtcagaggtataaggaggagcaatgacgtccagcacctgcgtgggggagcacagggtgacttcttccgcacactagtgcggggcatccaccgacatccgggtgaaatggccatcagtttggaaaaaatccctccccacccccaccggccggtgacaccacccatctccaacattcagatgcccagggtggtaatggaggtaaagtgtgtcatacagctgctgcaggcagaaggtgctttttggtaaacgagtatctgtcattgtcatcactacatcagaaagcacagttctcagttaggtacaaaatgaactaaattaagccaaaaagggcagtgctagtgtaaacagtatgaaacatgaaaccaacggtgcattgctgacctcagtgacaaaatagcgaatgagtgaaatgtcagtgtccagcttctccagacactttcggatgtaactgacaacaggaagtacataacctcgactcagcaggtgaaccatcctgtccagcagtgtcttcttcaactcaagctacagaagaagggggacagggagctggttagagagggtcctcctcagccctctggcaagccccacgggcactgctcacctgctccatcacgtccagctgggagtgctcagtctcaaaaagcttaacaagcagctgcaggacctgggggtgcaggagctggtggcaggtgctgatctacaaacaggccagagggagcttcgctgagcagtgtggtcacgctcagcacacagagaaactgggcactgtcacagccaccaaagagcttatcactgtggaagaaggtcctgacacctaagccagggccatcagcttccagtaacacttgactgaggttaagaaatttctgcagtcaatgaagctaggtc

SEQ ID NO: 15511 - DNA, 17864 bp, Human
aggacaaggatcaggtccaacttgttcaccgagctccagggagcagcgcagtgctgggcacttagggaacactcaataaacatttgttgaataaatgaagacatattccctgataagttctccaaaagtagtcactattatcaatcttctggagctcttttctctaatactctttccttactgacatgggcattacctttcttttttttctttatagacagggtctcactttgtcacacaggctgaaatgcaatggcacgaccatagcaatctgtaacctcaaactcctgggctgaagcaatcctcctgcctcagcctcccgagcagctaggactacaggcgtgcatcaccatacctggctgggggcgggggaagggggggggcggtgtctcgctatgttgcccaggttggtctcaaactcttgcctcaagcaatcctcccaccttggcctcccaaagtgctgggattacaggtgtgagccgcggcgctcagccacgggcgttacctttcaaagcatccagattttatggcgttaatctccctgtttaaaattttctgtgatttggacacaaagatgggaacaacagacatggggtattccaaaaggcagaaggtgtggaggggggtaaaggctgaaaaagttgccgaaaggattagaagcatcacgcaatataccaatgtaacaaacctgcacacgcaccgaatctaaaattaaaacaaaacaaaaacacaacaaccaaacaaaaacctttccgtgatcatcaggaggctgtcatattctcaccccctacttcacgctgggaatcgagctgcgggctttacaacagcgtcagctgctccctttggcaacgaccagagaggtcctttctccagagatttttgtcagctctgggcacttttgctttgtgggcctatcttccactttataaaaaattaaaaatgctactttccactgcattcagtactttttcttctcttttcttttttcttttcttttctttctttcttctttctttctttttctttttctttttttttttttttttgacacagtttcactctgttgcctaggctggagtgcagtggtgtgatcttggctcactgcaacctccacctcctgggttcaagcggttctcgtgactcagcctcttgagtagctgagactacaggcgcccgccaccatgcccagctaatttttgtgttattagtagagaaggggttttaccatgttgaccaggctggtctcgaactcctgacctcaggtgatccgcccgcctcggcctcccaaagtgttgggattacaggcgtgagccaccgtgccctgccctttttatgtatgtatttatttatttgagatagggtctcgctctgtcgctcaggctggagtgcaatggtgcgatcttggctcactgcaacctccgcctcccgggttcaagcgattctcctgcctcagtcacccgagtacctgggattacaggcgcatgccaccacgcccggctaatttttgtattttgagcagagacggggtttcaccatgttggccagactggcctcgaactcctgacctcaagtgatccgtcagcctcggtctcccaaagtgctgggattacaggcgtgagcccccacgcccggtcgcgtttagtactttttaccaaaactaaaagaaattaaaacactttcgtgggtcctggacacttccggaaggatttgtttccagctgccagatgaggaaactggggctcgcagagccggcgccgcaggggaggggctgtgcacgaatccagtgggaaacctctctccggagctaagcccctggtccacccgggcatcgctccgggatcgactgggggcgttccttccgccggtcccctttgttcccagtgccgagcccgcggccctgcccttcctccaggccccgccccttcttccaggccccgcctcccgcccgggccgaggcgcgcggccgcgcgtgcgcccgcccgcctgtccccgcctcgcgcatgcgccgcgctcgctcgcgggagggcatggcgggggccgtgccgggcgccatcatggacgaggactactacgggagcgcggccgagtggggcgacgaggctgacggcggccaggtgaggcggggcactgggcgcaccctagagagaatcgttcgtctccgccgccggcgggccggccccactcccggagaggccgcgcggcgcgaggctgcgggcgtgcggggggtgtgcgcgcgcacggcccgcgcggtcaccgtgtggttcaagcacagcccgccccgcccccgcccgcccggggtcccgcggcgcggccgccggggtccccgcctcctcgcctgcaggaccttggggtgggggtgaggcgccggaggctctggcgcggggcggcccgaggcccccagtaccccctcgctccggccaggcccggcgccggccctgcgacccccgcggcgggcgggacaccaacgctaaggtggagggttgggtccggagctcacagacttttaaacaaaaataaagtggaaaaacttcacagcagcatcatgaggaaaaagtagaacttagggcattcctacatgtgctttactgttttataaactgtactcttcagcaccttgggctgatttcatctgtttttgggcaaactgatggaaaggattttcgggccttgaccttccagggtttggggtggaagcccaggagggatcactctgttccaccctgaggacagggactgcagagccagggcaggtagctctagtctggacagtgtgtccccaccttactctaaagacccaactgaggcgcatgattgaaatgtagcttctcacgtccctcccctggagacggcccaacagttggtctggacgggagcctgggaacttgcatttttttttttttttttgtggtggagtttcgctcttgttgcccaggctggagtgtaatggcgccatcgcggctcactgcaacgtctgcctctcggattcaagcgattctcctgcctcagcctcccgaatagctgggattacaggcacccaccaccatgcccagctaatttttaaaattttgagtagagagggggtttcaccttgttggccaggctggtctcaaactcttgacctcaggtgatccacccacctctgcctcccaaagtactgggattacaggcgtgagccactgctcgtggcccaggaacttgcatttttaacaacaatcaagattggggatgtctggtgcattttgaagtggtattataagggaataaaggatgaagtggggcttacgttgataaacatgggtggtggtgtgatggcggcttcggagccatggtctaaaatgccaaggcgggcgatgtgtttctggaactgaaagaagccctgtgatgttagctgcctggtggaagcagtggcaggaggtcagtagggagcaggttctgaagatccttggagagctgctgaatggtatggcttgttcaggagtttggggcagggagtgacacgagtagatttgcatgttggatcatttcacagtgttggaggcttagggtggagtggatagagtcagacttagctaactgagagcttgggccatgtgtgtcatgcgttatccccttccacacacaggattttgagttgggtgttaccctacttatctggtaagtgtagaaaatgagacgaaaagacttagtgacctgcccaaggtcatgaaactaataaaggaaggagaggggacccaaacccacatcctttgcctccgttgccacttcgtcaaattgctgactaccaaagtggtccagatgagaaggtgtgaattagcttagtggtaggttggtgtttggggcatctagtatatcaccttgagcctttttttctttttttttttttttgagacagagtctcgcttagctgctcaggctggagtgcagtggcttgatctcagctcgctgcaaccgccatctcctgggttcaagcaattctcccgtctcagcctcctgagtagctgggattacaggcatccgccatcatgtccggctaatttttgtattttagtagagacagtgtttcaccacgttggccaggctagtcttgaactcctgacctcaggtgatccgcctgccccggcctcccaaaatgctaggattacaggcgtgagccaccgcacccggccttttttttttttttttttctttgagacggagtctcactctgtcacccaggctggagtgcagtggtgccatcttggctcactgcaacctccacctcctgggttcaagtgattctccaagtagctggaattacaggccggtgccaccacacccggctaatttttgtatttttagtagagatgtggtttcaccatgttggccaggctggtctcgaactcctggcctcaagtaatctgcccgcctccgcctctcaaagtgctgagattacaggtgtgagctaccgtgcccggcctcaccttgaggctttgagtcataaagtgttagaactggggcatataagggccatctaatcagtaccttcactttatagaccaagcacgtgagttatttgcccaagtttgtgcagtcagacctagaccccactgatgggagattggggagtctcatgtttggggaattttaatcatgatcctaatttggcccactgacaccagtgggctctcatggatgaggggggtggaccagacgttcatttcatgtttattctgtgactctgcttggaagaggtacagaaagttaggaaaggtgttaggagggtggcaagaactggattttaaaagatagttggtgacccaaattctgttcgcctgatgccatgttacatagtgggaggtaggaagatgtgtaaggaggccaccgtgatgttcagtctggatggtggaaactaagagctgcagacatgcaaatagatgagtcctgctacagattgcaaatggggagtggtgagaggtcagaacggacaggggaagtgggaagggcacgctcttgctagagctggggcgttttttcctgaaggagatgggaatctttaagcaggagagagacgtcagttttgtggcttacaaagatcactgtggccacggtgtgaaagatgattgaaaggaaggaataagactgagacttcaggggaatgttgctactgcaagcatacaaaaaataaggaagagcagaggcaaatgtggaaagaaggaccaccttggatagacagatgggagatggaactgatgagtctttgtgacaggatgtgggggtggggtgagggagagaagctgaggatgattttcaggtttggggggtaacaagtagatatatgaaggatacctttacggaaatatgggttgtaggaagaagatctgtttctagggaagagatgtcagttttggacctaaagagtttggatacttgtgagacatctgactggaaatgagaatggaatgttggatacctgagtctggagcttaagagaggaaagacggagagagagatccaggctaattctagattggtgagcaggtagatagcatgacccaagaggtggtggaagaggcaggtaggtgagtgcccagggtggaagcccaagagaacagacaacgtgggaatgaagctcggggtgaagtccggcctctgtcatgcccttaggggctcagcgttccccatgcaaatctggtctgagagaagactccacagcttttactgggaagtcatcgggttctgtctgctcccaaagcactgcttttaggatcttagtccagatcaggagtgagcaaacttttctgaaaaaggctagatagcaaatattttaggttgtgcctgtctctgtcttaactacttacctctgcccttacagggggaaagcaatcatagacagtccttaaaagaatgggtgtgctgtgttccgtaaaagtttatttgcaaaaataggagagggctggattcggctctgggtcatagtttgctgacccctggcccagctcttgccccattatgttagagtaggttgcatggaggtctgtctctcctattagtttgtgaacttctttgatggaaaaagccttgtcttgtcttacattttcttaggttccttggttgatgagcatagtgcagactgaatgttcaaaaagcatctgcttgttagttagggtggcagtgttaaagttggacagggtttgggatcacagtccatcctcacatggtcattagcaggtgaagaagcctgctttgcccttagatggagtgacaggcctgaagttgcttccacatagaattgggactggagtccagccagaagtgtggatgcaaggcgagttagtggtctttactttctaatggtaagtgatggctcacgctttcaagaatcaggttgttactcttcagtggcatgtatgaaataagaatagtgaaaacaataataataatagtttactatttattgcactgttacgaaatgtcagggattatgctgggttcttccaaaaattagctcatggaatcctcacaacagccaaatgggaataggcgttattattatcttcacttaacagaggaggaaatggacactcagagaggttgggtaacttgtgtgagcatggaacgcggtttgccagggaggagttgtacacacccactcagtgtgatcctggatcccattttcctagccactcactatctgtccagcccatttcatgaaattgtcatgaaagtcaaatgaaataatgtgtgtagaatactttcaaaatgggcagcattatacgatttaaggtgagattagggtatttgtattaatgaaaaaaatatcctggctcttcgcatttaccaacagcaggaggatgattctggagaaggagaggatgatgcggaggttcagcaagaatgcctgcataaattttccacccgggattatatcatggaaccctccatcttcaacactctgaagaggtatgtgagaaaggtgtctgtattgggaggaggctgggggtaatttagagaaagttttgtaatacacccagaaggtgctatgtaaagcaagagtaacgcgaactgaactaaaggcttcaagggggggtcccctctgccactttttttttttttttaaatttttttaagacagagtcttgctctgttgcagtggcacaatcaccgctcactgcagcttcagcctcctggaatcaagcagttctcccacctcagccttgcaagctggccaccacaggcgtctgccatcatgcctggctatttttgtttttgttttttgggagagacagggctccttacgttgccctggctgctcttgaactcctaggctcaagtgattctcccacctctgcctcccaaagtgctgggattacaggtgtgcaccactgcacccagccccctccgctgctttaaaaattttgaaacctgattctcttcctccttccttaccttcctgttgtccatcattccattcattcgggtgtaattgctgttgttactttccctaggtattttcaggcaggagggtctccagagaatgttatccagctcttatctgaaaactacaccgctgtggcccagactgtgaacctgctggccgagtggctcattcagacaggtgctttgtgggtgtcccctgtcctggctagttacccccacttttttaaaaatagacttttgggtccttataacactgatacaatgccttctttgatttcctggtttctgagacttgtgtaagaaagagctgaacttcttactcatttttatctttatcttactcatttgtatctgcttgcctcttatctttgattcagtaattgaggtttactggtagcctgcaaacgtgattctcattgagctgttttccctaccatgttgtagaattataggattatacagtgtgtgttcagtgtgtcattttcaagacgtctattacagcaagcagtaaatgacggataatttaggactggctgtgattatggcttttagttaatatgatcaaagtagagtcttactgtaaatccacggagccgggtgcagatgacatcactgaagtgcgtgctgtccggaagcttgtggacacactgctgtcccggtgattagatacaagtgtgtctcttttggctgccatctgctccctcctcactgggcagggatgtttttccatccccctacctgttgctggggccatttgtctttatcctcagtgaggctctgcagatggtgctgtcctttccatgaagttaggggtggaccagacttgtgtgttctgttctgtgctgctttttggtcttatcattgataactactttgaagagttccaaaaccttacatgtataagtggtcagaagcaattctttggtatttgattcacatagagacttttgaccatttgctttctaaagccacacagtgaatggacagcttgccattgtctagttgcttttattctctttcaggtgttgagccagtgcaggttcaggaaactgtggaaaatcacttgaagagtttgctgatcaaacattttgacccccgcaaagcagattctatttttactgaagaaggagaggtgagaaattatttttctttgcctagtaccaggccctagggtcttttgcaaattccctgtgtacagtggagcgtggcatatcatgtaagtaatggcagagttgaggactaaaatcagagtgtgagacagaagttgcatctagtcagaattgccctttaaactctgtacccagggtcgtgacatgcttgcacgcaagaggcacacaggtgctgagatcaagagaatgaacagcaagttcccaccatttcccctctcaggctgactccagggcacagcccttggagtgttgtggtggattcgtttggttcctccaagaagcagctgccaagacagggctaggcctgcaggagatgatggggaagcgactatgagggaagatggggtagggctggaggaggctggggtagctgtgatgcagtctgacccttgagggcaagagaaaaggaatgagggttagtaggaagaatgttaggctgcagtgcagtttccagaacgttccagccatatcagtggggaatctttaagccacaggtgcccattctgggagcccacgtctcctggacaggcctgcttttgaggccctgctgcattccatctgtggctgggagcagcctcggggagctggccttggcacaaacaggatggcaggttcagagcacagtccttgaggacatccgtcacataggagagctgagagaaatgtttttctggctactccatgtggtgatgggccagaacacctgtgccatttaaatggcctctttctcttttgctaagggcatacaagctggggcagcatgagctccctgtgtgtgcaaggcagctctatgcggttctcggtgtctcctaggaagcaactttcagtaccctcctgtgttgagtccgattttctaaaagctgagcgggcatctagggacctttctgtcactcagccgactgtgtggctgtggccagctctgggtctgcctcccccagaactagatgcccatggggagtccatcagcaccaatctcctgtgatcgtttatacaacagaatctccactcaagtaaaagtggggcctcctcctatcttgctgtttgtgtgtgtgttggcagaccccagcgtggctggaacagatgattgcacataccacgtggcgggaccttttttataaactggctgaagcccatccagactgtttgatgctgaacttcaccgttaaggtaggaagagttctagagttaaggagaaaagtgtttatgaatgtttatttttggttgttggtctgtttcctttgacagttcatatttgctttttttccataaaggtctttattgttttattttcataagccttacactgagaaagaaaagtgtaaaatttgtatctgtttttgggtcagtgttgactgtgttttaggatttagcagggatacaagaattctcttgtggttggagaggagctttaggcgtgcctgcttgatcttcctcttgcatatgaagaaacgatggagaggtggtcagcccagggcacacacctaggtgatagcagggtgagggcggagtgaaggcctgagacccacgaccagcgcacacttactccacctcaccatgaacactgacaagccagcttcccgtggaggtgcggtcactgcatgcctcccctctgacttcttgttttgtgtcctagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccgtaagttctttctttatgaacctcagattagaaggaggctgctttgggtcttggttttcaagcatgagatgctccttccctggagagaatctccatttctgagggcaccttccaggatgctcactcccgggcccgagcacggtggaggcttggctctcgtccgcccgtctgtgctacagtagtaaaccctgccccctctctccctgcaatcttgcagaagatggtgtgccacggggagcacacgtacctgtttgcccaggccatgatgtccgtgctggcccaggaggagcaggggggctccgctgtgcgcaggatcgcccaggaagtgcagcgctttgcccaggagaagtgagaggccctgtttctgctcagcccttccttcctagtgctccccacaaaacccttcccatggcccgtgttccacagccaaagctgctagctccttctgttcaacgtagaggtaaacttgcttttggctgggcgtggtggctcacgcctgtaatcccagcactttgggaggccgaggcggatggatcacctaaggtcaggagtttgagaccagcttgaccaacatggagaaaccccatctctggtaaacaaaaatacaaaattagccgggtgtggcggcacatgcctgtaatcccagctacttgggaggctgaggcaggagaatcgcttgaacctgggaggtggaggttgtggtcagccaagattgcaccattgcactccagcctgggcaacaagagcaaaactctgtctcaaaaaaaaaaaaaaaaattaaaaacttccttttatccagcagagctggaaaagttggagttgtttttggtatacttggagagctggctttctaaagtgctgctttgaggactgttgtgtaaagcacttgattcgtcttccctttgctggagttatgggcctgggcttttacactggggttctgaagtaacaaacaaagtcagtccagaaatagttgctcagcaatctcattgttacagtgtcgcaaaatgagctcatattagctttattttctgctaccaatagagtgttcctaagtatttaaagtgtgtgactcctttcttatagagccagcaagctgtattggaatcacttttccagtgttgtaaatgttatttttgtgggtcagtcagtatactcgtgaatgacagaaaaacagatcccaacaatgcaaagtattatatgtgtaaaaaagaacagaaaaaagaagctgccttgttagtaacgggctctatggtttttctcatcaagaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttgtaagttgcttctcaagaatccccaatgtcagctggtaaggtgactttggaaagtctgtgcttgtctgattgtctgaaggctgtgaatgcaaatccatcattgtcctggtccttcctcagtcacactctctgcctggagcctgttgggcccctgctgtgtagggaaccctgaggggaggtgggtgagcagtgccctcacgcctgccatcccgaactgggcatatgcttctcctcagatccgcgttccagccttcctggacctgttcatgcagtcactctttaaaccaggggctcggatcaaccaggaccacaagcacaaatacatccacatcttggcgtacgcagcaagcgtggttgagacctggaagaaggtaccatcggttctgggaatttgtggattttttaggagacaaatatcctcctctgctttgatattattttggaattttggctgcaagaaatcttgaccctccctagtatcaggcatgtgttttcttgtgtttctgtgtagagaaagcactaaacgtctccagaaaatgtgcgtaatgtctccaatgctctgcaaaccgtaaattgaaatgtgactaaagaaatgaaactgatttccgtaagacatggacaaacactagtctcattgcttttcagtttctgtacactgtgtgactgtgaagtttgacagctgaattgactcccaacttaagtagaaatagggaaagtgctttgcaagaagtggccgacaccagaacaccccgacagcagggatatctgccctgtcaggctcaccagcttgtgtgtgtgttttcagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtaagcaaaacgaaactcagttcttaaatcagtcctttggggaggaggtcgtttgagttttcatattgaaagctcaaataacaaaagcttcagcgatacttgttcattttatttattttttcatttttaaacagtatgtagggaactttaaacagctttagcagcatgagtaattttcagatgtttatttgccagaagtctgttgagtacaaattaggctaagtaaaagatagccagagttaacaaaaattgatttgaagggtctatttataggtaaagttatgcccacaaagtattgcttacatagaaatgatttgtgattatgccaatcatataaatagacgtgtcctagaaatagtgtgtcctcttaggcatgtctttcccctaataatttatactagggatgaagaaagagtttgctaaataaaggtaaacttcaacccagtccaccaaactcactgagtatcgctcattaatgatcttttcctttcgataagtggtttaaagtgagcagagaattgaactctgcttcttgcaccgcatgttgagtggctgctgatccattcacactatttactaataagcagagcttacgccaggcacagtggctctggcctggaatcccagcaatctgggaggccaaggcaagaaaatcgtttgagcccaggagtttgagaccagtctgagcaacatggtggaccctctctctacaaaaaattagctagacatggtggcactcacctgtagtcccaggtactcgggaggctgcagtgagccatgattgtgtcattgtactccagcctggaagacagagtgagaccctgtctcaaaaaaaaaaaaaaaaaagggttggggggcgtattgaagggtgaatgatggagtcatttgagtttgtttttaactttcctttaatgcttttctagcatattttgtgttttaaattgttttttaaaggaagcattctgccttaactgtaggtttccagtggtagcaatgggtgtgctgaagtgggtggattggactgtatcagaaccaaggtactttcagctgcagactgaccatacccctgtccacctggcgttgctggatgaggtaagagggcggagagctgttcacagcctacacagtgtctgtctcatgctgtttacgttggcattaacattgcatctattcagtgagtttagaggatactcttctcaaaaatagttatttctgtcctgaggattttcctcttaaggacctagcttcattgactgcagaaatttcttaacctcagtcaagtgttactggaagctgatggccctggcttaggtgtcaggaccttcttccacagtgataagctctttggtggctgtgacagtgcccagtttctctgtgtgctgagcgtgaccacactgctcagcgaagctccctctggcctgtttgtagatcagcacctgccaccagctcctgcacccccaggtcctgcagctgcttgttaagctttttgagactgagcactcccagctggacgtgatggagcaggtgagcagtgcccgtggggcttgccagagggctgaggaggaccctctctaaccagctccctgtcccccttcttctgtagcttgagttgaagaagacactgctggacaggatggttcacctgctgagtcgaggttatgtacttcctgttgtcagttacatccgaaagtgtctggagaagctggacactgacatttcactcattcgctattttgtcactgaggtcagcaatgcaccgttggtttcatgtttcatactgtttacactagcactgccctttttggcttaatttagttcattttgtacctaactgagaactgtgctttctgatgtagtgatgacaatgacagatactcgtttaccaaaaagcaccttctgcctgcagcagctgtatgacacactttacctccattaccaccctgggcatctgaatgttggagatgggtggtgtcaccggccggtgggggtggggagggattttttccaaactgatggccatttcacccggatgtcggtggatgccccgcactagtgtgcggaagaagtcaccctgtgctcccccacgcaggtgctggacgtcattgctcctccttatacctctgacttcgtgcaacttttcctccccatcctggagaatgacagcatcgcaggtaccatcaaaacggaaggcgagcatgaccctgtgacggagtttataggtgaggccgactgcctagccctttactacaatagaaaatgtcagctgggcgcggtggctcatgcctgtaatcccagcactttgggaggccaaggtgggtggatcacctgaggttgggagttcaagaccagcccgaccaacatggagaaaccccatctctactaaaaatacagcattagctgggcatggtggcacgtgcctgtaatcctagctactcgggaggctgaggcaggagaatcgcttaacctgggaggcagaggttgcagtgagccaagatcgcgccattgcactctatcctgggcaacaagagcaaaactgcatctcaaaaaaaaaaaaaaaaaagaaagaaaatgtcatgttctacttcctgtttctaacacagtcactgttttcctcgttaaagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaagtcctgatgtgacattgtttttgtgtgcgaataaggcacgggcagcctcggtctcgtgcagagccagatactttattcatcacttgggcgatttgaaactgccaactccctccctccctcccccacccttgattctaaagtgacataagaatggtgataagtctgaactctttcacctcttaaatgccatattattgcccacagttgccaaatacaaaatatcaagtcctctgctgaagaagactgaggtcccatcgtttcctgtgtcgcaggtcacttcttcaccaggtggctgactgcatcattgtgaggcagagccatgctgtgcaagtgtcataagtcatcccactttcaactctcaggaacactcgcagccagtaccacgctgtcctcgccatccaatattgatagccaccccagttcctgccagccagcctggcacacataaccataggatcccctctggtcatgggtcaccatgccttttcttaaactgcgcttctagtgacatggccttaaacgatggggtccccaaatgtacagtgctcctcgatggcaaggttgtatctggcgcccttcccatccttataggtgctggtcacgatcctcagccagcctctctcgccctgtgagaagtgggatcgcgcgtcagcccatctgcagccgtctcccgctccccttgctgccgtcagccccctgccccctgctttctgcctccatctctcaggccagccttgggggatccagacagcccactcagctgcccctcagctttcccatgacccctgttctgaaataccttttgtgaaacatttcacttggttaatgtttaacatgagggccctctatgccagaagtgaattcatctcacaaaacatgttgactctagactggtgcctcctccagctactactacccccattagtcacctagtaaaaaatgacgacatttcatcacctgcacatgaaccgctttccccccatttcttaatcatgaatttctgtgtcttaaattattaatggctaagactaggtctggcagttaatttctctctcctggatttttggcccaactcgagtatttttgaaaaaccgacacagtattttaggggagcccaaaaaccatgatgggaaaaagaatgagctggttgtaaaggaagagggtggcagagcccctctccagcagtgctcacagggacttccccagggcaccaggcaccatctggagacggttttggtcacactgggattgcggggagtcacctagtgggtggaggggccagggatgctgctgaacacccaaagtgcacaggatggcggcagccgcgcatgtcagagaagggtctggccccaaaagccactcgcgcggtggctgagacagctggagcaaggaaccctctgtcaaggccccagtttttagctaaacgtaaacagaaccattcaagcgagaggagtaccaggacgtttttttctaggaatgaccttaagaaaatgaaaacatcttacccatggttcaccccatgaattccggacaatccagtactcagtcccatcactgatgccccacccagccacggaaacgacatggtttatatatgtggtgtcctggtattcggcatagatgcctccggtgtagttagccagtctttctgttgccattattccacagctgagagcaagcagttaaagaattaccacttttaaattgagagaatttaccgtcattagaaataatctgatatggctgggcgccgtggctcacgcctgtaattccagcactttgggaggccgaggcaggtggatcgcttgagtccaggaattcaagaccagcctgggcaagatggcgaaaccccacctctacagaaaatacaaaaattagctgggtgtggtggtgtgcgccagtagtcccagctactcggtggagggggctgaggcgggaggatagcttgagcccgggcggtcaaggctgcagtgagcgaagatcataccactgcactccag

SEQ ID NO: 15512 - DNA, 7656 bp, Human
tactttgtgatttagtatgctgtatcgtgggctggttatgttaactgaaaaaaataaagtcattacctgagttttgcagtgctctaacttaaacagaagaacagctgttcacatcttttagcattttacatttgcctaacttaaaaattgccatgtgtcaaaatcatggttttgtaattgctaaggcatgatatgtcaggttatttgaatataattactttttgaagtaattgtgaccacaaaacatcttttttacatgaaggagctgtgtatcatttgaaattactcaaatgatgtcttgctctgaggcataaatcccaggtacttagtgtttttaataatatggtgccactgcaggatttgggggcggtggggaagaacaagcataatggtagggggaggcttggcctgaaactaaccactgagtgaattgcactgcaggttttacttaacgggaattccttatttgggatgtcaagagggcagctgcaaactgaaaaacaatccagtaaatgtactttgttttatgtattgtagcaggcaattaactactaaataatagctttgacatttgcaattgttgcatagagactatttttgctagaagatgattagctcttgcctttattttacagtgcttagtgtgataaacttctagtcatgtttcctatccaagagaccagttaatatatgtacataaaccacagaaatagtataacacactatttttaaattatcgttttcctacttaaattttgtttagcttaagacttcttaggacatttgtaaaagcaggttaaatttaataaggtttctgatttttttttgtaaccggagatagtttttacaagtgaaataacatttcagctaaataaaacatcgctaaataattgatatttgatgaaaatctgctttgtataatttctgtaaattatccttgttctgaaaaaggtgtaatgccctaatatttttaaatccttatcctttgattttttaaaaactgacctattgataaaactataaattttcattttccagtgcagttagttacctttttaaacataaatgcacaacaagcaaatgaatttaagagaactaaactggaataagtgttcataaatgaaacccttggactatttaataaagttgaaatgtgaattaaggaaaacttttgttaataaaaactttcttttaagtgatgtttttcctgattataatttctttttagtaattaaaggtgaagggcaaaggcttttttttctttatgagagaaacactttaattcctagactgtgagccttcactgcgttgggttagtttctctaaatcacaggctctgagatgagcattttcccggccgcctggcagttccctgtgcctccagtgggttttcctcacatttttcttcccatccattccgggcaacagtgacaactgttgccttaccctccgtcttgtcgcacatcggaagcaggtcctagaactacagaaaacgctagggggtcctccactgggtttccagggtttagtgtcactccgagaaagggggtgccctaagagcctttctaaatctcagctctcaggacacgcttgtctgtccacagatttaaaaaagccggcgccgtttccctgaagcgggcgcaaagccaggccctcggggcggccgtgcccgcgccgcctcgcgtcctcgcttcccgaaagcacgcggctcagtggtccttagcgagcggggacaccccggccttcttgcccccgtcgtccccgccggggtaatacggaaggtcgggggacacacgccccgggagctcttggagccaataggtgggcgcggccggccggcccgccccgggattggcacccgcagtccagaccgcgcgcgcccattggctcccggcgccggggggcttccgcggcagggcagcaggggccgtgctcaggggcggggccgggtaggaggcggtgattggcaggtccgcacgccccgcctcttccgcttctgtggtctgatcttcctgcggctgaaccgcccggctgagccgacattgccggcgtcttggcgattcggcccgacgagctccgctttcgctacagcatggtggcctactggagacaggctggactcaggtaggcccaggcctccagagggaagggcttcgcgagccggcccgcgcgcatcccggtgcccagaggtcatgcaggacacagagcagcggccccacgcgtgaccggggttgggccaagcctcgggcgtcgccgccaagatggcgtcgctgtgggcaaagcgctcaggcgggcgcggcctcgacctcgcgtgggagcgcgtctgtgtcctgcctcgcttcccgacggtgcggcccagcacccacagagtgcccctggacacctttgtgaatggcaggtttctcgagagagaggccagctcttatttagcaaacctttttcttctagaatggtgctggagccaggtggtgaaagtagtacagtcacatccacctcgggaaacaggagatttctctccacgtgaccgccgttagcagctttgacctttaatccagcatcgaggtggagccttttacaactttacacattttttttttaaacttttaaatcctgttgatttcaggtttccttatgtctaaaaggggtgaaagccataactgtcgagagcccctcacaaagatgagaggtggctcctggaaagctcaaatatggaacccacttgaggacatggtgtctcatagtggaaccgcaaaccattggtctagctgtcacatccgatttttttttacccgtgcacctgagtgagcagaagtaccttgctctaggtgacacaccttgttagttgactggatggtgtagcactttacattttgtgggtacactacagcggagcttcccgacttgctgaggtcaagccagcgaagtcttgtagaattggaaggatggaaggatgatagtcccagtagtagataccgtttattaggcaacctaccctgtgatccatactttttcacacttgtttttcctcctcccagctatcagcaggacaggtattattgtccttttattctgttgtttttttcaggtgagtgagtaaacgtgctgaaaaggttgaacagcctgaaggtcacccagttagtaagaatggaagcaggcattggaactcatacctctgagtccccaaaataaattctaaaacatgagaaaatagcacccctccccgcttcctgtttttcaaaagtgggaaaggtgatctgacatcttttggaaactacagtgttgatgggagtccatctaccaaacaggaagcaggttttacagttttgctagaattgatgatgttctctaagcacttttcagtttgatttagaaatcttcattaggaggttattttcagtggcagacttgtgagacagaattcagtattctcagagaagagtttaaataatttagaacgaattgttttaattcaaaatagttttctcttatgtatacctcattttccaagaataatataattaaagttttaaggagagaaatcgaggagagaattcatgattcatgttatagtctctaaacatttcagtctctttttttctatgctgtgggatttttaaaaacatttatgcatctttcattttgaattaatatacactaaagagaaaacacagtacaaagaagaaaaatcaaagatcatccatccaaacaccagttaatactttggtacatttttttctagttctttttctttgtatagatactttttggcattagtcatatttttaaatccaattctacaataaggtacaaccaaaccaaaataaaaagtacaggaagaaaagcgaaaacacagtaacagctgtctggctggaatattgataattaaccatataccttctctcattttctcccagctacatccgatactcccagatctgtgcaaaagcagtgagagatgcactgaagacagaattcaaagcaaatgctgagaagacttctggcagcaacgtaaaaattgtgaaagtaaagaaggaataatctgtaagttatggatttatttagaagaacagttgcatcttaagtttttggagcaccataaagatcaaaataattttagttttgggttctattcattttttagtcagtgtatttggaagttagttattgggatggtataatttaaagcatgcaggttatagaagtcccctggcctaataaaaagaaagtcttcttgggccctgacaagcagaagtaattggcacattgattttcagttcatttagcaatgcttaggtagagagccatcgtatttgaattaaacctgtttcatttgtctgcacaaatcaaataatttggaggatgaactccccacttgtataattgcaattggagttacataacagtccaagagcatgaaaaactacagttctttacatttttatttcccccacaaccactaatgttctcacaaatcactacttcccgaacataataactacaggcacaggcaagggtcctgctgttgtatcaagcaataaaatctgcaagaccccgcagcgaatactgttttgctaatttattatgctttcagagggtttggttcattttacttttccaaagatgttggtgatgtaaagttaaattctcgtgaaataaaaaggtctgtacagttgataagtgtagacttttgtgttccacattataaaagtggtttgatctctaaagtactttcttgacattgttatttcaaaagtaggcaaggcaaattatcagagagatgtttttcagatttaatttttcttgttttgcttttaaaaagcttcagacccataatagcacagaaatgtgataaatattaatcctttggcagcttatggttatgagcaattttacttattggaactgtctcccctaagcacttttcattttcattttgaattagtaaatattttattacaagtctggagatgcagtgttttgaatttagccctttttctaggggctctctgtctaatctcataattctgagtaatgagacctggttttatgttgggtggttttgttttaacagtaagctaacagaaaatcatttagcctcactcggctcagagctgccagactgcatctaatgctgagattttgcaaagtcctgggggtcaggaagtagtgtccgatccccttaaacaaagcattagcccctctctgttatgcccttcagggttacagaccccacctcattagcacaaggagatgttagtgtcttttaaaggcaaagtagtttctttattctgggagagtgtttacttttactcagcaggaaaatgcctgcttgactaagcctgtgtacttgaaccagcactttttacatctgagccacggcaatgtgaatgatagccacagttatacagttcactataaggaagttatttcttatattcatgttgagtttttaagaaaacacagagaactagccagcaacttgcattttctttttcctcctagaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgttactcttgattttagtttgtgagactttttcattttctttaaaggaactgtctgcacagctgcatgattatggccatgtgaaccagggtttcttaaaagcaggggaagccagatttaatatttagtgaccaaagggatacagaaagcattttgaaaatgtctcaaaatagttgtttcatgacattaattggtgatcaaaattatctgctgtcattgaggcttcgtagtcccttatttttgaattgttgtcatgtcagaataatgacatggttatcagtaacaaatggaaataattattaaatactaaaagtgtagattagaagaagaaatactaaattgtacttgttttgtattgtgcacttaaagcctatagataagaacggttacagaatttaagcacaaagtgtttttcacattgttttgtaaatgaatctttatactctggtagcatttctcataggaaatgaggcaaagctattgaataacttgctcattgagttgatggccaaactgaaattaaaacctaggagttttgactgcaagtctgggacacggtgaccacaacagcagtttcgtggtatttccatagtgattcattcattcattatttagggatgaaaaattgttgcaagttatgtttttatctttctttgaaacttgaaagggcttgggcaagtaaaacaccattgcaaagttaactgcctgattttaactgtttttggagactggagaaataaatttgaactggaaattttgaaacaccattctaggatcagttctcacatggtacttaagctcacaatgatttatcagggccactgtcagcaatgccgaggataagccgaaaagaacatctttgttctcggcttctgggaatgacttattgtcccgacacttgacctgtaggttttactgaattctcagcacagagcgagcagggaggcagagccgattgagtggaagagggtgcctctggaaaacagcaggttaggagcccttggagtcctccgcctcggagctgtcatcctgctgttggcaagttagggcacctcagttcagtgctgtggcccccaagattaaggtactaggaagtatcctccattacagggaacaggaataaatgaatcaaaaagctatcgggcctttttgacatgggacgaataaagtaactaataggcaaaggggctaaatgatttccagtcaagtaattagagataagtcatttattaaggaggcagatggggtattattggtatatagatggcatagtagattgctagtatattggtagattattggtatatagatggtatgttaaggaggcagatggggtattactggtatatagatggtatggtagattggtagtatattggcagattattggtatatggtatgttgaggcagatggggtattactggtatatagatggcatagtagattggtagtatattggtagattattggtatagagatggtatattattaaggaggcagatggggtaattagaggtgagacttagggacagggcttgtgatatggaaaggagtgaagtcactgagtaaaagacaagtttactgtcagcagagattcttagaggctcttttctccgtgattaaaaaaaaatcctaaaccagtagtataataaacttcctgcctccagcagtgctgggtagctggcaggatgactgtgcccagtgatgaggtgaccccagtcagaccaacttaatgagtatcccactaactagttggatgatgtttgaagctgtcagttaatctcttagttcacatcgttcttgtgagcaaagtgaaggaatcggataagctctaaatttcggtgatgctgctgctctgagagaccaaggtcgctggagcaaccgtactgctaaaggataagctcttcaaaatcaaaagggacagatttcttaagtttctagtttgttttgtgtttttacatctatttctaccatacgaaagagtaggatggtgagatgcat

SEQ ID NO: 15513 - DNA, 28790 bp, Human
acgcgcgggaacattctccgtgagagaaaaagcacgggtggggggcggttaccggtgcttcccccggtcgcctgggggtcccgcacgcgccccgcgggtgccgctgtctggctggggtccctgggtgagccgcgggcaccggcttcgcgtctccccgggcgcgactccgctttgcaagcgctcagcacacgggaaaccctcggaaaacacacacgtgtgtaaagtttgttccacgcagaaacaaaggacgcgtgggggccgcttctggggcctcggtcctttgttggaaccccgcaccgcagcccggcccgcagcctcgccccgcaaggggaagccggccctgcacaggcccggggcccggaaggcgccgccgcacagctctgcgcccccgacccgctccggccgcgcgctgggccaggcccttggcctcaagcctcccgggcggctccgggccggacccgggtctccgtcgcgggacgccagcctgtttgtgggtgccgtgctcgggcccgggcggcccctgcccgacgcggccccacggagcccctgcacgaaccccgccgacctggcccggggcggcaagtcgaggtgcttagggcgccctgggcccggccaaccgtggaaaacccggcccggggcacgggggggcgcgggggtcgcagggccagggcccaggcagggaacagagatttttttcgcggggaggggggtgggaggtgtcaaagttttcggggaacttttccacttgagattccacgaccctgcagtgccccctacagaaagcggcagctggggagggcgggcgcccccgacgacccccgactgccagcggcggcgcggccaggctgcctggagttcttgttccttttttttttttttttttccttttatttcctcgtggttgtttgtcggatacatctttttccagagtgggaaaaaaaaaaaaaaaagcgagcgccgccgcctgcagtagagcgtgctcggcctgcagaggcagtcgtctccaacttttcctctcccgctccaactccccgcgcccaaaacttcagttcttggggagcccaaatttgcctgccgcgcaacttccactctaattcagcgaccaagggccctggcagcggtttgcagcctgggggccacgctccccaggctcaggcctgctcgttggcctgctcctagtgcctggacccagttgggggaggcgaaacagggcgcccgaggagcaccccgggagagggcggagcactcccgtgccccggggcaggagtgcagggagctcccgcgcccggaacgttgcgagcaaggcttgcgagcgtcgcaggggggcactcgcgagggacggacaggaagagggccaggggggaacgccagaacccgggaccacagcacggaaacggtccggggctgagctgcagtcagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagtgagtagtcacatcacctccagccctctgcattcacgtagcattgctgcggtgagtctcctggcggcctctccgacacacggaccgtgtgcactgcggctctgcctgtttgtctgtctctgtctgtctctctgtttaaaaagagaagataagaataataagactaagaataataagatctcttggctagagtcagggggcatctgtagccctggatgaggaagaagcggtgctgtgaggccgcagctccacctctgcccggtcttctcctcacttccgcagcaccccccccccccgcaccccccgccttggcgtcactgcgctacaggccgcctgtaatttacatatgttttaacgctaacattgggaagcattgggcctttctgaagcctttttgtttcgttttgtttgaagctcccctccccccagtaatgagcctcagtttggtcctaagggctgggtcgccggatcgtagacccaaatccttgcaaaatgaacgactccctcccctcaaagaggagggagttgtgttgttgttttgttttgttttgtttttccgcccgttttcttttaacggcccggcagccctctgtgtggccttgttccctgtgaataattgcctcactgttcttcctgggggcttgcgtttgtgagactcaaggtgctagcctcttcactttccatttcccagacaggaaattaagctttcctctccattcgaactttttaaaaaaagcctgaggaggtatatgtgaaaattaaccccgtaaaatagcactttttttttttaattaaccacaacctttagttagcctagcagtagcgttttttaagggtggtcctggaaaaattactgtttggggtttgtttttaatgggggctacttttccctttctgagcctcagtttactgctctgttaaataaggggcgagtctggatgatctataccagacagtgatcgttagctctgtaatgtcttcaattgaaaagtgaagttatgaaactggctgtagttcaggctacctgctgtaggcagactaggttggaatagaagcagcgttggaacaggcgggaaatagccatcccaggaccacattcttgggggttatacttgatattaggcaattttggaacattcatttcacctcttagggactgtattgccagtttatttttttctttatggctttatctaaatgcttcaggaaaattttgccatatgtcatgattatcatgtctacaaagacagtttctcctttttgtaagtcacaggtggagaatgtctttggccatataactgatagaaaagtcattttaagccgtgtgagcggtttcaggaataaaagcatgtaaactcaggtcaaacagcctagaactagggacagagtgtgtgtgagatttcagttaattaagaagttgaagggttttttttacatttataaacggaaaggaattacattatattgaaataaatgtaaagatgtctggtagcatagaaacaggctaattctagcgctaattttgaagaagaaataatccaagaaatcgagtagaaattggatgaattcaattccttaatggaacttcagtaatgttaaataagaactgcatgttccttaaatgacttgattttgtgctgcctcaaaaactactgaaactcatattaagatttctaaggtatcagttttaattgaaaaacatattgtttatttttcaatttttaatcattaaggttcaaaataccctgaacctttgggtaacatgagggtttttttttttttcccgattaagtcagacagtttaaaaacctagtatctgagacgggaagctttttaaaagtgcatctctgaatcagaccactttagaaaattattttctaagttaggcaattttaaaaaatatttaagctaagcagaataattaaaaatggatagttaacgtatacagtttggaaaaatagatatgtcagggtatatacagatacatttagctaactcacagttttttgaaaatagatttctaaacccaactaaaaatacatttctaagaacgttaaaaaatgttttctaaatgtcataccattgaaaatgttaatatttatattagtctgaccatttaaaatctttctcagatcattgaaagcagtcatatcatttaaaatatccttatagtcaatccatactatctcaaaaataggttttgcagtctaacaaacatagtttgcctgaattcaaatttaaaaataaaacacagatttatatattttaattgtgttaaaaaatggcatgtcataaatttctgaagtatttagggttgaagtgttacatcttcactttgcttacaggtgattcgtaacaaaatctattctgcacacagtacggcgaaatgctaacaagactaaatagaggttatgattttttcaacttttctggaagttggaaaagctttataaacattttgaagcaaaagccatgtttaacacaatttgtaaaatctattgagtaactcttagcaatgcttttcactgcatatctagctcacaaaaaatttaaagccttgtttctgacttgtaaatttcaaagccatgtagcaaaccaaacaaaatcgtatctgtcaaattttgaatatggactaggtattaggtgacattaaggaattaattataatacattacatttgctaattttattagagatgcctactgaaatgtttagtggtgaaatgtcaaggcatcttacctaagtccttaaacccctccaaaaatagaggaagcaaataaggcaaattgttactcattgttaagtctagtgatgagtatgtgtgcgacattttaccattttgtaggcttttctgcatgtttgaaaatttttaaatagaaacttaaagtaagtatatttgttatagtaaagtaaaacagttaaaaagaggcaatttgtaaatacatgtctaacactcaggcaatttgaaaggaagaaattaaacctaagtttaacttaatttaaaaaataataacctggaattttaagtttccaattagaagaaaaagctgtagactttgatcttgatgcatttgataccaactaaaaatacacctaaaataacagactttttaaaaaaaaaattgtaatcctgaattttgacatcttatttcaggaaaaagctgcagaaattaattgcagagtagtgtgtatcatacacctcaaagcaaagcacacctaaagccatgccattcaaaaaatttaaacatgcattttttgcatcctagtttgagggaaaaaactagaatttggttgttgtagtggggttattgtgtgtccctgtgcgtgcatacagggttttgcagcattcaggcaaatatgtcaaataaacaggaatttaaggaggatacgcagtgaccagataaacacaaagcctcaagggccagaaggaacctaaaggtcatttggcctaatgtccccatttgtgataacccctcatgcctatcttatttggccatggtgtatgacaatgatggaaaatgccagcagctccatgatttttaccactaaaaagtctttgcctgttaatcccaactatttgtgtcctggggtcctgcttttagttctgttccttcgggtcttccttctgtctggtaaccctgcagccttgttacccagaattctttccaggcctagcattcccggctcagagtggttatgcttttttcctataaatgatgtttagtttttctgtatcctttttagatttcagcatccagaactgagcaaaattctacttttttgtgttcttagttgtattaaagttagtaaaactaattgtaaaaaaacagacaggtttgactttatgcactcctaacaaaatacagtcgtatttcccatgcattttactttggcctcagttttgagtgccccatcacgttcatgcctcagggcagcatgaaataaaggaaagagcactgagaattgaatctgagaattgaggcctaagtcctgttctgctgcaggctcagagtgtgtccttaggcaagcctttaatcttttcggacattttttgcctcatttgtaaactgaggggtttgggttaggtgatttccagcagccctatcgattcaacagtattttctcaagttctgttttaatacattgtttctcctgactttagctttaatttgaaaaggagaaattcatagtcaacagtgttgtagctgtcagtccaaggttactgacagaaatccttagaagtagccccagtactgtgcaaaagtaactttcacattattatgccagccaagtgcaggttttaaggtagcaactcattcaagcagcttggctttaggaaactgaaatggatttatgaagctaaacaattattcaaaacaaattgtaaagtcataaagaaatgaatgaaaggtagatattgagatgctcttctgatctgatgaaattctgtatggatttgtgtggtttccttcgatctccgggaatggatctaatataggggttggagctactttgttagtgtttactgcctaatctatactctgctttaaaataatgcataatctataattggaagctagcgttaattggtcttagattagtttgaaacataagcacattatttttaataaaatgtgtgctttaggaaaaaggaaattaaggattaactatggttataagaaacctgaggtccttattcaggcttgactacaatattagctaagatttatggagagtttactttgtgcctggctctgggctaagccctttccgtgtgtaagctcagctcatcttcacagtgctctatcaaataagtactattgtttttctcagatacagataaggaaacagattttagaggaggtaggaaactggcccagtgtcacccacctgatggctgggggctgtgattggaactctggcaaatctggcttcagagccccgtgctcacctcctgggccactctggtgttggctgcattttcagaacttgtgctgcagatcctggaaaatggaaggacctattgttttaaaacaattttttttcttgcaataggctagcatctttctttatctcactttatgaaccttacatagtcaattttaacttgcagattgaagattctaagttttagtacaagctgagtctgttggaaaattagttctctgtctttagaatccaagtatgaaatcattatatatttctctttagatctacttgcttttctgcttttaaagattccatgggagcagtgaggcttactttgagaataagggtactttgttggataaaagtgaagcaaacttttattttggcagtaacggaaataaagtaaatatcactatagcatagacctgtgtttccaactcattttgctcaacttttccagacttcctgagtaaacacagatgggtttccacttatttttcagttttatgtagaaagttctttagactataaattccacatgctacttggagttttcagtgtttgcttgattgcatgccattggaaggtcaaaaacctagatttagacattataaagatttagaaggtgatgatgtgtagtaacgtgttttcatttggctttattttggtctttcttgatggtaattctaaatgttttaattcaggtcttgactaaatttcctggtaatttggtggcagacagaattttgaaagccttctatttttaaatagcagaatggtggggagggtctttgaaaaggtgaccttaatttaatattcctgatgtggtggtagctgcctatcacaagtaattccctgaattgttaataaaattagagaggctggagggtggggtggaaagagacctgaacacctgggtctgtccccagtctgaccattaacaagctctgtggcttcaagcaatgcatttatacattttgaagcttagttttcttatttgtaagaaaagacttatttctagccctagaatcccatgattctgatttcacctcttatcaactaataattgtagaaatcagaagatcagggtgtgtgtgctcggttaataatccaagagcataggcacatgtgcagcagagattttaaccgaggtttgcaatagtacatcgttcaaagattaaatgccagggagccgctgcagaataggaagaagactgagatactcaagttagggattttgtcttgcatcatgttttattaataaaagattttaatgttctcttaatgttaagcttttaaaaaataaaaacattttttctttgtaaagtaaaaggtaattaaatcagctttccatttgatttattaatatcgtctagtactactattatggcagggtgtgtatagagttcttttttgctctcatagaaaattgtggaaggaatgaagaggatttgcagcttttcataatgtcatctaattgaatttttacgtggagtaaagtttgattacatttttattgctatcattgtttaataatattttgaccctgatagagcagcttcatttgcactatttttaaataagaaagttatgttttattttctaaatttactgctaaacataaaaaaacacaattgattattgaatttcaccactaattatttcagtgatcaatactgtacaaaaaaaagacctagttgtttagattatctgtcattagtaaatgtctgtccagaagatagagttccatgttgatctaaaaaagaacctttacttttcaattgaaacttaaccctctggtgtcatgcttctcccttccccctccccttaaaagaaaaaaattattcttaccttttgttttgtctcgtttgcttgcttttataagagccttatgaataactgtatgctttctagctaataataatacataccaagagatggtaagagtttttcttttattttgccacctgtgtctctctccgggaaagagtggtttctcagctctcttactaccagggatgaagccgtgtctgcgggatgtaatttgcagagaccttacatatgtggtcactcacatgttatctgaatacagctacagacaatttttgtgggtcatttattttttaattttgttgcatttgcaggtctgatttacatgttaaaatatacatttatttaacatgataaaattacattttagctctgctctcttattttattttcctgagggaaaatagaatgtggtattgtatgtgatatttggtgtttatgaaacagattaacagcatattttagtgaaaccaaagcaagtgtgttttatctgtttccagtgtattttaatatttacagtcattttttgcttgtttcctagctcattttcaaaacaaccacagtaaataaaaattaaagcatatattgatgtagcttaatttaaaaaaaaaaaaggagattttaaaatgccttgcttagtggatctttatatttagtcagcttaaaatctcagtgttttctcaactgaccatgccttgtctgtctgtctgtcccatgctgctttctttgtgctttccccaactggatgggactgatggggacaacatgtctcttcaggagctggacgaggtattgtgttttgaatatttttatatgttgggtaatttgagtttataaaatacctacttttcctgaagtctttgctcatatataaaatgctaacagcttatacatatttagcatttgttttgattactttataatttttttaacagtttaatatgtagaatttaatctattttcacaccatgtgaactgatgatttaaaaaaggctttgggaagatcgtttactagtcttgggaaagtgtcttaactttggaagcagtaaaggttgaacactttcttcaaggaagccagaatgttttgagaattaatgtctgtagcttcctgatttctgagaagtgagtcgtgcacttcctcaggtagacagtatagaaggccagcatgtctgtgaaggccctaaatgagaaggactgtagccacggcaactgtgggagggtcttccttgtcactcctgtctggaatgagatgacacccagtggatgcacctggagctattgtcacctgggcccagttctgcatctcctagctgggggtgcctttggcctttttattagctactagcatcttgcccagaaggtggagagaatatatattcaaagcactttattttagtagccggagtaaaagggttgagaaaaaatgagattaaaactgttgttaatgtttgtgtctattgtctgtttcagcattgaaggggtaagaatatttttcctgagtatagaccttttaagtagagtgatggagaggtgagggttgttcttgtttgttttcatttagaagtatgaatagtaaagtaggattaggaggatcactgtccttaaaaccagtggggtcctaactagtagattcagatctacctatatattctaaaaaccttaactagttgataatgacaacagactgagcacagcctaaatagccttcattgggaactggttaaatatattgtgtagcatctctgaccctctgtaacaggtaaatagtgaggcccatccatgagagctgcagtggaataagccccagacacatggcggagtggaaagacccagatgcagagcagcatggataatatgattcctgctccttttttttttttttttttttttttttttcaggaaaaataactcatatttatgcttgtgtgtgcttaaaaaattcctgaaaagatacacaagaaactgttaacagtggatacaccccaagaaacatctgggatagaaaacttcctttctattgcaaacccttttcttagggtggatatatatttttaaaccatgtgcatgtatactttgccactaaaaacaattagttaaaaaaaaaaaacaccactcaacgggtagctgactgagccaggtgtcatggtcatgcctgtgtgggggtttcctttcccattcaggaacctcactgccagctccccgcctgggcacggggccctggagagggcttgggggcttggagagcaggcgttctgagttaaaatagatgttgctactggctgaacagtttgaagatatggagcttatgacctcaaaaggaagtgtataggatgcgagggagggtaacaaattatggaaccacttaggttgaagaaccatttgaataatgttccaaggaggggcacataagtggtcataattacttcggggtctgctgtctgaaccgatttccagtctttcctacttcctttttcaggcagcaagttccagaaactggctactcactgcatgaacttggcaggcccttttgcttttcttatgtttcacctctaagggcttaaaagggagtcttcacgctctgtgatcagaggccctgcgtagagagcactatctcctccacgcgcaccccagtgctattagaaatgcaggttgctgcctcatcgtgggtgcccacggccacctcatttccttgtgcgtttcacttgcctcttttgctcttttgtgcagtgccgttatctttttcatgaagtgtggcttccacaattgtctgtgacgtacattttatttacctcgtgcattcattccactcgtttcttgtcggatcactcagctggttgtgattgtgcgttcaggactctgaagtgccaggtactggcctaggagcagggggtgtggttggggacagtgtccagaggcttctttgaagctgaagcagggcctcacattggcatctctggaaatagtgaacacccagctccagagtggattagatgttagccacccctttataggggaggcctgagcaaatgtccctgagtgaatatcacttgcatctcccagagtaaaggcatctgacggcctcacttcagaggcttcctgcagtctgtccatgtttgattgtcattctcctcctctagcctgagtaccctggagatgtcacttttccttctcagaaaacactaagtaaggtgttccctgaggaggacccgagcccaccattggttctcttacccagggaagtgtctggccctctcctttgttctctgtctttaatctacttcctgtcttatgacaaagaaatctctgggagtttttaaactcaagaattattttaaaagtcacaagataacaaatgtcaagcccccaaaccacactgcctggaggactgcacatctgggagtgcctgggccgggccccagtgtccatgttggtgaaatagggagcggcgctcctctgaaggattgttcttgggactggcatgggccaggtcagtagcagtgctcagtacagtgctcacagaaggcagggagggacggattgctcccctcctttttcttcccctcagagtatgtatgttagttgagaaaaaaggaaaatcagtgaaacttaacaacagtatcagggtgatgtgattctcaagtgtttttatctctatattttttgtatcatttatttttatttttttgagacagagtctcactctgttgcccaggctagagtgcagtggcgcgatctcggctcactgcaacctctgcctccccagttcaagcaattctcctgcctcagcctcctgagtagctgggactacaggtgcgtgccaccatgcgtggctattttatttatttatttatttttgtattttttagtagagacggagttttgacacgttgctcaggctggtctcgaactcctgagctcaagtgatccgcctgccttggcctcccaagtgctaggattacaggcgtgagccactgcgtcatcctatgccattttaaaagtatttattttgaccatttactaatttcataattagaaaaggtaagcattattttaaaattattacgggtttagaaaaatgtagtgctgacatcacttttttcttttatccacatgcttattcacttctccaacaactcggatttcttaagcctaattgtctattagcgaagtagtctgacttcatcatacaggctcccagagtttcacgtggaagtgtgagttgccagtctgttgattttcagtgtcccttctgggctttccaagtgttcattgccatagacagtccagaattatcggtattgttctcattaccaatgcgttacggctaaacttagttgatttttttagatggggaggaggtgtagctgacttttccaatctccacagaggctttgctatttctgtaatcttagtctacactaaatcagccttcagggaaaggcagggtttttaagagtaggagggccatagatttggaacagcaagatttataagagagaatgtgtatgttctttccatagatggagaacttgtccatactggctggtactctttaaatggacaaatgtcaacatttgaagtggatcaaaggcaaaagatacctttagtgagactggcaggaaagccattgggtgtgctgttttgaacatctgttggattttttctgcatttctctcaggaaggatggctctaggttagggtagcggaccccagtagttcttggagagaggaactacatatcaaagaggcaagaattcttaattctcttaagtacaatttttatttaaaaaatatggatttttttttttttacttcagaagcacaaatttatttatttatttatgtattgagatggagtctcgctctgtcttaataaaaggctggagcacattggcacgatcttggctcactgcaacttctgccttccaggttcaagtgattctcctgcctcagcttcccgagtagctgggattacaggtgcatgccaccatgcccggctaatttttgtattttcagtagagacggggtttcaccgtgctggctaggctggtcttgaactcccgacctcaggcaatccgcctgcctcagcctcccaaagtgctgggattaccggcgtgagccaccatggccagctgcacaaaccaacatcatatatttggagggggcaccatgttgaaattcagtaagggtaaggagagagaattagaaacctggccattttttaagatctgtatgaaataggatggcagcttgaaaattgatacatatgctggatcttcaacaataagaagacatgtttttaaatggaaagtgaggtttctgaaattaaaagggtgcttatgttgcacataaaatttgtttatgtccatatttgttcccatttcaaatagttgacgcttatcttcaacaattgttttcccttcccaaaacatactgtcttgttttttaatagtacatactgtgatacacattacaaatccatactgctaaaagaaatgacacatttcttctcaatagggtggtgtttctttattataatgaactatagctatagactgtatcataaaagagacaaattattcgctatttaaagttttcattcccaaagaatcagctgttctatcttactggcaaaactctgatacaatgtgtgggaaagctagtaccagctgagcaggctggcatccatgctgttcatgtaggaatctctaattagcaagcttccttaggacccttaacaaagagtgtgttctccccacttttgatttacatctaatttgaggggaacacatgcataaaatcaagtactgcttcaaagagttgtattcacttcaaccgacttttcatatgtggtttataatttgttgttttggataaaatgatactaatcccaatgcaggtaaatttagatagataccatctctctgtcttctttagtttaatgtgtatttgtaaacagtaaaaacagtacaaaataagatcatgagcttaaaaactctaaaatcactataaataattactgattgaaatgtgtaataataaaatatagtggattcgataataaactggtgtagtggaaattctaggacccatgaagaggtcctttagcaattttagattttactttgtataaacagctggagttcaagttctgttccagtccagcaatactgtagacagcacctgatgtatggctggcaggtgctgcgagctgggcctgtggtttgtccccctgctttttagtcagtgtgtcctccacagagttgtgtacctcttggtgactttggagcaggagtgttgaggaataaacaagtctgcctctgagtgcttggcacaggccctctctgtgcctgctctgtagagggtgaggtctgcgcctctctgtccacggatggtcagtaagagaggatgatctttactgacactaacgtcactcactggcggcctgtcctatagtgcctggtgtagttggtgggaaatgaatcaaactactgtgttttgttgttttaatctgatggcttgtcttgattcattttcttagcaaattgcagttatagtttatgggcctgtggagtgattggcacctttgagggtggaaggggtttctggagtcagccgacccaggtttcagtctgtcacataatggctctgtgaccttgggcaagcgacttaacttttctgagtttcaatttccatatttataggttagaataatagtttctaactcacctagtttttatgaggattaaaataatgtcaagaatgtaaaattcctattgatgaactcttgaaaccaaacagaaggtagtggtggtggagaattaccacttcacggcccgggagccccagacagtgcgggtttggatgacacaccatttgtttaagaaatgacactggccctgcagcatccgtgccacgcttgagcaccgttgggcttaatcacggctcctggacgtgctgggattagtgaatggggcctagtccttccagcgtggtcattgcctaagatgcgttccctgagtggacacgtgccccagagcacacagaaagcctgaagcagatggtggcagaaccactccagggcatgcagggaggttgatggtgaagataccaatttgcttttaagaattttactgtgaactctttaggatttagggcctattacttgaagtggtcttttattctaagtttttctttatatgatatttttcccccttcatctgtggattttaaaattttgtcttgttcctttattattagaaaagcaaataagtatttaatgaatgaaaaaataaatttagttaaatgcaaggaagagggaagaaaagcaatatgaatttttcacccaactctacagtgtgatttagaaaatttccaaagtattatctataaagggcttttatagattattttccattatattttgatcatcatttggatcttttgaaactggcatttaaaaattctgagctctggagggcacctcaaaatcttttcaacccattcactgcctgcaggcaagaaaacagcttaaccgtgccaaacccatgatttccctctgttttttgtgtgtgtgtgtgtttttttttttttttttttttgagacagagtttcgctcttgttgccctggctggagtgcaatggtacgatcatggctcactgcgaccttcgcctcttgggttcaagggattctcctgcctcagcctcccgagtagctgggattacaggcataagccaccatgcccagttaatttttgtatttttagtagagaacggttttcaccattttggccaggctactctcgaactcctgacctcagatgatctgcccgccttggcctcccaaagttctgggattacaggcgtgagccaccgcgcccagccgatttccctcccattcttaaaagctttctaccgcagtgtgttatatagttaaaataaacaggaaccatcgataccatttcaaaataaggggaaatgttccctgtggacatttaactgaagaaaagaaatgacagtgtaagattgcattgagatcttaaggattgcttttgccaaatggtagataatttgctagcggttttaggcagttgtttcacacatcttaacacatggttaatgattgtgtgactgagataactggatcagccctatttccaaaataagctaagtgtatttaagtaaaccttgctactattgagcattttgtagttgtttcatttactgcctagttttttttttcacttgcaactgatcacaagaatcattgaggttcatgccgttctatcacagtactagtagtaagaggtctttattttaaggatcttttgttgactttttcattacatttctatagccagatcaagtcaaatttacgttctgaagtatgtccaaggaaattaagagctggtgcatgaaaagataggaaaacaatccaaatcctagcagttatcaaaagcaagtttataatacaggcaagtgcattcactcctttctatatattttcagggagcaacatttaagagagagtaaacattcactcctttctgtatcttttcagggagtaacatttaagagagagtaagagtatttgtatctaaattggattagaataatttttttcatgtccctttactttcctgtagcttgctgatgaccgtatggcactggtgtcaggcatcagcttagatccagaagcagcgattggtgtgacaaaacggccacctcctaagtgggtggatggagtggatgaagtaagttccatgttagtttcatagcatcttgtttttttaagtaattatgacaatgtattttaagatatctgtcatataaacgaatttggctacacttgaatgtatatttctagaaatactttagctttaggttaagttgtctatgtgtgtgttaatgattttagctgtagttttaacattggtagtaactacctgaattataggaagaaattgaaaccccatgcaacaaggaagaatgtgattttctggtaatttgaattaaaagctgctcacacatcagcaagccaacaagtttgctgaagaccgaattctgtatgctgagtgtagctgatggaggcagaccatagcctgcctggcatcagtggagttctgtgacttcatttgcttagattcagtatgatgttggccggattaagcagaagatgaaagaattggccagccttcatgacaagcatttaaacagacccaccctggatgacagcagcgaagaggaacatgccattgagataactacccaagagatcactcaggtgaggagtgcaagtgagtcctggggaaaccagcgagccttctcatggcaatctcagaaactagagtgttactcagaatcagtctcctggagtcatttcccaacctgaagttctcagagggacctcaagaggccctgaagtcctccagctgtcagcgtaggtacctgtgaggccttggaggtatggggactgtttttcaattgttggcagataactgctgtggacggattaagtaaatatgaaatttcaaacattatcgagttcaatcatttgattttaaaatgtataactaatatcgtatactagtgttaagaaatttcaatgctaaattatagtcctcataattgaaaaaacaacttagtatcctagaaaaaattttttataaatattaaatttgattaattttaaaataataggactagtgttgaaacctcagtgtttacattttttactgaagtctcctgggtgctaattatcagaggagtgtggtgctttgagaaaagccctggggggttggaatgttggaaccctggctcttagcagtttaacagttacacgattctcatttaatccctctgactctagtgttctcatctgtaaaatgggactaataatcatagtaccatcctcataggatgcttgttagggattaaatgagaggaatgcaataataatatgatatatgataatacaggttgaacattcctaatctgaaatccaaaatgctccaaaatttgaaactttcttttgagtgccaatatgacactcaaaggaatgctcattggagcattttggatttcgaattttcagattggggtactcaactagtaggtattctgcaaatattccaaaatctcccgaaatttgaaatcctaaacattgccaatcccaagcatttcggatgagggatactcagcctgtctaacgtgatgatatgtgagcagctgggcacacagcaggccctacatagcaggagctgaaatctagtgaaatctttctgtgtatataaatgaagccacagattccttttatctgttcacctttctctaaaccagactgagtgaacagagcctctcacttctcactctggcttgtgatgtggcagtgttagcagaggggcttctctcccaggcttgccctgagcctcgggcttgttctcttagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgtgagtgctgcccgggcctagtgaagggattttgagtaagaaaagcactttatgttttcttttttgccactattttttcatttagtccagtacctttcattgttagcttttgaacatgctcataccttgtacagtaaagggaagcctcctccccatgtgaaaccctggcttggaatgaaggcacagcgtggggtaccgaccaaggctgggggagggcaccaagatagttcagcatctcagcaaacaaaatttgttttgtgtcaagctgcaagaatttgaaaatcaaccaagcacattttaaaaacctgttgttttctggatgttggggtttgggagagctgctcttcaataggtaaaaagcagttgttattactgaaagccacatatttgcataacaaccaaagtgtttgagagcacctgagaaaacctccccagggtccttgaaacacttcctctgctggcaccacaggtttcacccagcagaccttttcttcccaaatagtgcaaagccagatttcagctctcttctcattctaatcaccctgtaaactgggttttttaaaattgcccttgcaatcaataaagtccccacatactccaaaaaacctagttctccctccctctgacaactggcatatttgtattttaattttattatttccaaaatttgattagggccatatggaattcatactagagatgcttctagagagaaatactgattttttaaaatgttttgtaacagcagttagattaaatatttctgcttcacttagagattctcagatggttgtgtcatttttatcttggcatcaagtgaattgtgcacatttacactgtgacttttgtcttgagtaatcccaaatgcctgcatattgttgtatgtttgtaatcctttactctccctccacccccattggagataggcttctttaaagcggctaagaatatctcaattttgactgttggagtttactctagaattcccccttttaatggtagaacaatactcaggatggtttacatattcaagtaaaatgaattcctatctgtgataggcatgaagaatcgagaggaaagatcccagcattttttcgacacatcagtaccactaatggatgatggagacgataacactctttaccatcgggtacgtgaacgggctgcaaagctgattgctgtgtctgtgcaccccattctgcatctttcacctcctagacctcgatcttctgtgcagtgtcagtggattgatacagttgacttgtatattcatcaggttgttttgcagcaggtggaagaacagccgtactgtttcttcctttccaaaggccacagggagaccttgtaatctgctttccagagcctttgggaaagtggtcaacacgctgccttcttaggaagagcccagagaaacagagggctatcccgggggttttgtttatctgcccttgtggagttggcagacgtgggcttctgtcttccctgctatggcctcagagctttagatcctgctggtttagggaatttgaatctttcctgttagggaaaaatgagtgcttactgtgctttgtagaaatattttcagaattcattttctttaaattattttcattgtctttaaattatatctaaacaagtataccatagctttcctgagagggaaaacaatctatccaacacattgtgcactgtcttgctagggttttacagaggaccagttagttctggtggagcagaacacactgatggtggaagagcgggaacgagagattcgccagattgtacagtccatttctgacctgaatgaaatattcagggacttaggggcgatgattgtagaacaggtacgtgagctggccttcctcgtgaataggttttcctgccatactatctgtaccttctttttcctgtactcctttcagggaaaaaaattggagccaattttcccaacatgtgtgtgcacctgtcctttatgtgtgtgtgggtgtgtgtgtgtgtgtgtgtgtgtgtgtgtgtgtgtatattaatattaatcaaatattaaatttgattaattttaaaataataggactagtgttgaaacctcagtgtttacattttttactgaagtctcctgggtgctaattatcagaggagtgtggtgctttgagaaaagccctggggggttggaatgttggaaccctggctcttagcagtttaacagttacatgattctcatttaatccctctgactctagtgttctcatctgtaaaatgggactaataatcatagtaccatcctcataggatgcttgttagggattaaatgagaggaatgcaataataatatgatatatgataatacaggttgaacattcctaatctgaaatccaaaatgctccaaaatttgaaacttttttttgagtgccaatatgacactcaaaggatatatatacatagcaatcctaatcagaaaatatgaagttcaaaatgctccagaattcaaaactttttgagtgttaacatgatgccacaggtggaaaatccctacacaagacctcatgtgacaggttgcagtcaaaactttgttttatgcacaaaactagtaaaaatattgtggccgggcacggtggctcacatctgtaatcccagcactttggggggctgaggcacatggatcacctgaggtcagcagttcgagaccagcgcggtcaacatggtgaaaccccgtctctgctaaaaatacaaaaaaattagctgggcatggtggcaggtgcctgtaacagctactcgggaggttgaggcaggaggatcgcttgaacctgggaggtagaggttgcagtgagccgagattgcaccattgcactccagcctgggcaacaagagtgaaactctgtctcaaaaaatatatatatatatattgtataaaattactttcaagctatgtatatgaaacattaatggtatatgaaacataaaggtataagaaacattaatgaattttgtgtttagacttgggtcccatccagaatatctcattatgtgtatgcaaatattccaaaatctaaaaaaaaaatcccaaatccaaaacacttctagtctcaagcttttcagataagggatactcagcctgtatatgtgtgtatttacaaattatatacataggctactgtcattccctataagaatattaataaatctttttttgataaatgaagttctaatattctcttcccatgcctcgagggtactcatgtgagcaccctactctagagacctagttgactctgaccgagctcagcaatgattctgacgctatagaagatttcccttctaattttggcaggttattgtgtaatggcaattggaaccactagcgttcaagtagaattaaattgttgttcaccgttaaaatctgattagggcattttattatcttgccagcagggatttgggtcctgatccccctgaaaccaactgcagaatggagtgttcaggctctggaagatccagttacattaattactccagtggttcccagtgaactgctatctcttctaatccagcatgtttccaataaaagctctgttcttcctcatagcccagtgtccccgtcttccaatttaattgtttaagagattaaacaattaaacatcttccccttgagtccaaatttttaattttaggtggtagactggagtttaccatttcctgctctgacccatagagatgtggatccacgtttatagacgtgatagtcaatttgcaggtctacttatgacaggggcgagcttacctggtgttctctgcttacttgaatccaagtacgtaggcagcaaatgggcgcagagcttctgtgctgctcagagcctctgtccactggaccatagatttcttagggccccaggaagtccgaatatggcatttctatggcagctgaaaccaataaggaaacctcagtctgtcagtacttctttctcgtgagctagatgtgatggcactaaccagcattctgccatcgagctcctgacactgcttgagggtgaactccagagccctccgtgtgtacctgcagcacacagggaaggaaaacatcatcttatggatgatgatgtctgtaatttgcatatctcatttttgacgttcagttttcccagttgctattgttgattgtctgtaactgtcatttattacctagggtacagtccttgacagaattgactataacgttgaacagtcctgtatcaaaactgaagatggtttgaaacagcttcacaaggtaatatgtctttcaagacttgggaatcttaggaactattttcaaataatcaagaattggtaagagggttcttttccaccataacgatcttcagcattcttgtgttgtccactctcaatacagtagtgtaaaaagggattcatcatttcatttaaagccaattgtgggggctgttgccgttttattgcagttaatgattccaggtgtatctcacacttaaatccaaaattgctaagaactcctttttgtgacagtaaattctaaagagattggagttctttcttttagaaaatatttcattcttttctaatgcttcttgttttaggaaatcaattgggcatttgctaaaatatgtgttgaaaatctgtctgcttgttgccgttgacttgggcctctcttgtgatacattcctgatgaattgctgatggagaatcattctgcagaagataaaaatctaatcttctctttaattaccacagcatatctgtattaccttgagaaaagagaagtttgttgaagtgagagtagtaattcttttattctgtgctaataaggtagctgtttcagggatgtttttatgatattctcttttaaaaaaatagatggaaagcatcttaggaatcttatcggttataagaaacatgcataaacggctgagactctcatatataattggttacgtattttctttaaaaggaatataacaatacttcacaaattaaataatatccatttccttgtatctttgagacccagtggagtttctagccatataatgagtgttttgccaattcactgttggactactctaccatttttctgaaatcagtcgcttcctataccagagatcgccccatttaatagcagtattgggtttacaaaaagtcagcccttgcactagtctaaccagaagccctgagctgtcttttcagggggcttgttgccatgtgtaggtggatatgagactccagcctgtggtgggaagagaagtctgaccttgtctatgcagggtttttttaagcatttagattaatttggttgccaagccctgtctattaaaagtgaaaactaacttaagtttctcactctgtaatacccaggttttgatgtgctgctgaattatgcattggttttgaagtttcttaaataaaaactagtgaaatatgttttgtaatataacacagataaaaggaaaagctttctctgcgggagtgagcaaatctagtgggaactaaaaattttgttttaggttctactttataaatcattttgagaggttttacagtatattatttagtattggcttccctggtgttctgggttacttattagaaaagtcagcgtgctccatcttccctccagccacaaggctgtaggcagcacgcgcgtgctcggcagtcggctagtctaagggtgattgagcgtcgggagctgctccccatgaccggactctcggtgctgtccccgtgcctgatgtttcctcctggtggatgaggggctcctccaggtgggcgggcaggctcacttaggaaacaagcccaccgcgggggatggagcaggagagattgccattctcgccagggctgccttcccgctgtctcctcctccctcctgtgccatagcaaggtctggaagaggcagcgcatgctctccctggacgtgcctcccggcgccctctgaactctgctgtcctctggctctcctttctcagtgctctgcgtctttcgccagccaggtggggccctttggcatttctctagcaggcatgatggagttcccgctcctgccgagcttccaggatgcggtgttaaggtgaagagatgtgcagggtgcagcctcgtccccagattgagcttggagggctcctttgctgtatcgttagcggcactgggaggacgcgcctcagagggatctttctgcatatgacatccatggggcacacgtgtctgtttttatttcaaaggatgagtttttgtttccaaatttaggggaggtcgaaatggggcctcttccgggtgtctgttgcctacctgccaggtacggtcctccagcccgttgtttccttccgcggtgaaggaactgtgcattcgctccaggaacacggaccgggaacaggcgacccgtgctgcaggggcacttgccacggcctgcaggaggaaaagccgggagaagcaggcccagctgcacccggaagcatgagctttcacttccctgtcaggctttgtcttagtagtaggtttccaacaaatccatttccacgtccagggtaaataagcagcaccaggatcatggggctcttccactcctggtgattgaattccgtgggattgattggagggattacaatcatgtagcctgtagcagagacctcagtcactgtgcagagagatctggaagcctcattctggaaacgagtgggacttgatttgggattttggggaaaatgacggccttttttccctcctctttttgtaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaggtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaa

SEQ ID NO: 15514 - DNA, 9499 bp, Human
cggtggagctgccccgcgcgacagttcttcgccctgggcaaaaatgccaggaaaaagccaaacacggcaggagaaaaatattttcctgtacacccacccagcttctggtggcccctgagagccggcccccaccccccgcaactagtcagggaaaccaggcaggcgtcgtcccaccttgcttgcccccccgccgcaccccaacactcagggaatcctaggtttgcgcctcaagctcgttagagatcagtcgcaaacccaacacctctgctgtcaccagaagacaaccgtcacccctacacccctggggaggggccacgtgggtctcggtgggtagcagccgccgggcagcagcagcctccgtggcgcaagagctgcaaggtggtaatgaaatggagtccacgtgtgcgttcaacaccagaccgtcttcgagcttctccgggattcctgggcgaacacgagccccgcgcaggctcctccctcccctgctcgcccgagcccccgtgcggtccccaacagacagccgggtcgcgtgtcagggcggtggtggagacccggatggctctttgcccgcccccatccctcgctccactctcgctctgcttttgctctttttctttctccgtggacgctcagccaagggattgcgcaagcctcctgctcgcggtccttcaagagcccggagccggggcccagacacaccccaggccaggcgcgcccctgcccctgcccctcgggccgcgctgtccgctcccgggtccccccaccccgaccccacggagctcgcgggccctcggcggcgccctcggcaggccgcatagggcgcagcagctccaccagccggacgcaggagccgcgcgccagaacgcgccgtctcgccgccggaggtgccaaacttcacactcgctgctgctcaggccgcgtcagtccggagggccttggcttggtcgcctgtcgggaacaagggtccgcggacacaaggcgaatgcgtggctcctcggccattccgttcatctcccctttgcgctgcccgttcgtcccccgctcagcctcaagctcttcccggccctcccagctccctgtttctaggccactcccgggaccccacgaagtcccctcaggcccccaagcggaccctggcctcccgcgcccgctctctctgcctcctacgcctctcgcctagcttggctctggaggctgctagaaacaggacatctcgccccgtcaataagaggaccaagtgtaaattcggagccattgaggatcggggtgggatcggatttggagccctttctgccgaggttcttgggcgccagggccccgggattggctgctcctcggtccccttcctcgtgcgttcttcaatctctccttggcacccagtcctcggccttctctccgccctgtccctttccctcctcgcgctccaaaatgcccggagcctggaggcgaggcggggcccgcagtggggcgcgagctgcccctgccccattccgccccctgccggcggggcccgcgcgtcccggggcgctggtgacgcaattcggtgcaactgggagcggcggcggatgcttccgtggcccccagcaggggtcccggggccgtgaacactgagaacgtgccgcgagggggaggcccgggcaccgggatgtgggcgaggggtcgccgccgagacccttccgggctgtcaagctctccgcccgcctccgccccggcggacacacctctccttcccggtcccgctccctctctgcagcctccctctcccaggctcgccgatccctccccctgcacctccccggcgccctcccctccgcgtcccccacccgcgccctttcctcctccccccgccgcccaggcccggggcctccggtaggcccggctgcgccaatccgcgccgcggcccgccccctgacgccgagctgggcccggcgaggccccgcccgctgacgtccgggatttgcatgagttcttgtgcagccgcggcccgggctcagttgtctgagcgagcgcgagccgggagccggggcgggcgcgggcagcggcgggccggccgggctgtgcggggcgagcggcggcggcggcgggggcgcttcggccggggcggcagctgggcgccggcgggagctagcagcgtctgcagccgcgccggccgccagcgccccggcgcgctccggctcggccatggagctgccagctgttggcgagcacgtcttcgcggtggagagcatcgagaagaagcggatccgcaaggtagggcggcgcgggggcggcgagcggcggccggagcggcccgcgaggaggcggggagggggtggggaggctgcgggccgggccggggatcccgcggaagctgatggagtgctgtctcttccccccagggcagagtggagtatctggtgaaatggagaggctggtcgcccaagtaagtcgcggcggagggcgggggcccgggggccgaggcgcggggctcggggccgcggacccgcagagctgctgggggggtggggggagcggacgggaggcggggtggaggtggggtggagggaggagggggtggggaagtcggtggcaggcactggggaagccgagccgccgagcccgagcccggcgccctgtgttgtgctccgctctccgggaaatgccatcactaatttatgcactaaaaggagccggaggagctggagagacgcggggccgagccggggaggccggcggagggagggagggcgcaggcactgactgatgtgcagcagaaaatggctcctttcccctttccctccaccgaacggctccatattgcaaaaccaaaaaaaaaaaattaaaaagcgacgaaaatgcaattgtgtgccttctccctcctagtggtgcagggaggggaagaagaaaggcagaaaatgttgggaactgtcactgcggcgcttttggtggagaattttttttctttaatttgaaatgcgaaggcaccggatggagatagacgcgcaggcacacgcacactcacacacacacacggaggcatatttttgtgttgctgagtatttggggtttgctcgcccgtgacagcgggctcctgggccacgagggggtgtgggggggacgcttggctgttggctatcggattaggggtcaaatggagaacggctgaagccctcgcggggactcggggctggggagaggagggggactgcgactttgcatttcggctgctttgcacgcagggttcctggtgagcaaagtggctttggaacatgtcgcagtaacatgcttaaaattcttgacaactgcaaaataaactgctagtttcattttccttacccctcccctttcttcctgcccttgcgtgtttatttgaggggggggctgtgtatcagggactacgtcaggcctgcggaaatctaccttccacatccacggctaaatgttcataaagacagagtagggccttatgtcactccccacctggaggccgcggcaaaggtggcttttttttttttttttacaccgtgtccccctcccttttcccttgcaagatataacacgtgggaaccggaggagaacatcctggaccccaggctgctgatcgccttccagaacaggtgagcgtcccccacgcagccaccgcctgccacccgtgaccgtatatgggaatggcaaagtgggcgacgcagcaataggaaaggggcgtggagggggctggtgggagccccctccccaaccggcctggatgggcacgctgcggccccagctcctctaaccagcgtccttggcggttgctgcagcttggggtgggggcggggcaaggccagggaaggccaggcttgggttttgggggaagtttgggaagggtgtgtgtgggtggccatgcagctgcccggagaacttggggctgtgcctggttccccaggggcccctcctgttgcaacctgggagccccacccccggagcctaggtgttgctgtcctgcagccactggccgcttggcaccagcacctcgcggtgcagctctgagggagctggcattgtgaaaccgcccggacgtcatggaactgaacttaacctgttggcggctggaggaaagttgacatggccttaaaagctgcacccgcacaccccagggaatttaagcttggtcaggagtagattccatagggtgctgggttgccccccgccccggaccccactgggctgtttggcagggcagggccacccaccctcaaggcaggggggcttggcccaagggcctggggtgggcgctgcttggtggtggaggggtggcttcttctgggggactcatcctcgtgcgcacggttgcttgtcacgctgcagctgctgcagctgggttcgtcgccggtggctgtggttctctgtttcggagagggtagaagggggaagggcgaggaggggaggagcagccggggcccttggagctcggccaccccgctgccttccatctctcctcccccttttattttgcactatttcctgtggcgcgtttggcgctaaaactgtaaactgtagaccctctgagctagccaccggcggggcagggcagttgccctcccgcaatgcagggggggcacgtagctgggatcctgccccattccacctgggagttcaccaccctgtaaccatgtcagcggctgatgccacgttgcataatgggtccctgaagaattaaaacgcaggctgtcgcaatgccacgcaacttcagagtcaggccccggcccccgccctggggcatgtcagaactccccagggttggtccaaggaggcatgggggtggtagctagggtctgtgaggaacccgtttccggcccaggaatgggctgcaactttggcagacactagagaggcatcccactcgtccgtggagggctgggtagtgcctgggaagatccagcccccagctgtggatcacccttaggctggcctgcaggcaggagcctggtggctgtagtgaccggtgcctccgcccatgggctttattcattatttggaaattgaggcagccaggagccagactccgaggaggaggcggtgcttctctaagctgctccggccacgcccacctgctcagctgggaggagcccagcgttcaccaggtggccacaaacctggccacaccctggccttggtggcccgcccccgcccccagcccctaattggctcatttgccgctgtgtaaacaagggcgcagcccctccccctgtttagtgcctggcctttaagaaagagccctcccttctgccggaggcactcgttatcggaatcttaatgaggtcattagcatcccgcgcttctgacgggagggatgaggtcggcgcacacctcgcttgggctggtttgtcttccctggatccccgtgtccactttgcttcgcacagagccacaggcccaaggccgtgggcgggagggccagaggtgcagccctgagcttctgcctcctgagcacagaggtggggcttgggggggtgctggttcgggtgtgggcatcaaagtgggggagccctttgcccaggacctcttgggcagaggagggttggtgtgagggttaagggcgcagaggcctgacctgccctgaactcttgattcctgtgtccggccagccctacctgatgctctctgaagcgggggggggggcatcacagaagattccggaattagcgggtagggggcgaccctgaggctaacagcactgccctctgttccctcccacccagggaacggcaggagcagctgatgggatatcggaagagagggccgaagcccaaaccgctagtggtgcaggtgaatacacacggccgcccctgggcacccccttgacatggccaccagagctgcctccaggcctggggatggggggggtggtggtggttcctcccagcaccctgaccctgttccctttctactagacctcccacctcctgccccccatgaggcagctgcggacctggtgggggctgggacgctccagaaactcccggcatgcggtggggctgtctcctccctcctctcacccctgcacccgttccctcaggtgcctacctttgcccgtcgttccaatgtcctgaccggcctccaggactcctccactgacaaccgtgccaagctggatttgggcgcgcaggggaagggccaggggcatcagtacgagctcaacagcaagaagcaccaccagtaccagccgcacagcaaggagcgggcgggcaagcccccgccgccgggcaagagcggcaagtactactaccagctcaacagcaagaagcaccacccctaccagcccgaccccaaaatgtacgacctgcagtaccagggcggccacaaggaggcgcccagccccacctgcccggacctgggggccaagagccacccgcccgacaagtgggcgcaaggtgcgggggccaaaggctacctgggggcggtgaagcccctggccggtgcggcgggtgctccaggcaaaggctccgagaagggcccccccaacggaatgatgccggcccccaaagaggctgtgacgggcaacgggattgggggcaagatgaagatagtcaagaacaagaacaagaacggacgcatcgtgatcgtgatgagcaaatacatggagaacggcatgcaggcggtgaagatcaagtccggcgaggtggcagagggggaggctcgctcccccagccacaagaagcgggcagccgacgagcgccaccctcctgccgacaggacttttaaaaaggcggcgggcgcagaggagaagaaggtggaggcgccgcccaagaggagggaggaggaggtgtccggggttagcgatccgcagccccaggatgccggctcccgcaagctgtccccgaccaaggaggcctttggagagcagcccctgcagctcaccaccaagcccgacctgcttgcctgggacccggcccggaacacgcacccgccctcacaccacccgcacccgcacccccatcaccaccaccaccaccaccaccaccaccaccacgccgtcggcctgaatctctcccacgtgcgcaagcgctgcctctccgagacccacggcgagcgcgagccctgcaagaagcggctgactgcgcgcagcatcagcacccccacctgcctggggggcagcccagccgctgagcgcccggccgacctgccaccagccgccgccctcccgcagcccgaggtcatcctgctagactcagacctggatgaacccatagacttgcgctgcgtcaagacgcgcagcgaggccggggagccgcccagctccctccaggtgaagcccgagacaccggcgtcggcggcggtggcggtggcggcggcagcggcacccaccacgacggcggagaagcctccagccgaggcccaggacgaacctgcagagtcgctgagcgagttcaagcccttctttgggaatataattatcaccgacgtcaccgcgaactgcctcaccgttactttcaaggagtacgtgacggtgtagccggagggcgtcggaaggggaagcgccattcccgcgggggggcggggagctgagcacctggggcctcggggcgggctcccctctcgccaacccgccaaccgcgagagacccaggctggcccccagggtgaggacgcccggagcggaggtaaccatgttccccctgcggcggctgtcagacctgggcggaggccccttccacgcggtgccggcggggctcgccctctcctgcccttccccgctggagatggacccccggaacggacagggcagctctgcgcccggcctcagagttctagtattatattttaaccgtgctaacttgtcaagtgctgactctactcccgtttgtacgtggtgttattattgaaatgtattgtttgagctcaaaaggcccgaccaccccccttcgggctgctatatatatatttatttgtaggtatttatatattgaaatataaaaacctagatttatggagtttcctctagatcatgttatattctatatcagacaaactattttcttttgacctttcttcccctccatccagtatttcggttgatttcattttctcccctctcttccccttccacgaactgcaataccagtaaccttggtatatattttttgatactgtacacatggatgtcttgtttctatgtgcaaaaaaaaaaaaaaaaaaagtttgttaaaaggctacacgagctctctagaaactgctgctactagaaatgtctaaactataagcttccaactattacctgcttgaatgtaaatattaaatggagatgttgaaggtgcattttcgctgtttgagatgagcggacccctctcgccaccaactccgccttcgagccctgtgctgaacctttgcaccagcgaagtgggctggttttgcgggccgcggcgccggcgcaggagggtgaccccgctccctgggaagtcgagaggcgcccggctgggaaggggaattcctgcgggggggtgggtgtgggagccgtccccgcccccagggctttccggccggcggtgcccaaggcactggcaaaccctgggttctgggtaggggaggagggggtgcaggggtgggcggcgcggacacgcgggtggggctagtctccctcgcggcacccactgggcagcggctgacctttggctctcctcccccgtagcctccacccctggggctcaacacacccaggcgcaagccctggcggggcagggaggttccttcttaataatcgcgcccggtagggcaggttccgcggggcggggacccccagcctctccggcgtccctggctggcatcgccggccctgccccactgaggaagctgccgaggcccttgctcttcgggctctctccccggaaaccaccaggccagaggctcccactagaggcgcggcgagcgctgccggggtggggggcggggggcttcctgcgagatggatggggacggggaggagggcgggggagcgaggcctgccacccccacttccttagcgaggagagctgggactcctcacccttctcccttagggtggcaaggccaaggcccttggtgtcgcgggggaggaaggggttaaggtcccagagggggcgacgggactgggccgaactccggggtgcggctcagcgggccaggaagccgcgacccgggaacgcggcggcggtggccagctttctgcagacgcagcgatcttcctcctggttgaggtggccgcacagggccagggaccgcggggctgggggcctggcgggcgcggggctgctcccggcctccgaagcccttcccctgcccgcctgggaccaaggggcccgggtctgtgcggggcgccagggcggaagaggtcaacgtggttcagagtggtggggggtggcgaggtggcgagagagccagtgtggggaaggctggggagagatgagggccaggagggcggggaggcctgaatgcggacagtgtggccagtgttggctgcaggccaccagcggctggacgtgggggaggggagcccagcatgggga

SEQ ID NO: 15515 - DNA, 43376 bp, Human
ttttgtggttgcatttgaagttcactatctcttgaccacacaaccctagcccttctactcccaccctgctgtctcaggttaatctcaggcaatggtgtaaagaaggccaagtttgtttccctggagtcccacgggctctagcaataatgcttcccttttctcatgagtgccccgccacccaccccccttcaccatcactacacacaaatgccctgcagtgggtggaatgtagttacttcaggttgtgcctgatttgtctctcaagcaaaactccagcaggccattccctcagggccctgctctcagatctggaactgatagactaattggggctaatgtgataatgggaaataatgaaatttgttgtttttatcagtgtgtatatggggcggggtttacatttgcattttcacagggcccttggcaagttcacagggttgaacagttgggaagggtgggaatgtctggggcaggttagggaggcagagggatttattagaactcccctaaactgcactgaccaaagcctcaagcccttcttcaagacctgcccagcttccaagaccttcccaagtccacccttgttttcccactgagtcttttacactttcagaaacctctgaatttgtgtagaaactagaaaaaataagtaagaaaagactaatactactgcacactcactgttcccccttaatataataaccagtttttattctattcagtcagcctttgaccataagcagaccttttttttttctttttaacacaagtaacttcttggttttgatcacaaaatctttatctctgccaaatctcaacttcccttccctctcccacaaaagggaggcccgttgagtcaaagaaatctgcttagacactttgctcatgccaggccagtgtcctggaaggttcaacagagaaagttaatggttgggggatggtatttttctttgctaggagcagtcattcacccgtatgggagaaggtacatttgtgacccagtgaagcaggtacaggtaactccccatatgtcccttggcccaagggaatagaggttgcctgggtatttgaatccgtagatcctccctaatattccaccttcttcttgtccaaactgtgcttttttatttccagtttcagcattttggtcttctcatctctaactcttatagggagtgtcaataaaccttttaaaaaagatcatgtaagtgtcaagaggaagtgaagaacctagataatccaccaaccggataatcagctcttgcatatttgagagttgactgcttgacctaagcatctcctcataaggtaccctccctcccaggaccttccctttcaaacctctcaaggctcttacctggggccaggggagataggcttttcaaagtccattgaattgccaagagtctctgtcaagaaggcagtcatggtgcctggagagggaacttgctgggagccccttcagagcctggtacttatagagctagggaaaagatcttgatgccaaagcagggtggactaaatacagactaataaatgagacaggtgctcaagagggcccctccataccatcatctcctccagatttggacttctactcactttgcttttacattccctcttcccgatggtgtctttggtgagcagggtgcttttcacctgaaacagcctctgagctgaaaagaacagtcaccaccaaatcaattcctcatccattaacaggttgtctctctgttcttgagacacaggcattacctggttagacctgttttgtttgaacactaacgtgtgagttggccaaatgcaaatgagccaatgtttgtaatcctttattttatttttttaaagggctgggtagccaatcagaagagggggaagtgacttagggaattcccggttggtggcttattgcttaacatcctacaaaatgatttaaaattattgttatatgcatttatcttcactctgatgagggctcagacttgataacgcccgtggtgccccatccctataggagctggtgagattgcagcctgctgcctcccctccatcagccacagctattggatttcccacccagaatctttaggtaaatgaggtaagtcctgatttttaaaacttcttttgaatctggaatccaaacacctgagtggaaagagaagcctgctttaaactggacagatgaaactagaacagactcttggagacggctggcaggaagtgaagctcaccttacctgggcttacctcactgggtcaaatcagaattttattttggagggcaggttggctactttggatattatctgtgaatttcctgcattgtctggacttctaatctctgtgaatttaaaagccccctcgtttccctatgcctgggtggcaaaaccattcccctgggttgaattcttctggaacaaataggcagctagagataggtggctctgatatagctcagagaagaagtggttggctaagtagctgttagggctcagagtacacggtctcgctttctagagatgtcttctgctggtaatttttctgacttatgagctacatggaaaggccaatttgtttttaatatgttccaggactggaaaatggctagaaataggcaagaacatacacaatcacactggaaaaagtggccaggcagccaaggcaggcagaggtattggggagagctgaatatctacaaaaacaaaaattcagaaaaaacaaaaatcaattttggcaaagggcttcactgtataacaaggggacaaactaaccctttgtttacaaactaaccctttgtttactccattttgtccagaaaatacaacaatcagttttggcaaagggcttcactgtgtaacaaggggacaaactaaccctttgtttactccattttgggagactatgatcagacaggcagttgtgactcagcagcaacaaatgccttctgagacagggattcttttgattttgcttggacattgtggagaagtgttagccccaatgtggactgatctgggaacagtgggaaattaacttcttgttggtaaatatcaggctgaggtgagaaagcgacattttcaccgtccatctttgctgatttaccatgctcccaggatggtgggagtgtgtgtttttaagatggagagtgtatgcttctgggttcaagttcacaggtgtctctgctggttatctgcactcaccttggtaacagggagaaagtgagtgaatggattccaagaacttactgatggaagtctaattcaggagttggttctgcagccatggaggtaaagatgtgttgatagtctttcaatgtgtaaaagggcaattagagattctgtgtgactgtgtgttaattccactggggtcaggggaaaaatttatttctaacagaaaagaagaagatacgttattaggaagaatttcatggctaggagatactatcagaaaaggctcttaagagattttaaggatgactttaatagccgcatttgaagtttgcagaggatccacttttcctctttttgtgacctaaaattctgggatgatgaaataactcaccaattccatcttcttataatatggagtcatgtagacaacaccattttcacacaaatggctaatggtatttaaaaaccatgatggaatgtgaattgggagtcatttggaggtctgtagttgaacttgaaaaaataataaatgtaatggagacaatatttcaccgtgtttccaaaatattttacagaggcattttaaatgaaagtcactttgagggaacagctgtgctgtaagttctcttacatgaccgcgcaagatggtagccttcatcaagacctctcaaggtagtgtgggtagggtgacgtgtttgattcaggcctcgtttgttatgaaaaggctcaaattcaattgtatttgttatttttttggttaaaaagcacctatttgttcaattcaaacaatcctttttggtttttttttgagatgaagtctccgtcgcccagcctggagtgcagtggcatgatcttggctgactgcaacctccgcctcccaggttcaagtgattctcccaactcagccccccgagtagctgggattacatgtgctcgccactatgcccagttaagttttgtatttttagtagagacggggttttgccatgtcagccaggctggttttgaactcctgacctcaggtgatccacctgcctcagcctcccaaagtgctgggattataggcttcagccaccgtgcccagccatattgttttcatttttaatctattagtctatcgtgatctcccagtggaagtatctttggcctttgtggacgtcaggaaagccctacattcccactcgcgattccatgtttatgggtaccctaaatgctcccattaattgaccaactttaccctgatcttctttcaatatctttctgactccttgaaggtatgagacaaaatggaaactgagaggttaaaaggtttactaggttgcattcaattagcgaattggaaactggaaggagctcctatcgggtctcaggtcagaacgtgagtgcttttggccaaagttcacttctgaggaagtagaatttcgctttctggaatcttgcgatattttatttcctctatatctttcccatgcccccgacccacccaatctccacaaatttggggatttgagcactgggttgtgatcgttagaccatcttgcttttctgaaagcccagggcaagacccctgcttcatgtcacagtatcaaacacagacatagaagcttgtacaaattattgagaagttattgtcttttctcccttcctccatatggagtcatctctatgccctttcatacagatgtgatttacgaagacctctgggttaggggtggggtggtgagcaagaatcccgtggcagaatctgctaacacacttgagaagcaatgttgtggttttaaggaactcaatctaaagcttgaacctgattttcagggataccattttgctgccgtttcagcccatttctcttgttaagatcgctctctggtagagttgacgtgacactcatttctgttgtgggtggggccctggttgggaggcattggctccactgcagcctgggtgtctagagaccacattctcaccctgcctttgttactgggaaaccgaacgcggcgctgtggctttcagcttgggtaagccgggtctgcggcggggattgccatctgaagacagaggcaggagggcagccacaccttgcccaggttctcttaaatctcttgctctataactgaaaggagggcatagataattaactttatttgacatttttcatatctaatttttaagaatatgattttaaaataatagatttgttctaaagagcaaacaatcttgctgttattaaaaacgtgtttacttaaattgaacggggtttcaaagggccaagctactaagctgtgcaggaaacaaacagtgcagtgaggagaatggctcctcaccacagctattcttagggtgggacatagtttcaagccaaatgacattgatgtccggaaaccaggatgtgctgaagtagaaatttccagggatccctcagagttatttgctaaaatgtttattattcttcagaggggggtggaaatatttctttaagagtcttccttgaagaattttgaactccagctttggagtgatgggagcacagtgcagggaaggcgggatgtgaggtggtgtgctggacggcagtctagggacctggtctagcactggcagagctgtgtgtcccagagcacacattcccctttgccaggctttagtttcctcctctaggcaaaagggtttgaacctgaccatctttaagatccattttaaccctcagattctgtggctgtggtgattgggggtggtgggagtacctgggggtcagcaggataagcacgaatctgtgagagctgagaacaggtgggagaagccttctaaggatgaggcaggaaagattagcaagagcccttaaatggattctttagggccttcagaattttggctaaaggctatactagtggaggtactaagacctgacacctggagcctttattaaggatgttagaatccactcccatgacaacatcccagctttgccaatttgcctcatgtgtctcaagctggtgggaatgtagaagtggatgaaacagactgttttgtgatggcagggaacagcctatgcacaggggcaggtgctctactggtgtcttctataaaacgccaaagcagcccgccagaaaatggacatttaggcactcgtggtgtctactgagtttgtatggtactgatgagcttgcttgactgattatccatgacttactgagtagatcgaacgtatgtggactcacttctcctagaggaagaccctgtggctgccccagccactgagcagcctaacctggagaccctgatgtgcccagaaagcgtcaaccttgtatctggagaaaccagaacttgcaacagggccaagcagggtggcccatttaaagaggctcctagggttttaattgaccttgttttaaaagagacaccctgtaaaatactcctatgaaaacttatttcacaagcacctaaccgcattctgtctttggtttgttttacggggccgggccccttgttctggtcaattggtctgcattatctctcctcctccaatctcaccacacaccctggcctctgggaggcttcctcccttctttttttttgtttgttttgtttttttagcatcttagttgttactaggggtacttgcctacttatttaaaatatggccagtataggtgcatacaaaatgtgctttctgattaaaacaaagccaaaaataaaaagaaaccaaaatgcctattatagtagttggatttttagactaacagaccacctcattaaccctgtcattttaccataacaacttatttttatctttgtatgaccttgtctcaatgtcctttttctttgatgttgttgcaattatgaacatcaaatttcatagctgcttttccaccccactttctatcacagaagcacaataaataatcttgggggctgggctcttgttggcccaactgtggcttcaaaacatttcagttgcctgtccagccctttcttagcctgatacaacatcccccaaaagtctgttgagcttttcctggaataagaagagggtcttctactttttgaatagagcaatggagattggagaatatggtcatcttgtggaggttattccaggcttcttcttaggaaccttaaaaaaaatctcctcagaagggctgatgatatattctggacaataaggtgagcagagtctgaaagatgagagcaattttcaatcttgtcatgatttcatctagtcagcctcatttcatctagtcatgaggctgactaatgataagacttgctttgtctttgcagtgtactctagatttgactctaaattcagcctctgtcttgatcatgcccacttagaaaattagagtgcagctagctcaccttttagtcatcttaattccactaggcagaaggctgtgggtcaaggaatgttgatggagtaaaatttgactgcatgtgtatctgaaggggtaggaggctaagagattttatggcttggaagctgctgagatgtggtgtaaagaacactggacttagagtccagacacctgagtttaagctggactctaccactgggtagttgaatgactttgagtgagttatataagctctagcatctaagttttctcatctggaaaatggagttaataacatctactgcattgggctgttgtaaagattaaattaacaaagaatgtgaaagcacctgaacaaaagcttgtgagtaaataattagtaatttgtggaatgaacatcaagggaagtcttcaatttgggtgttttcagtgagtttctgttgggtcagagtgaatggatattaaattctgggattttggtttgtgtgtgtgtgtgtgtgtgtgtgtgtgtgtgtggcgatcaacattggttcttcactgtgaccttaggaaagaaatgcaatagggtttttattgggaaggtgggtagcagggagatgcatgaaccatattaaggggggacctccaaattgaaccttgttttgagtcaactgcaaaccacaaccaaggaggtcctgggagacctggggtgacttggggtgattgggtatgcagcacattcctgttcttgtgtcctgatgcctggcaagtagggacctgcagaaaatactgattctcctccaggcagttcacatgactagcttttaggagtgagtataccgttgcccacccctaaaattcttgatcatgtctccagatgtctactgaccactgatgctgaggtcatgaatcttgggcattctagaggctttgggaaaaaaaattctacttacttcttttgcccagacactctggggtctacctcttggtaaattattcaaatgaggtttctggtcatgcaaatgtggtttctagagcctatttgaattgaacaagtagttcttattattagtaaaacagcaaggatccctaacttggggtccaagggtaaattcagggtttctgtgaacttggatgtaaaaaaaaattgtctttattttcaataatctctaactagaatttaacattttctttcaatatgaatgtaggcaaaactccatggtagtattagctgcaattgtgactatcaccaggataaatcacattttcatgtcttattacacctattacatatatcacaaaaagtgggtatttgatatcaagttagatctgcactaggtagatattcttatttaatgtattaacaaggaagcacatatattgttatcaggttggtgcaaaagtaattgtggttcttgccattaaaaataattacaaaaacagccagtctggccaacatggcgaaaccccatctctactaaaaatacaggtgtggtagcacacacctgtaatcccagctacttgggaggctgaggcaggagaatcatttgaacctgggaagcagaggctgcagtgagccaagatcacaccactgcactctagcctgagcaacagagtgagactctgtctcaaaaaaattaaaaaataaaaaaaaactctgtaattacttttgcaccaacataatatgatatcacacatttattttaaaaagtattttgacattgtcttttaatataaatttttttaaatcttataatattttaatttgtcatgtaaaaatattattttgagaagaggcctgtaggcctcactagattacaaaacagatccatcgtacagatgaaaggttaagaacacctcatttacagcattctctcacacacgactaacgaaatgacttctgaacagcgccagttgatagatgttctctgccaaaaggggaatatgatcttcccatatgttcctgcctatgggtagccttggagttgtgaagggactttggcataatgaagatgataataagaatgataatggtaatttgttgagtgcctgctgtaagccaggtggttacagtcctgttcaatgtcatgtttagtttaatcctcccaatgacctcaggaggtagtgcatggaacaaagacagaagagatcccctgcccacccacggtaatgaaacatgggtacaggtgaaggcaaaagtggggactgaccctttggagatggctgatgtcacgagtgtgcaacctgtgcagttccacggggccccatgcttagaaaggttccatgtttggtttaaggctctgctgttgccatcttaaaattcttcgtaagttttgaacaaagggccctgcatgttccttttacactgagctctgcaaatgatgtagctggtcctgcctctggttatggtgaaatggaatgtatgacaactcctgagactgggagtctgggaagctgctgcggagagccctctcctcattttcatcaggctcagctacgcaacctctggtggaaagctatggcctgttgaggagggaggatgtcgtttttgagttagtgagttttccagttttgtttgagctccaaagctttcctccaaacaactggaaggatggctgaataattggctgaaagggatttaatcccttgaaaaacctttctggtagggagttgctggcaatactggtgggtttttcatgattttattttacagagggcttgctacgtaaaccagtgagccaggagaaacagaataaagtctgttctggaaggaaaaatgagacctggtgtgccacgagtctagtgttctcataggaaggctctaaaaacaaactcagctttcctgctattgaatgattatctctataaaaggaaactttacttcttctaaaggagaggtcgtctaatttgtgagaaaattcagatgttatttgcttcttaagctgcaaggatgctaatgaaataattctcatgaagttctgttggtgttttagggctaagtttttatagactgttccaaaattcaaaacagggatgtggacgtagtgatggtggaagaggggaagacttttcctcgatttctttgcctgagggatggaattcaggctcccccaataacatattcatggtctttctctggtcagtcagtgatgttcataacacaagcaagcctgtcatcaggaccaatctgtgatggctgagacatcaggtgctcttccaaaagagccataattcacccttcatttcccaaggtttttttttcttgctgttattactgctcttttatcatggttaataagtctgaggtggcttcagacagccagtcctaacccctgagtcaatctggggcctctaacaggaagccagactgaagttctgatagatgggtttgagtggctgtgaactgtgtttctgtagcatccagactgatttgcactgaaagggagcttccatattagggtacaaggatgatcaatatgtctcctgtttatatttggtggaaaaagttgtgggaatcgtgcttaaaggatctcaactttgaaattaaaagtataacgtcctaacagacatcctccttctctttagaaacacaaggatccattttcaagtaatttcaaaagaactatgttgctttccccaccccttcccaagtacacttattataatatatccagtccatttgctagctttgtgtctttagaaaagttgcttaacctctctctgtaaaatggtgcttatattagtactaacattcagggttattgtgaggattaaatgaggtaattcatgtaatgactagttctatttctagcacaatttaaaccctcaacaaatatgaactattatcactgtcatagtttttgttgttgttttctaattatataatcttcaagattctgagatgggggctgttgctctttccttgacttgaacatcttggtcttttcctaggaggaaacttgactcttgaaatggtcaaatccattgtcctagttcatcctgacccctccctggctccaatccccaccccttaccgtcctccacccttcctacattcctgcacagttggtcttatttatttttcagtcaactaagggtgttgttaaatcttttatttttctgctgcccgatttggttctaagcactccactccctacgctgctcataacaagaatgcctgggaacgctcagtcagccatatccctcccctgtcggaacacccagttcttaatgctcctggagaggcaacatttctgaggccccactgccataagcccccctcccccatgaagccagtggtctggtagtaatgaacccccaacggcccggagaaaactggggcaaggtgtttgtctggggaaatgttgcatgttgccttgactgtgctttcttctacaaagcttaaaaagagatattatattattttatttttatttttatttttgagatggagtcttacttggttgcccaggctgggtgtgcagtggcacagtcatggctcactgcaacctccacctcctgggttcaagtgattctcctgcctcagcctcccaagtagctgggactacaggcacatgccaccatgcctggctaatttgtatatttttagtagagacggggtttcaccatattaactacattggtcttgaactcctgacctcaagtgatatgcccgcctcggactcccaaagtgctgggattaaaagcatgagccactgcgcccggccaaaaagagatattcaaaagctccctctgactgtgtgtgctgaaggctgagtgctgatgccattgcttaattaatgttgttcatgatctccatttgggcgatttgtttagctccttgtggccctttttggacttagcttatcatgtgacattgacaaattaatgagaagtgagcatgtgatgatgcttggattaggacagaaatcacatctaggacatctcaggccctttccacctgggacctgaggcctcaaatctcttggcaggagatgagtgggtctacacagcccgattttgaggtaggtgtggctagcctcatttatgcgatgggaaaactgtggtccgggaaccaggggttttcaaattatgctttttgcccagggctggatgtaggatgtctgggggagaggcttgactgagatctgggtacactgagcctccactttaggaggtaacctagagactacacctactccctaaactgtattgacttttggaagtcaaccatttagaagagtgtggttttggtttcgatcgtatcccagcagtcttttctctgcccttgttaatctgattcatgatctgaacctgggctggctggaggctggccatgtcactttgcagaccatggacacccctgagtgccctcacagaaccagccaatggaaaagtacaacgtcttctggcttctcagccttgccatctccctctggcctatttgatacccccttttatattgagggagtgaaaatgtagcatccaaactgaaaacgcaggtttttctttggtttttataggaaaaacaaattggcatgaacactcagtcaaaccagctcaggctgtttgggcagatgcctttctttgcttttttctgtttattttcctacaaatcaatgcttaactgcgttgttatcggagcagagcaacaggtgcaaaaaaataactctgctgccaactcaaatgaaaaggtagggcttataccctctgggaggtattcagaagataacagaagcccctgccagcaactgaattaacagctctgtttacggtgggttttatgttaacaacctgctcctgaccctcctacacataaacacaccattgtctcagagagagacattcagccatccagacaacccactgctttattctgccctgagtggagattggttttggctcaggctgctttgtgaaactcagaagcattatcctctctgccaactccacgtcctagtcagagttttctgtgaaggcaagggcatggggttgccggagagaagaggattggtcctgcttttaagcctagctgaaattcttttcaaggttggtcattctcaaatgccagagagggttgcccggctctctctgctcttgccccattccattcacaacaggaggtggggaatgagctcagatgactttggaaggagccactattattttggaagccgtgtccttgtgaatagtccatcagggtagggcagcgtctatgttttgttaactattgtatcgccagcacctagcaaagtgcccagcatctagtagacacttggtaaatatgtatgaattacagagggtctgagacaatattgtaatggccggataagcatttcttggtaatagtttctttctgctgaaagctgagagactaattgtcttctgtatgagggcttaagtccagggtaattaagtaatcttttgaaggactgagatggaggtgggatggggttagggtggcttggccagccttgagatgctcctgatgcaagtaaccatcagagagatcctctgcaagcgctatattctggggccagatttgtctgttcggacttcagaactcatacttttgagtatccaattattgttgaatttgaccatttggtattaatagaactaagcaattccctcaagttggcaaataatataatagtaggttatctgcagatggattagaggttgaattctctacattgaatcttttgtctctaactttataaggacttgcttgcatttatggacatttctttcaaggctggtatctcctggagttgatcatcttgtggtgggaaagggaagggaggcaagtgggtaagtctatatagaccagaaaatctcaatggcgagagtgttcaagacttcgttaagggaggttctcagaaatgcagattttagtttagagatctggggtttcagtagccaaacattgttgactctaacaacatgggggtactgagcattaggacctattttatttcaagttggcaaataatacagtgataggttgtccacagaggcccacagaaaacaagcaaaaccaggaggatgtaaatgtttggaagaagaggagagtcaaagtttcttttgagggctcaaaagcctctgtgatgttttacaatctgaagcttgccctattcttaatcatatctgatgggtttgataaaggccctgggggtcatcttaggcaagcttgtcttttgatcaacttgggtgcctgccactgtcagtatgtgctgcctagcctgggtctgacaccaagactgataaagatcagcatactatgtatatttccaaatggcttacagtcaataaagtgtacctataatggatccagacttggcctcccagtgctgcattattggtcatgaaaacccttgaaaccccagcaataatacctcagatgttgcccctgggaacgtgaaaaatgtctgtttcaaaacacattataaggctatgaaattatctgtgatgtaatcccaagagaatcaaatacattccccaagcttgattcacaattcaattcatttgtaaaaacacaaatgattgtatgtattatattcagttgcctttcacatgtacatggatttttttttctcttatttgggagtagtcctttgaaacgacagtcatattgaaacaggaagtcagtaagctgttgcaacatccttagggcaaatgctgtgaattcacctgctggtaactttgattaaggactgagaatggtgtgggtatcgctgtcatcacaaaagtaattatttaaaaggactaattgctcctttggcttcagaggtaaaaatgcccacatggcagccagttctgtggcagtttggggataatgtggttggatgaataagggagctaggaagaaggctgatggtggccttgactctcaatcccctggggctggggacagggaatgcaggtgcaagccctggttaagatctgctccgtggccctggtggttcccagtgtaccttcacccttgcagcaggagcaaaccatgctgtctggcctgaggtctgattcaggtaaagcataaacaattatggaccagtcgatttcccaaatacaaaattaaaataactttattgagtcatagggggataatttacattatatatgcacgtatgtatttatgcatgcatatgaatatatatacatatatttgtatataagcttgataaaggtgtaaggcagcagacggcacagggagaatgctgtgaccatgtctagaatgggagtcaaagtgagaatgagtcttctctggcaaagcaccctcttctcagcagagagtggcccagttcccaggttttattgcaagacaatctgagtttgaattctcttccagttccaattctttctaaactgtgtgaccttgaacaagtcacctaactcctctgtgcctcagagaggccatctgttaaatgacataatgcctcctagagttgttgtgagcattgattgagataatctgtttaaaccagcagtgcagagctggtacattttaagtgttcagtaagtcctaattactataatatagttattattattatttttaaagtgtttaatcctgagtctcagtagccccatcactgagcaaaagaaagacctccctccagctgagcaggcccaagctggcctgcgttggtctcttctggaaggttcgctctgtatatttaagaagggaggccagtggagcagtccttgggcttgttaggaatcccgaggctgagcagagcctcctgggtcttgggatgtgtggttccagttccctgccagtggcccagggttttttcttgcttttctgtccctattagccctagccccaatccgaaaccttattctttttttttttttttttttgagatggagtttcactctttttgcccaggctggagtacaatggtgtgatctcagctcactgcaacctctacctcccgggttcaagtgattctcctgcctcagcctcccaagtagcaaaccttattctttgcagtatttgagcattctctgtgctaagggactcagaggaaagagaaacctttagccgttctctatcaggagcttgcgttttagacatgctgctcttcctggtctttttttttttttttttttgcacctccaaaccagctatggtatgtgggagtgcaaagcctttgacaacacagagcttaggagcatatgccttaccactgttcttggcagccttggcaatgtgtctagtgagaggaagggggacaggagggatggctttcgtcctttgggtaagaactgtgcccagccagaggggaacatcatggcttctgcaagcagagtccaagccccgctgtttatagttcagccataatggtacgtctacacagcagctctcggaatagggagtggggaggcatgagatctagtcctaggctccactgtgccagtcagccagaactggagaagactgtacagataagagagctttgaagctttgctcgaaatgaacttggctctcaatttcctccttgagagttcaataaaataaaaactacaagtatgattatgattattataaaaaccagcaaacatttatcaaatacttactatgtgtcatgcttttccaagcattttacaggtatcatttcattgttgtctttcgacaacacttttcatgtcatctctactttatagatgaggaaactgaggtcctgagaagttaaataacttgtccaaacttgccccattaggaaattggcaaagccaggatttgatctgtggccatgtaactccagagcctggggctcccaaccatgatcctgcttctgaggagtctactcctaccacaaggatgtccccagtgccagccaacacagtttaaacagagactcatgggcagaccctctaataagcatagacattgactagacacttgctacatatgagacattatgctggggactttacaaataatctcatttagtcctcatattagctccaccttccaaagtggaattttgttatgtggggagactgaggtggtagagaggatagaaattctccaaggtcaacatagcccaccaagccacagtaccaagatttcaaccctggccgtttgaatcatgagcccttattcttttaagagcttccctcaagacatgtggcaccacggccgggcccggtggctcacgcctgtaatcccagcactttgggaggccaaggcaggcagatcacctgaggtcaggagttcgagaccagcctcaacatggagaaacccagtctctactaaaaatacaaaattagccgggcgtggtggtgcatgcctataatcccagctacttgggaggctgaggcaggagaattgcttgaacctgggaggtggaggttgtggtgagccgagattgcgccattgcactccattctgggcaacaagagcgaaacttcatctcaaaaaaaaaaaaaaaaaaaagacatgcggcactactaggctgcttttcaagctcctcacactcttgaatgtgtcctctcaactcagcttttagtgggattcagtctctgtggctaggctttaccttctgctatgcccatatttgccaccgaccagcagccaaaataggagactcttaaactttagggttagaccaagtgctctgttccccctgctccccttcatgggtccaggctgtgcatggtggtcagggtggtgcttttctggaagcaagcccttggcgaagcaagcctggagaagcaggcgcatggggctgggatgtgtctctgtgtggctggcacagaagcagtccaagtgcttggcaactcagggcactgcgggagtttgtgtgtacctgaaactgcccttaaaagaagtgagatgcggaggctggcctatctcccgccatgtctcaggctggtcatttagcacagaacagtgctttcttgctgcaaaaagaatttcagattggccaagccccagtggcccataattttaggggagcttatggcacattgtaggggacttgctgcctaaggctaaataggtcttggcaagaagcctggcatgttgtacttgccagttcttcagtctattgggtagcacacagggctccttctcttcaaataaagagtacgattctgccccacaactgtgagtcttacaaacttctgcccaaagaggtgaagtttgggaaaaatgtcaacctctggacaatcagtagtgtctcaaaatcaaatacacttccctccaattgttcctacctatgaaaaaggatagggaaatatatatgaaaaaaatctcaggataatctacatttcatttcactcctttttttttttttcctttttgagtcagagtctcgctctgttgcccaggctggagtacagtggctcgagctcggctcgctgcaacctctgactcctgggttcaagcgattctcctgcctcaacctcccgagtagctgggattacaggcatgcaccaccacacccagctaatttttgtatttttagtagagacagggtttcaccatgttggccaggctggtctcgaactcctgacctcaagtcatccacccgcctcggcctcccaaagtgctgggattacaggcgtgagccatcgcacccggtcacacttcactctttgagtttgaaataagaggtatagtttttctttgtgtgtgcagtttgtaatagctcaggtaataatttatacaatctccccagaatacataccacctgggaacagacaaaggtggctctgatacccagtgtattctcttaaaccttcacagatcaggcaattactctataggtaccaggcactctgctgtgggctttgaggtgccttgtctcatttaaccctccagcaagcctatgcctattctccgggagaggaaatggcacccaggaaggctaagggacagcctaagtttgtcacgtcagtaagagcaaagcctgagctgtctgcctccacaagcttttaaccagtattctccactgggggtggtttttgcctcagggacatggtgtgtgtggagggggtgctgctggcatctagagggtaggggccaggggtgctgctacacatcttacaatccacaggccagcccccacagaagggattgtccacatttcagtggtggagaggttgagaaactctgcttttaaccactacctagggtggctgaggattcctcctctgcctccccatccgaggttcctgcctccagcagaagatggggagaagtgagttcttttcccagcttgcttttgactcccagggtggagtcattctcacttaggctctgaactggggattcagtcctggaagaaataaaatgtgttagaggaacaccttgagaattaatgtttaaagaagggaaaggaaactgattttgatgggggacatgtttgccaggggctagacaagacacctttagacccattataattatttatctttcaaaacagcccttaggcttaggagaaacaaatactcccccgcaaccccctccagctctcccatttctaaaccagtgagagaaatggaggctcagaaaggttaacgtgctcaaggtcacatggctgaaagatgggacctagagtctaacccaggaatctcagattctgaagtctctacttccacacatttgatggtattttttttttaaggaaaataatgaaagctatgctgaaagcaaagtagggagctgaaataagagcattcaataattcccctactttctaattaaaaggattgctttttataccccagaaagcaattactatatactacagaaagtctacattagcatatgggagtatgggtgagttcgttataataaggtttttttacaattctcaagtcacatttgttatccacgatctcattccatctcaacagtcctgtgaggctgttggggcaagtgtcttcactctacgcctgaaaaactatgcctcagaggagggtaggactcggccaaagcccttctgctacactggccctgggcctcatgtgcccaccctgaggacatctttccctgcagctccctgcccagttggaaatgctgaccttctttgcttacaagcccaggtgagctcaagcgaactctgactcactaagggttaagccacacaaactcttttatgagtggaaaccacttaatgtgccctgtaaaaaagggcccctcaccatgctggctgctttcccttggaaagggagtgccagcagggagcagggctatgcacaggccatctttttgcaggaggatggtgatggggcagctgccaccctgtagtcttaaaggcatctctgggggttgggagaagttctggatgtttccagaaggtcatggtggaaaatgacgtcggccctgaggagaggggcttgtgggcatttggccacaggtggagaactggcccatattgttctgcaacatttattaaattctttttttttttttcactacttgccaagctctctatgtgcatgacctcatttgattcttacagccctttgagtttggtgttgttcccatttatcaggtacagaaagtgaggaacagaatgtttgcggctagacagatttggcactggttcagggtcacccacagtaagcaggggaactggaatctgagcctgcatctctccagctccaaagcctgggtgcacagcctccacgccaccctgctttctgcttgtcaggaagcatagctggcccaggcaggtgctgccactgaaatgaccactttgaaacaaccctgcaggcaaatccttgtgaaagaatttgagagaagcctttccctgcctgtcctccctaagcctggaaggccaatccctccatgcaaatgggctgggctctgagcttcagccctttcagggttaaacagtaacctttccactgcttgtggttgagcaaatgctagcaaggaacaagcccagccttgagcaaacaagacactgggccctgggcccccctccttccaccagccacccggtctggggacttagagattttctttcgtcttgaagttcccaatctgatttcttagctttagggcaattgctctacaaagttggatgggaaaatacccagttattatgaaaaaggaaagaaggtttgacttgaggttgttttctttctctgagggtgagaatcaaagagcttttcagaaaaggaacttatgatcagtatagtcaccatctgtaaattttcaagtggggaaactgaggcccagcatcatttctggttcaggctatccacagagctagtgacgctcctcatgataacacctgacgtgtattcgtgccctactttgtgccaggtgctcgaggtacagaaactcatttaatctccaatcaatgtacagacgaggtatgattagctgcattttgcatatgagaaaactggggttcagagaggttaggtaacttgtctgggtgagtactaaccttagctagtaagtaggaaggcttggaatcgaccccagctcttctggcttcaaagctcctatacatggtgccaggacatataatccagtcctcctatcttcccacccagtggctctttgctgttataatgtccatcatccctaccctgtctttccttctccaccttctacttaggctggattcagtcctaattatttaccaagcaacagtgatgatgaagctaataatcatcatacatgtttgtgtgtagcctagttcaacctttaattactgctctctccccagcacctagaatagtgcccagcccattattgggctgataaatatttgttgaataaatgaatacatgaatatattcgtatgccttttgcagacccctcttctcccccagtaggccttactcagaacaagaggagcggtagctaaattaggggaaggaatgccaagggctgaaaatcctctgggttggcaattgtaatcctgtggacattggtaatacccgaggatgcaaaatttccccaaaacaagcagaaaattttccatgaattgctgctataaagctgaattcctctccccaccccaacattttataaagagcaagtgacttttacagcctctgggtattgcccaatagcgatctggaaacaggctgctcttcgtttaaatgactgaacacacggttggggatctgttctgaaaggtggagggtgcccgcttgggaatagggacattataaatactggacaattgaagacaatatttctgaagtgtaaaatgtttgcattgttataaaataaacccaaacaggcccatggaagaaatctcttctcccaagtcctttactgaaaaaatgatcccacagactgagaaagccactttgacttaggtcagcttggaaacccactaaattctccaggtctctaacaggagaaaaaaaactggttataattgttaccagaaaggaaaaatttttttctttaccagaaatgggcagtgtctgtcagagaaaccaactgattcctgatattatcacaaagccagatacttgaagagctctattaaaatatgactgaggccctttgatgaccagcccagcctgtggcagatacccgcactgaggaaacttgttactgggtgtgcaggtgcgattgcagtccgagctcccacacaggtgctggggctgtgctgccaccagcttggattttcattgtttgaaattgcactttaaatactttaaataaaatctccttggcattttcacttttgtaaaaaaaaaagaaaaaaaaaaaccgcttggatgccagccagcctcgccctgggagcaggtattgcattttcctcccgcttcattcctgatcagagattattcatttatgaatgggtggctgtaaaaacttgcctcatgcatatgaaaattgaacctggaaatttttaattgctgtgagttttgcttttacaaaaaacgctttggcaatgggtggcaggcaatgggtggaaggacaaattctctttattttcttcctaaatttactctgtgatctgcactttccaatgacatttgtccaagaggcactgactgaacaggctgtttgatcccctaacagatcatgattctggaaggaggtggtgtaatgaatctcaaccccggcaacaacctccttcaccagccgccagcctggacagacagctactccacgtgcaatggtaagagggcctgtgggtgttggtgtcactgctgtgctgtgtgggctctttgctttaattcctctcacaacctaatgtttgaaaaatataggctttacagcagaagatgtgggacaagaaggaatggagaaaactcagttttggagttccctaccagcccccagcgttccagacaaaagctcgtttgagatattctattgcctcctcccaaaattcaaggttccagattgacagcctggcagtgaaggggggtagaagagatgcctaaaggaaagactctctgttggagcttttaatagtgttttgctgggatatcaagataggctaggagagaaagggtatgtgtgtgtgtgtgtgtgtgtgtgtgtgtatgtgcgcgtgcatggaggttaggaaggagagggttatagcagttcaatctttcttttttcgtcttccagtggcctctctttgcaaggggagaggagatttgtaaggagaacaggtgttctccctagagctttaatctagaacacgtctattagaagaagaggggacctggtggtggggcgtatagagggtttggtgatcaagcctgtggcttcctgaatcaagttgaatccctgaatcaagttgaatctctgaatcaagttgttgctgaatcgggaaccccataccccaatttagagctctccagtttaggcattcagctgtgcatccaacagcagtgagtttagggagctctgggcctcttctcaatccacacccactgctaatctgcctgccagaggctctgctgttcaagtttgctttgaaatatggagatggtttgttggtgaccagagcttgggaggaggcagaagtgggaggataatgggagagttattctgcagcgagtgctaatccatgtggagctccacctcttttaatttggaatcctagtcaaacatggttgaaagggtgagcaggtgagcttcccttactcggtcacctgtccccccaaactgctgcactttctgggcagttgcattttctgttgtgggcctcaaataccctgtgaggacccagaaagtggattccaaataaaactggaagtctttggcatccccaggaccctggcctctcgatgaaggcagcatttctcctgcttgctctggagaaagctggggaaatgtgttcagcaggaagtagaactggggtgccacttttatttcttaaattccagagacctcaaagaaagctcagccttgattgagactgaagaggaaaaggagatcagttgaatggcagagaggatgtgaactcataggaatttttattgtttctcctgaaacttcaggaatttggtgggttctctgtctgatgcggaatctccccagtcagcttcagacaaaaatccctgattctcccaagtttgaacaagatacactagcagggactatcttttaatctagaccgtatcaagtttgcagatgagattattctagatgtgctgttaggttattaaaagttggtgcctcttgttgtcaaaaccagagctgtactgtcatagcaacacaattattttagaaaaagaaagatgaaagacttggggagccacaaaatatatatcccatccttaaacagctttatttgtgaggcaccaaaaattgggggaaatggaaagatccagcccaaggtctgtgtatttgggactatttccatataattagatttttagattagattgttccattcctcccccaacccctgactattggcttcctctttagagcccacgttgtgggccaggggctgcttttgtttcgccatgaggtacgaggagctaagtgcatactgtgagtggtgggtattactaacggcagtcacctctgtgtgctagataaacttgacctcctgctcttagtgcttctgaggtctggaagccatggatggattctgaatgaatgaggaagaagagggattgggtcagaaacatttccctttcagtctctcctctgagggtgttgtgggctggaccatgggcattatgggagttaaacctttctgaggcctttagctacttgtaattcgatagaccagcaacatcagcatcacatggaagcttgctaggaatgcagaaactcaggccttgccccagacctgttgaatcagaatcggcatttgaacagtattccctggtgattcacgatcacgtttgagaagaactgatctggcgtgaccttgaagaaaaagttagagacagttttcttgcactacattttcttctactggtccacccttgaatttgttggaatatccatgtgtcacgttctgttggatttcccctgcttcagcttggtgggatgcaatagtctttgccccttgcccctttcactcatctttcctgaaagagagttccttcccaacatctatttccaagggaactgtaagctctctcagccctgttacatgccctcagatgctggtttgtcttttccattgccgcagaacttcgggcagactatggaatgtttttttaagtgagcatgagtcacatatacagatggttagcacatattaggttcagcaatatttatccagtttaatgaactgcacttcttcattggtatctgaatgtaccatcttgtgaatgtaccatcttttaaatgtacctcccaactcctcagatgcctaccttatttcttcttcaaaaatacattccattaaataaatatatggtgagcatctactatgacaaagtctctgaggtcattttttaggtgatacaaagacaagtaaaacagtctgtgacctcaagcatacaatttacaaaggagaataagacggcacttagagacctgtacagaaaagcagaacatgacaaagccattagaaataccaagcatgtctcctggagggtaagaggacagtgagcccttgaagcaagttggggggattgggaatgattttacaggatggtcagagttcgaaagatgggtaggaattcaacaggagtgagaggtagaacacaagcttagctgaaagaacagcatagagaaaagacaagttattggttacttgaagaagagttagtgaagagcctcaatgcctagctaggcagctttatacctaatttcagtgggtgatgaggactactaaaggtaactgagtagggaagtgacatcatgatagctataatgactaggctggggcagtgggatatcagtccagttagtagatcaataatctggaccactttgaggaaaagcaaaggcatcgtagagaaaagaaccttaatttcaggccttatttttagttgaaaatggtctgagtttggtggtgtgtgtgtgtgtgtgtgtgtgtgtgtgtgtgtgtgtgtatgtataagagagaaaaaatgagagagagtgagtgagagagaagaggaagagaacgatttgggtatggacaataagctaataaattgctgaaatgatagcaatgctctagctttcatgatattttactttgggggaggtgggggatgagctctgagcacttcagctctcttgtcctcatccagtgtccaggggtaggtagcaggctagggaggacatgaaaatgcacttctgctccatcacccatgctggcacatacacggactgtggttgtgtctctgagatatctggcagccaacagtacatccctgtgtcagatactatggccaggaacagccaggggtcactcatgaggctgcttcctgttttgcagtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggtgactctctctttctgtgtctctccctaccctgctaggagccagctggaagaatagagattctgcagatgacaggattctttgtcagggacaagaaagagtggtctcacctccaaattaccatgtcccaagacagagaaatggaaggaagatgaaaggacaggattgaagcatagggtacctggtgtgcctaatcccttataaatgccagtgtaatttaattctttccttatggtgataattttcaagaagacaaaagctggctaggaattcgtagaatacttactatccttggaaaatgttttctttcctttgcaaacagtccagtcacttgcttgttaaaaagatcatcatggttacaaaaaaaaaaacaaaaaacaaaaaacaaaacaaaacaaaaccccccccccacacacacacaaagaaccttctagacctaggttcttaagatagggtcctaagggtggtaagaagatatatgaaattagaactatgtttgtgttttgggaggggaaaaaactcacaatacttcagcagattcttaaaaggtctgtaacttaaaaaaagggttagaacatatggtctagacacgtgtatggggaatgtttctgtggtggtttctggaatttctgttgccctaatgccccagatgtctctctgaggcttcccctagcacagggatgggccaccattccagatgttgtctttgagtggtagattattcatacacgaacatatcctatactgacatgtaagacctagtagggtggacaactgaccttgcagaatggttttgacactggcataaggttcccctgatagtggctgtaaaaatctagctcttctgagaactatgggcatcctgaaaagtagcaatatttaagaacagggagttggcctgtctgcactggaaaaggcatttatgtcttggtagaacccatgtttgggcaagtaaccgggacttgggcggcatgagctccagggctgtgaaccagagtcataccctggcaacagccatcaacactgaagaggacctggggccttgcagcagagcttgtggctgcggtggccattttagatgatgtcattcagctccctggccatgccctgcttcccacccacctcacattggtggctgctcttttttctttgactagaatcaaaccaaacaaggctctataaataaccctcagggatcttcaaaaagatcagacttacacttgaagaattaaaaatatttacctccaccccccaattaaatccactcctttaaagctttgccctgattgaggtctgaggcagggaggcctgggaggtgctgtggccatcttagaccttctgtctctgacttcccatgacttgtttggtctcatcgcatgctgctgtagcctctgagttcctaatgtccaggcagattgctcactcttttgttgtttgcctttgtgtagaccttctatcaactaacatttattgagtatttacttatactaggcactgtaagtgaattaattcatttaataactttatgacaaagtaaatattgtgcccattttacaggtgggaagactgaatgtcagagaggttaaaggcatggcttctgttcttgagatgtttagaatctgtctggggaagaaaacagactagattcatatgcatttacaaatatatatatatatatataagcatacatatatatgcttttatatatgataatgggagaggagttgcaagcaaacaaggtcatgtgatgtgtactgcttgtacatgtgctgaggcataaataaggaaagagtcaccacattttatccagacatatctcacagattggatgtaatcatgatggcattgattagattttaaatcaaagaagaatcaagctagttaaaaaggtttttccctacattttcattttcatatcatatcttagtatgggaaagcaccttagaagtcatctagtgaccttatctagtttaatcttgttacagatggggaaactgagacccagaaaggtaaagtgcacacaccttcctcatagctagtagttgaaaaactgggcttctgaagttctatttccaccatactgaatgcctttactataccacatcaaataattgcttctaaggtagtgccttagattcccaattttctggggtcagagactgcaggcttgagtttgtagaggctgacagagaaaccacctcccataaacaaacataggtgaccaggcagtaggatggcagaagctctgcaaagatgccagttctgtccttatttaagcatccagttctggctccatctgggccctctctgactatcccaatctgtccttcacaggccagtgcagtagtgacctgttccagtccacacacaatgtcattgtcaagactgaacaaactggtgagtagtagtggacaaagggagccaacctagcctggcaaagctccggggaggacagttgggagagggcaagagagaatgtgggggcaagtttttgcaggaaacacagggaggccttttccctggctgtctctgatgggccacccccaccatgaatctcattcttgcccttgcgaccagtgactgccacctatttccaatttatagacttatggggagccacacttctctgcctcctactcctggttgtggcatcatccagacctcaggccagcagccaaggaaaagcagaatatatggtgggcctccccaccttaaaaagtgtcaggggagtggccaagtttggaaagagaagaggaaggggcaatgtctcctcttctctccctcctcccttgatgggtgtgtgtttcacaaaaagggtgaatatactaacttggtattgtagttaacaaatttttaggggccctggggagcttctgcagagatgtacaaaggtacctgcaacccagctcctgccttaggtgtgtttttatatgaaggacaaaatgctgggctctgagcagagtctacagtcccatagcatctacattcattttcgtttcctttcccctgtcctaaatctctctcctggagactgtcctccaaagtccatgagccatcataaaactgtgcagcaactattgctcctaagtcactccccatgttcatgcctgggagcctgggagccacgtgggccaaccaagctttccatagacctccctgaggatgtgtcccagtcaccaaggacagaatttgacctgcaggtgatttgtgagtcacttggggccaaaattggcccatgcagttatttaccctttcataagtgggctggcctaccattattaaagaaaaaagcaatagctgctaagcatgcaaattaggctttgctagccctgcctttctcttcagaggccaggggatgggccatctggatgttctgtgctttacaggcctggccttgccctagagatggatgcaggacttggtcaggaggatggcaccccctcccctgcttgacctgtcagatagccccaccgaaggagccagggtaatactggagaggtcccaaataacttgataattccttcttgaccatccagacattcttgtgttgccagttcagaaaagctgagtggaagggtggagaagaaggtccaccctaggaggaggggagaagaagctcatagaggggccaacacccccatacctctttggttcagtttgttttcagagacaacaacaggtgtacaaggtgacccaacaaggagagagggtgtaaccccaagagattgggcttggggtgtccaaacatgtagctattagctaaaataccggctaaatccctatgtcgtaaacacgaggacttagccagtaagtcaggttttgtatcatttgtgctataaaaacaaaatgaaactcagtcagtggcttacaccccggccctaaaactcagaacccagcaaggaggggagctgagggtaacctaggtctgcggtgaggagaaagcaggaagtttctggtgaggacgaggtgagagatcttacagcttttggctagccaagaaacaaaatgcttctgttggagaccagcccagatctgggggttgcgtaggagttgagctccatttggggtaggtggaggggagttccctttgaatctgaaatctgaagagtcagtcaaagtgagaggtgtttaccgcagcacacagaagaaagagaaagagagacagagtacaagagcacttcttttctgcgatggggcagtggggcttcactcttaaaaggtgtttgtttgatttagtaacacagtccaccccttctccttggttttgttttgagaattttatgtcatcctttaagctaattggaaaaatcctagagggagggggctgtcacccaacttggatgacaaatctctggatttcagcaaggaagaaactgtgataagattgacaagactcttcctgaaagaaatatcattaaccccccaaggcctcattaattatttattatacatttaaataaattaatccctaacaaggccttcccccccaccacactctagggtaaaaatattctggtgattatgcagtagaatgcagaacaaagccaagccaggttaggaaaattcccaggaaccacttggtctaggacaggttcccattcttgcaacttctctcacttccctaaaaatgcaataggtacagaacacatggatgaggccatttccccgaggatgctgaaaggaaaattagacaacattattataaagtaacgcagctgaagcagaatcatatcccttgtctctgaggaccactcctcaccccccatactttgttgatgaacaatgaattagaaaacgcagcctcttctccctggggaaaatgatcgctgactattctccttctctattttttgtagagccttccatcatgaacacctggaaagacgagaactatttatatgacaccaactatggtagcacagtaggtaactaactccctgacacttaaggccctttacattcttattcagtttgtctaagagccacagtgttctattgtgaggtggggggagggggtgctctaaatgtcctttatcttttcatggccacagatttgttggacagcaaaactttctgccgggctcagatctccatgacaaccaccagtcaccttcctgttggtaagctgtcatcacatctgaggctgggtatgcctaatgcttagggagaatcagtgggaattaccaacactctacatttctgcctttctggagtctttctaattaaagggctaggaaagggatggggttaccattagacgaggtttgcttttgaggcaatatttgtacatcgaagatgacccgtagggatcctctaggcaaaatgttggtctcctacgaaactagtcactctgttgtgacaataaaagttgtttaggcttttctttattttcaatgaaaacttactcttgcaatatagctgctaaaattattcatatttgggtatacttatgggaaataaggctatatttaattttcaacaaactacatttggctttagagaaagaatacctcatagtaaaattcaaaggtccgtgaacctgtagtgatagtttctgggtgaaggggtagccattggaaacttccagaatccccacagttacactattttgtcagtttttaagtctaattccgatgactcatcagtgctctctaatcagtcagagcacctgcattttatgagttacgttcactttagctgcatttggttaagcttggatgcaactggggctatccatgctccttaaccaaggttacactgggtgagaagtttgggatgttgggagtctgggagaggggatttcagattaccacccccacctacaaataggtgcattggcgtgtacagtgtgggaaatggttgaaagaggatcttatggtttcccgtgatctgagtatgaacttgtggatctctttgggtctatgaaatggcacttagacatcagtcacaagtgatagtgcctctctcctggaattaaatttggagcaacttcagaaatgggatttaattgggtctttgtgaaagaaattagtctgcaacccttccttcctctttttttctgtttttgtttttgcttttgagaactgaaataatgaaaggttttggtttgaggttttgtttgggtcaagccccttaaatgagatggggctgggagccaatgtaaatgcttgtggaattgagattaagagctgaggccagcatagctctcgacttctccttcccccagtggtccttagcattatatgtcacttgaagtatttgttaaaattagggaatagatcaaacactggcaaggcttggctgtgtatttgctattctgggggaactgagccaaccggggtaaaatttctgtggcaatcattgccactcagtcaagaccatggggttcagggctgaggaaacctcccaagtcacactctgagttcctctgcgacttcctacagtgtcatctcccacatccttccatccttccatccttccatccttccatccttccacttgggtctttgacttacggcaaaaaattccaactaagaataaagctgaaccaaccacttcctgagcctcaggggctagtaggtcttgaggcacccgggaaacaaaaacatcatagttacagctctgctgccctgagagctgggccatcctcttttctacatcttgacttacaccttctagaatctcaaaatcaataggggccttagaggccagtttctgcttttgcatttgcagtagcaaggaactcgctctctcctgagtccaccgattgtatttttcaatagtccttcttaagatgggctcaggaatcttctctccttacccttctgatccttgtttgctgcagctccccatttctatcctgtgattgtaacccaggctggaaaatgagatcaatcacccaggccctaaagaatcaatgcagtctctggggttggtgtattcattggggtaatagcccttcagtaggatagttaattacagccttatatgggtcagtttctttcagaatagtttatagtctctactgcatggaagcagaaccccggaaaaaccttggtcatttgcctgagtctttatttttcgagctcccatgtaattgaatgcagtgaaatatctttctatgttttaatgctagttaccagctgagctaaggcgaggcccagcgtaaactgatgccctctgtgataaacgcaggtggggaaataggctttgttttgatttctctgtcatctgcccatttcataaaatgcccgctgccggtgtcctgttctgctcgacagtcctccagcctgtcatgccagctcgggcttgatgtgtttatccactgacttgttgagcctaaagctagggtggcacggtctattagaacactgaaatttgtatatcccgtaaagaaatggctcacagctgaatcatatgcaaatgcttctaatctttgcttcttgcgaagcagcttagctgaagtcacgctctctcacttgcatcacaaacctgtggcttgttgctgcccctgcctggactggataggaccttggcctggagtgcctgggagccaagcaagagaaagccaggctggacaacttctccagggcaagccattattttataagaatgaatcacttaaccacatggctaacttcaaaggtcttgacttttatcctagggcagaagaaggacacatattaaagagaggttaaagatcaaaagatatcagtggtaaagcaggccagtgattccacggcttacccctgcacactgcaacaggcagagaggtctggaagaaattaggttcttcttttgcctttgactgcttattcccctttatgatgatggaaagatttttatttggggattaaaaaaagaacgttcctagctgggtggagcctagcttgggtaaacggctgacaactcaaagaatatttcctcatggtttatctagtgtagaggttttagagtccatggactgctgcatgggccacagccccctgaaattgttgacaaaatttcatgtgtacatatatgtgcatttttttctgaggagagggtccaaggttttcgtcttattcacaaaggcacctgaactctgaagtaactgattctagatcaactaggaacccacaaacaataattgaggccaatatactgagagactcttgtatttttctgaattcaactcctggctctgaaataatggccctgcatccctcctggatgtcatttgaaaatgagctttgcttgtggcctgctgggtaaatgccactctttgtctgcagtacaacgtggccctgtcagagtgatgtatcacttggaaaccggggtggatgccagacctgtcgcaatattgtcacatcctgatgggatgttgcaacctcaccctgcaacctacagggagggagagtgaagtctccttgcatttcctgtgaatttgtcctctcggatttcagagaaacccaagtcaggtgcaggccctgctagtgacaatgccaggagagaaattcttaaccaggatgagaggtttcttgtttactgaggtcttattaaatccctctctccatcctgccatgacgtttcgagaaattgctgggaacactgagtcttgattagctgggtgataagatggttgaaagggcccatgaacgttgggaaatatagaattgtcagattgaaattatcttttctactaacaagagcattacagaagtgaacctgattcttggcaagaaaggcttgtgtgaaatctgttatgtgcaaagggagattatgtgccggccaccatttctggaaatgacatagaatcatggttatgagtaaagcttctggattcaaactgtttgtgttcatatcctggctccacattccagctgtgtgactctagtcaagtcatttgacccctctgtttctcagatcctccacagctgaaaactgtggatcatattagtacctgtgtcatagagttattgtgtgaattaaataaagtgattcatttaaagtgcttagtacagtgcctggtacatagtaagtgctcaataaacagtagcttttttttcttaaccaatttaattaggagctaatggctggcagttcatagcttttttgaataataggcttctcctgataattgaatggatgctgtgaaccctctcccttcatatatggtttcagtcagtccaggggcccttgaaggccacactgggtcagtggaccctagtttaggaagggcacatgaaagagatcagttttactggcccaatttcttaaaataattggcttgtatttagggactactttgtattaaaattggctgatttttgagtgtgagagtctttgtaagatctactttggtcctcccaatacacacacacacacacacacacatatacacacacacactcacactcacacacacacggctagatcatttagttttctttctgagaagaatttttatttcccaggtccgcctccatcatctcctctttggtaatagtcgcagaggttgccataatgagtcatttgttaaactaatctgtgtttccatagtccactgtggccctctgtattgagcttgggccactcaatggcgcctttgtcaggctgattaaaatgtaactttgcatgccaaaaaagggcactcctctggcttaaaagtcatcttcctttgttataaatgtttacatttttctattatgctaaaaaaaaaaaaccacaaatttttcaatgatctaaatctttcaatggcttccatctttctcagagtcatgtccttaaaagtcccataagggattaatgatcagaacctcagctcctccctctctgcctcttacagcatgcatataccaaacacacatcaacctcagggcctttgcacttctatgttacacatggaaggctgttgcacaagctctctgcatgaccttttccctcatatcctttaggtcgtggaatcagagaggtctcctatgaccaccttgtatcaaattgcaaattattcccaagtccatacatctatctccatttcttaacctgcatcatttttctccatagcatttatcatctctgttttgtttggttcactagcacatactcaaaggtgccaggcatgcagtaggtgctcagtaaatattgtttaaatgagtggatgcatgaataaaaaagagaattataggaaataggtcaattaaacggctctcatttttctccttagcagagtcacctgatatgaaaaaggagcaagacccccctgccaagtgccacaccaaaaagcacagtaagttggctggctttcagatggcctttggtccttcccatcacatcgggcacatctggaggccactagttttttggcaaatatcgcctctgtctgctgccttcatgtcttcatcccaaacagggtggagtgagaaaatagaggcatcacttgctagcaaagtaagccccctctgcagctgtttctcaaagtggagccccactggacatttcctccctgttctgtcatatgtgctctaaaactgagacacccagtgcctaagaactgcttgcaggcatggggttagcaatttccatctctcccagaagaaaagggtgggaagaggagcgagataagaagaaacagctgagatgtatcatcctttcttttgctaaatgttggcctcctacctttgtggagttaccattccaagaaatgactgttttttcttaagattcaacactgctctttgggagttgggtctccttcagtaataaaatcttatgaacatatacgaaatatcagagacatggaattgtgggtggaacacagaaagaaatcaagatggtataatctaggcctgtaatcccaccactttgggagactgaggtgggtggatcacttgagctcaggagttcaagaccagcttgggaaacatgacgagaccccatctctacaaaaaatacaaaaattagctgggcatggtggcacgtgcctgtagtcccatctacttgggagactgaggcaggaggattgcttgagccagggaggtctaggctgtgatgaactgtaattgcaccactgtactccagcttgggccacagagtgatatcctgtctcagaaaaaaaaaaaaggtataatccagaaattatgaggaattagaatgtctttatctgctctttcacataatcccacaaaaccatattaatgcaacccctcgaaaggtgggtggggtgggggtggggcatcaaaaattcagtgggagtaaagttgaatttggttgataatcttattgcagtagtggcttcattttcaaattgggtcctccagtccctgcgtgaccacccctttccctaccaccctcatctattctgggagtaaacattctagacccttactgatttgcatttggctgaaacacagttgctgggtcaaagcaatttaattggttgagatactggataaaagtggttgagagttgctctctggggaagtaacaggttgaagtgaaccccaagcaatttgtggataataactagaagaaacttccccctggcttaggagacctaagacctattgcttagtcttggctatgtcactagttagctgtgtgatcctgatcaagtcacttaagttctctgtgcctcggtttcctgatttgtaaaataaaatattgtgctagtttattcttaaatacctttttaatgtccaacatctggtgattctgcgatccatcttccctgacaagtaggggagaaatgagtatctcctacttgcaggaagatgacctaactcaatgctctctgccctatctttgctgtgacttagatcattagtaacctgcctttctgcttttcatcagacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgaggtgaggagtttcatgtctctgaaaacaaaaaggctgtacgacccattatttacctagcaaccttcatcggatcagtcaccttatgcaatctcctttgttacagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacagtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagtaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacctctgtaaaggtttaacttagtgttgtcaagtaacagttactgaaagagctgagaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataacgcatgaatatttgtgtgtctgtgtgtgtgtctgagttgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttctgcaacctttccattcaagagcaatctttgctaaggagtaagtgaatgtgaagagtaccaactacaacaattctacagataattagtggattgtgttgtttgttgagagtgaaggtttcttggcatctggtgcctgattaaggcttgagtattaagttctcagcatatctctctattgtcttgacttgagtttgctgcattttctatgtgctgttcgtgacttggagaacttaaagtaatcgagctatgccaacttggggtggtaacagagtacttcccaccacagtgttgaaagggagagcaaagtcttatggataaaccctcctttcttttggggacacatggctctcacttgagaagctcacctgtgctgaatgtccacatggtcactaaacatgttatccttaaaccccccgtatgcctgagttgaaagggctctctcttattaggttttcatgggaacatgaggcagcaaatctattgctaagactttaccaggctcaaatcatctgaggctgatagatatttgacttggtaagacttaagtaaggctctggctcccaggggcataagcaacagtttcttgaatgtgccatctgagaagggagacccaggttgtgagttttcctttgaacacattggtcttttctcaaagttcctgccttgctagactgttagctctttgaggacagggactatgtcttatcaatcactattattttcctgttacctagcatgggacaagtacacaacacatatttgttcaatgaatgaatgaatgtcttctaaaagactcctctgattgggagaccatatctataattgggatgtgaatcatttcttcagtggaataagagcacaacggcacaaccttcaaggacatattatctactatgaacattttactgtgagactctttattttgccttctacttgcgctgaaatgaaaccaaaacaggccgttgggttccacaagtcaatatatgttggatgaggattctgttgccttattgggaactgtgagacttatctggtatgagaagccagtaataaacctttgacctgttttaaccaatgaagattatgaatatgttaatatgatgtaa

SEQ ID NO: 15516 - DNA, 37601 bp, Human
atccagaagcctgtaatttcacacacgggcacccagaaatgctatattattcatttgggaccgtgagacaaacagagttcatggtcttgtacatccattgtcagaagacttttatactcaaataattgagtcagttgggcagccacagcccctggggaaaaaattgagccaaaagagtatagaaaaaatataatttctccaaaagactcttttttttttttgagatggagtctcactctgttgcctcggctggagcgcaatggcgttatctcggctcactgcaacctccgcctcctgggttcaagcgattctcctgcctcagcctcctgagtagctgggattacagatgtgcaccaccacgcccagctaatttttgtatttttaatagagatggggtttcaccaggttggccaggctggtcttgaactcctgacctcatgatctgcttgcctcggcctcccaaagtgctgggattacaggcatgagccactgcgcccagcccaaaagactctttctaaaaacagtatcagaataacatgttttccctaaaaacctctccactgagaagaatgtatatgttcagaaagaaacactggtaacatttcagaaatcaatgacaagataggccagtgcccaacaatggaaaacacagtgtgtgggactatcacagtgcacagtcccctagaaaccaaagaggaagagaagtacagaattttaaagcttgaaagaggcccaaagaccatgtaatccagttacttgcaaaccctttctaagggcagattcttttgttcaaatgaaatcttacccggaagatttatataaaagctgagatgctcttattgagtcaggaaggaacggggtggtctagagcctaacccactctactccactcccatcctctcacccgcaaaagtccttgtaagggctccagggagcccctggggttcctcaagtcacagtttgaaaaaaatcactatttcaatcccacttcctccttttgccactggggaaaaatgaagcccagagaagtccaggttacccagccaagataggggtctaggcagtcacctatcttccttcaacaatttttccatgatgacaccccgaatcctctcacgaactgccttttgtttctgcagactatatgcgtatttgtatttgtgtgtttgtaaccatgcccggtgatcccaagaaaacataacaaaccagtccttgctttcgctttaaagcttggagtctgccatttgaatacaacatctcggctgcccaagatggctagaagcagaatgcaaaaaggcacagggttataaatacctgtctcatagtgacctgggacactgtgctttgcagcctaaattaggcagagtttctgttgtcacgaagaagtactaaaaagcgggcagttctcagcgagacacctgagagctggcatccacatgaggagaggccccatcacttacattacactcatgaagcccagagatgttagctacatttttctaggtagcacagctaggaaatgatggacactgaatttgaatctaaaggcaactagctgcaaaacctgaggtcttaacactgggcctataatgctcttccttctcaccacatgggaaaaacggagaaagacatgatcttacaaaagcactgggctcagccagcctgggagagaggcagcgcagaccggcaccagggtggaatctctgtgtttcccctccagcttgcacagaggaaaattcctcagcaaacgcacgatccccgcacagctcccagggacaagaattttctgcttgtttactgagtcccctgggctgggagtggggggttgcagggcaggggtgagctgcgcacaaaagcaggataaaggtaaactttctgcatatgagaaccatttccccccctccaaggagccgtgtcacactgtatgtcaccgtcatcaaaggggctgtgcgtaaacctgaaaaaccaaacggacctgtctgtaggtgtcacttatatcacaaggctacaggtgtctttatttccactgcacgctggtgctgggagcgcctgccttctcttgccttgaaagcctcctctttggacctagccaccgctgccctcacgtaagcgccttttctttgcttttttggatgaatcgtaaggggtgtcagggctcagaggctcggcctggggcctgggtctgctcgtccatctccagctccagggccggcacctgcgctgggtgcagtcccagggcctccgggagctgtttgacacggatgtgacggcttgcctcagagagacctgcttgcctccgcaggccgtgtggccaccagccctcctcacagccaccactccctctggatcccttagctgaaccaaggggaattaagagaacgcgcccaggcgctcagttctctatcctccctaaagcttctttaggaagggaagctggattttactcagaaaaatattcagcttcaaggaaagccccccacctacccttctcccctgactgaattcctttccccaccggcctgcccactgtcccccaccccctcgatacagagaactcccttattatagtttggggcattttcaggaatttgtacaaaacagttttaaaagaaacccatttgccctctgacatctccccagaagagaatgcttccagaaaagcaatggttagggtttttccactgtgttctcaggccttgtcagactctgcagtgtgtggggtttctgtggggttgccccctgctgacagcgacaggtagcacaagctccctcctcaggctgaagccgggcctgcgtgtggatgccttttgtacgcccgaaagtgtgtcagacatcactaggtgcaatcgcttcatgttacagatgaggaaactgaggccagaaaggctagatgacttagggaggcagctctgtggttcagtctagtccagagacccagggaaaggggtggtttgcccatccgagtgaacgcttgattctgttgtcttcgtgttctctgcaatactgtttttcataatctaaggtattctcgggccggagttttcagtttggtcatctccctttttcagaagtcaccagagtggcaaatttttagatacattgttgatggctgatttttccctctaaaacaggattgaatatatgtattatgccccgtcctttgcatatatcggattgcatgatttaaaaaaaaaaaaatccccattttagagatgaggaaaccgtagttcgaagaggggcatgaatatttatataccacatctatatgaaaaaaagcttaagaatttcagcagtctgggtagtaagaaatgtgccccacgttcgcagcagcagaggtaggatttaacccctgatatatgtaatccaaaactggtaagctttgcatcgaagcctacagcaaactacatggcatacctttttggatcttcgctgcaccttcagaaaaacagctacaaacaaacaaacacgcaaactccctaagcgagctaaagaaaaatgaggaatcacttgacaagaggtcagcaaattggttctcacagttgctagggttcctctcagaagaacaaaccctcaagcacccaaccctcaatctttctttagcagtaagtgttgaaatactccactgggttctcctcagtgggccccttcttagggaggtccaagggctgggaaattgaccctcccttgctcacaagtcttgggacggagtggacatttgggtatcactgaggctttaaggaaggaaaaccgattttcttcccaatgataccactcagagggtggggttgaggaagcccaatcttggccacttttttctatattttgcaccctatggcctagttctgcccagtgatgatttggcccgtaaacagccaatgtgtagatgcttaattgggccaatttttggtcacatgcccagagtgaagttgatgatcaccaccagagtcaggaaggaattttcctcctctggcaaactggccaaggctgagtggtttgctccttcccctctctctgggaggctgagcaggggtgccgggttgctcaggccatgggagccacacctgttattgctgcctctgatttgtgtgacactgagaagcccacaggcctgtccctccaactcggtggaccctctctgtgtgcatttggtgtgtgagccagctctgagaagggttcagaagccactggaggcatctggggacctcagcttccatgccatctctgcctcactcccacaggtacctgcagccaactttctcatgtgtgaagtgagcccacctgattccaccaccttgtgttaatcattcttgagcttttcctacttactaggcagctagaatgatgactacatttgggggaaactgattccagcttccacggatctatcggtgggcagtgagtgagggtccagagtgtttaaggtacccagctaggctgggcaaagaatatccagttgtcctgaggtatctacctccaactggggtagaaggcagtgggcacaggagaaaagggagaagaggaaatcagggagctttttcagcactaaaagttcagtctgtgtgtagtggttggattttcctccaatttggtggacttgcttgaccaaaaaaatgcaaatataatcaatgtgtatgcatatgtgtgtgagtgcccaggtttggatgtgttggctcaatcaggtgggtgtctgcagaaagtcacagagttagggcagaccttgggggctgttttatctgtgttcttgtttagtagttgaagaactgagatttggagaggggcaagaggcagaatcataactccaggcccagggctccttccatgatgagccagctagtccctcacaaaatgaaaagtatgtccagaacagcaggccaagagacctcccagcagatccctgtctgtactggcgctgacactaggtggatctatcacagcgcttctccaccttttttttatcacttctcctaaggacactttttaggtcattttttcttaatcatctccccaccagaaatgtgagtaccagagataaactatacatctactgtagacctttggagcatgataaaacactgtaattaataactcagttttttgatccccaagaactcatctttgttccctaaagaggggggcaatatcaccccccttgagcaggcctggcctaacctcaggcctgtgttcacatatccctgggcctcagtgttacttctgagaaagggggctctggacatctgccttttcacacctatcctgctctacctccactaaagaagtccttaagagctaaaatgttcaattattgcaaggaccttagagggcctagagaagagaggctactgaatacaaagcagccattattcttgaactctcacacctactgcatgctggctaagtagccaaggtcttttgtggagagcccagagttaataacacccactcctgctgtaacaggaaaaaaaaaaaaaaaacacctttttctgcttttataaaagatattttttccaaaagcaagaaataattacagaagaaaaatagcatgctgtacacctgagaaggccctttacaaaaacttaatggatataatttgccttagaaggaattaccaaagggaatcagatacagcattgtgtatagcactagagagattacagatcaagtgagtaggccggtataaagaggagaaagaataacaatattaaaagaggtaaaaatactattgatcaaaaaatatttctagtttttatataatgccattcaatttaccaaatgacctttttttttgttaatacccaatgacttttgagagcaattagtgaggcatagatgaggaagatctcattcccactgtcgtgttttgtatttgatggattccttatttgacactgaagacctggggactgttttctgttttcttccgtgtggaattcacctctcctttctcccaacccaaagaaggtcatatcacaggcctgccatcctcttctttagttttctgagccttctggcccagaagaaaagggatatatttgtcttcagccctcacttaaaggaacttttctgaagtccagtccagaaagcagaagtggctttcagctcctgaggcccttcccttcctcataacctctcaccccatccctcagcatcctaccccctccctgcccccctcactcaggatataaaaccagccaatccgtgggaaaatcacagcccaaacccaggcagccttgacatctgtttgattgggctcccaggaggagatccatgcccacgataatctgcagagcacattaaccctctccaggcatcagcaaagagacttcccagcagagtctggaaactcttgggtgatggcccagaaaaggtgcctaagtgtcagaattcaaactcggttatatatttacatctggagaggagttctcatgcacgtttttgttgttgttgttgttgtttttgagacagagtctcactctgtcacccaggctggagtgcagtggcacgatctcagctcactgcaacctctgcctcctgggttcgtgattctcatgcctcaacctcctgagtagctgggattacaggtgtgcaccaccatgcccagctaattgttgtgtttttagtggagacggggtttcgccatgttgtccaggctggtctcgaactcctgacctcaagcgatctgcccaccttggccttccaaagtgctgggattacaggcatgaaccaccgcacccggcgtctcatgcacatttgatggtgatgatgatggtggttggagattttcaagcatctgcaaagaattgacctttggtttcagaatcacacaatcctgcccctcttagtactgaggtttgatttgctatataagtgtgccttggggctcaattgtgttttcagaaagagaagcagatgggctgagagtcagaaaactaaggacctccctgccacttaactctggcatccactggctatgtgaccttgagctagttacacaaattccctgagtctcaacttcctcaactgtaaaatggtggaggcgaggagggaaattggactaactcagtatcttccaacacgtggtactcacatcaactggcaacatgccagatgaatctggttaggggttgcaaactttttcttaaagggccaggtattttaggattagcaggccaaaaggcaaaatcaaggatatgatgtaaatatttatataaccacttaaaatgtaaccacttaaaaatgtaaagttttttttattttttattttttattttttatttttttgtgagacatagtcttgctctgtcgcccaggctggagtgcagtggcacaatctcggttcactgcaacctctgcctcccaggttcaagcgattctcctgtctcactctcccgagtagctgggattgcaggcatgcaccaacacacccagctaatgtttgtatttttagtagagacgggggtttcaccatgttgaccaggctggtcttgaactcctgacctcaagtgacccacccgcctcggcctcccaaagtgctgggattacaggtgtaaaccactgcgcccagcagtaaaattatttttaactgcaggctttacaaaaataggtgagggactgcattttgcctataggatgtagtttgctaacccctgatttaggtggcgcatgaaccatttttattcaaatgcttaaatatttatttttatgtatgtttaaaaaatcctgactttccatttatattgctaatataaagttttccttttaattagcatatttatgttaaaacaaaaagggagttgatgatttttttaagtattttaagtaaataatagtgctcgtagtatatggattgagtgaaattatcacagtcgtaggcaaatgactgaagtttaggaaacactggactagatgaagaattcactcctgccaatcttaaaattccatgtgtttaatatcccaagacacttaccagtggtgtgatcttgagcagctatgttccctttgcaaaacgaggaaagaactactctatgtcaacattatttcaagaatcagaaaaaagaattcgggtgaacagattgttttaatccaccaaacacagattattattttttctgaattgcggggagatgggattcagtagagagtggcatgtgggaacatgggaagcagcaaagttgagaccagcacaggcaagaatgtgtgcaagcgggggccctaggcctgttcttttctgccttccttccagcctcaaccacacaccctgccccagagctccttgccgccaccaaagtgtgtggggactggagcacagcaattagaatgggctttttaaacagacacacctgagccaccacccagcttcgctggctttgcatgtattacccggaatctcagagcctccatccctcacctatgaaatggaactgctgccagtacctatctcagagtggttgttctgagcagaccaggaagaatatagctaaagtgctaaagtactcagcatgaagcccaaagtgaagtgcttgttgcaattaccacaggtccacactcgtctccaaaaccttgggccgcacatgctgcagaattctgaattcttcacagatttaggaaggcgagatagtatatatacagtggagtacagattacccctcagggtttagggtttgctctaaacattaatatttctgcactgcatcataagaatattcactcagtgcaataaataaaactgcaaccatagttataaaactgtataacatatatatgttgtatgtatgtgtatgtatgtatgaaacagtatataaaactatataacatcaattcaggactgttttgtgctagaaaataagattgcagcaaacacacacacacgtacacacacacttcctttcagttttcagagctttcagatttcagaattatggattaatcacacacagtaattcttacctcatttttatttatttatttttttcggccagtttctgtggctcacacctgtaatcccaggactttgggaggccaagaaggggagatcacttgaggtcaggagttcgagaccagcctggccaacatggtgaaactccatctttactaaaaatacaaaaattagccaggtttgatggtacacacttgtagacccagctactcgggaggtggaggtgggaggatcgcttgaacccaggaggcagaggttgcagtgagcctagatcacaccactacactccagcctggcgacagagcaggattacatcttttaaaaaaaacaattttattttatttttattatttcaacttttagtttagattcagggggtatgtgtgcaggtttgttacctgtgtgtattgcaccatgctgaggtttcaggtgctattgatctcatcacacaggtactgagtatagtatccagtagttagtttttcaaccttggcccccttccctgcctcctccctctggtagtccccagtgtctattgtccccacctttatgtccaggagtactcaacatttagtgcccccttctaagtgagaagatgaggtatacggttttctgttcctgacttaatttgctcgggataatagcctccagctgcatctgtgttactgcacagggcatgatcttgttctttcttatggctgcatctcacgctgtttctagaagcatattattgaacatcataagtcagagttcaggggtcagatgtgagcaaacaggaaacataaataaagaggcaatattgcataatcagagcctccatgctccagtcccctctttgccactttctagttatatcactttggcaattgtctcaacccttttgcctcagttttctcatctaaaatggggatagacaggatatggcaagggtggaataatgtcactcgtaggtgacactaggcggtgcctgctcctagtgagtgacatatttgttatcatttttaaaaaacaagtatcgccctgctaggggctcctgcacagtgtggcttcaggagtacctcaccccagcctcctcacgacctctcctgctgttgcagggtaatgttggactcggtgacacacagcaccttcctgcctaatgcatccttctgcgatcccctgatgtcgtggactgatctgttcagcaatgaagagtactaccctgcctttgagcatcagacaggtgcgtacatttgaaggagcccatctgagtgcagccaggatgggctagggcaggaggtggtgctggccgcaggtggaagacaaagctgtgctggggcctaggaacaccagagttcagggcagagggctggagggctcctggatggaaggaagggcaacctcttgcagataaaaggtgctggaaccctcacccccaaactccctagttctgtggcctcgaggccgtgcacggctcagctaacctctctgagcctcgttttgctgccaagtaaaatgtacgtctcttggagttattatgatatttaaacaatgtagtagaaagaaagcccttagcccaggacctggtatgctgtgtttgcttggtcatggtggttttagccaacatttactgaacacgagctgtgtaccaaaccttgtgccaagcaccatctcatccttgccaaagccctatgagatgaacaattattatccccattttatacatgaagaaactgagatacagagaggctaagtgacttgccctgggcctcacagttaagctccatgcaagttgacccatcttataattgatatcacactgtggttattgatattaatatatcattattctctgagcttctatttctttttccctaaaccaggggtgatgagagctactataaggactaagggagccaaagggtgtaaatatgtagcctggcacaaaacaagtgttcagtaaatatgagcccctcactgttccccaggcctccttccccaccctccctcctctttctcagcctggatttctccacctgagaaggcagcatgggaccttgagaaaatcccatgccggagggaggccagccgagctttgcccccagaaaccctctgagggcctctgtcactgaggtgcttgggtgaccacatatcacagcacacctggctgactgctggcacaacaggagcacacgctgctcagcggtcatgcaagtgccaatcaagctgtcagtcctcactgagtgttaaccccatgtaggagtccagactcagtgtccggaggcaggcagtgtgcaagagaggccatgcctccagggactgcaaaaagtccactaccagaagcccctgcctctggggccagggaccaggccacactcacagacttgaggcacttacctacataatgcaatcccacacctgcccccaccccacatggacacacatacacacacgcgtgcacacacacacacgcacatgtgaaatctctcaccctcatctgtaaggtctagatcattgcatttggacttgaatcaaacagatacatcttacaattctcctttaggcctaagaagcaccttgtttcccagaaagacatgagaaatgtactgtgtctccttcccttgaactttggttaacaggttaaatctgaaggaggaaaatgaaaactttcaagtcgccgtgccctccctatgtttcccacagtggtggggcccagctccaggctctctctctacctatgcataaggccaggcctcacttaacccagacctgccatcatgagagccccctctttctgcctattctgctgggaagtagttggggtggcagtgggaggggcgggctacaaccagctgccccaggcaatggcctgggcagtgaagcagcggctctgtgtcatgaagacctggtgtgtcccaaatgggaagtctggctctgacactagctgtgtcatcttaacctctcatgtcccagttagtttctcatctgtaaaatgggaatgaccacaatgctaccttgtagagttgttatgctaatgaaatgagttatcatatgggaagtgtttaggacacagtccggtacctggtaagcacacataactgtttaaaaaattgaaggattagctggacgtgatggcttacacctgtaatcctagcactttggaaggccgaggcaggattatcacttgagcctaggaattggagaccagcctgggcaacatagtgagaccttgtatctacaaaaaattgtttaaaaattggcctggtatggtggcacatgcctgtagtcctagctacttgggaggctgaggcaggaggatcccttgagcccggaaggccgaggctgcagtgagctgcagtcacgccactgcactccagcctgagcgacagtgagataaaaaaaaaaggttggggagcaggcatggtggctcctgcctgtaatcccagcactttgggaggccaaggcaggcagatcacctgaggtcaggagtttaagaccagcctgggcaacatggagaaaccccgtctctacgaaaaaatacaaaaattagctgggcatggtggcacgcacctgtagtcccagctactcgggaggctgagacaggaggatcccttgagctcagaaggttgaagctgcagtgagctgtgagtatgccactgcactccagcctgagcaacagggggagactctgggtcaaaaaaaaaggattagtttcagtttgggataatgaacaaattctggaagtgaatagcactgatgactgtgcaacaatgtgaatgtacttaatgccactgaactgtacccttaagaaaagttaaaatgattaagtgttatattatgtatgttttaccacaattttaaagaatgaggttaacagaagtgatcaccagtggcattgccagagttccttaaatccaaccaagtcttagacattcagacacagctctctggccagaggcttccgcatttccatcaacgtcatgaaaggttagaccaggccattgctaggatcccttccagaagcttctgtgattcctgcatcaggcaatatcgaagacacagccttctcctcccaccacccactgagaaaacagaaattcccatcaagtcatgcggccagtgaaaataaaatagccttcgagactggcccaggttcctaaggctccctgagggatggagccaggctttcaagtagccaccggccctcgggatttcaggggaagctcagtatcactgacctccaaaaggtcgaagttgggtgtgaaatgttcacctggagtaaacacctctcttggagctgcctgggcaccgggtgagccttgtagcccctgctctcctccacaggtgggaggattagcaggaggggccttctgtcttttatcaacaaggacgttgccacccagagaggtgcagccatttggagtttctacaaaagccccctctggcaggggtgggtcaggagacagccagctttgcctctgggcactgctcagccaactttccctgctccatggccagcaggctctgagatacctctcctgaggtccttacccacctcccaggaaatactatctggaattctgggccctcctaaagattgttgcagtggcagcttcctgttcacccaggttcatgggcaggcactgccacttaccagccatgtgacctgcagccagttttttgagatatgctttcctctgcctcctggagttggggagattgaatgatattttgtgtacgaagtgtttagtcacgtgcctggcacttgggaagtgctcaccctagccaagaactcctcaccactccctgttgggtggaaaaacagccttccctctcctctcttcattgtccatattgaacaaaaataacaacaaaactccatctcaagcttctcagttcagaatttttaacagcttagatatttgagacctgagggaagggaaggaaaaggagaaaaaaaaatgatgtgccttctagacaaatgatgtctaggagagggaagggtggaatactcagcctatttaggaaaaccagctgttctcaaaaacccttcaaatggcttgagcagagtgccgctgaatctgtgccctggtgtggtaaccacaaaggattctgacctgctctttgaagcaggacttctgcttggctgcactgcaggcaggaggttggacagtccagattgcaaaatactctagaatttcatgaacttaccctgccttgcctgtggctttttcaaagtaaagaacgatgactactggaaaatgtatccaagtgggcgggagagttggttgggggggaggctgcatgtagttcacatgcatatgatatttttaaaagatggtttctccagtcgagttccagtagccaaccctccagtagtcattgagtaccctggccttgccactactttctttctggaattctttccttaacctccacagaccaacacccctcccctgacagccaatgtgccacgcacacatgcagcgcctcctttgctttggaatcttgcttatactttgtcagctgcagaggtttctaaactgaggttcctgagaggctttaggggtttcccagaggttccttagggaccaccagagaagggagtggaagtgacagttgagaagatggggcttcagtccttctctgtccacctccatccctaagcatgcttctccactttaattctgaagacggtagagcacagtgaggctgggctgcaggagccagaatacacccagataacccactcctagctctgccacttacgggttacgtgagcttgaaaagggtcacacccgtgagccttactttctccctttgtaaaatgggtaacatgacagaggacttcatagcattgtgttagggacaacatgagaaagcacaaataatttagcatgataacgggcacatactaagtgctcaataaatatgttagctataatattattgcacaatgtgagattttatttgaagaaagcactttttgtaagaaaaaaaaaagtgcaaaacccactggtcagagaaagaggcatctgcatccccacatgggctttcctaagcaagattcatgttttatgtacagaagcttgagagcagatacaaaggaaagaatctaagaacttctaagtcaaaaccagatcaacaaatacaaaatcatctgaaagtctgaggtgagccctgtggcagcgcccacacctcaggaggactcactgttggccacctctagcccagtggacatgcacctgagccttctgggtggccatggccccaggactgctcagggcttggctctcttggccccttcctaactccacgctcccaaggccatggctactttgcagccagcccttctcctgttttctctatacagtttcctatgctgcactggacttaacttttccatctcatggtctctttccataggctatgctggaaagccaggaaggggtatgggatggagctggactggctctgggaggaaacttgaaagccatttatcatttcaggttttccctcataaagtccttcctttcagtgacaaagctgcaattgatggtgcccctgctatccagttcattcaccacctctcttcagtgctgccccgggcaaaacactttcccaactccctatgctagtaaatcatgctaattatggtccaagtttgtctaactcgggcctcctctgacccagactgtctgtcttgtcccagccaagccctgagcttgctttactgtagtttttcctcagctagattgaggaaggccccgtttccctgagaacaaatgtattcccaaaataataaccaataacaggtgacttatactgaaaacttactgtcattcagatactaggctaagttctttacctgcatcatttcctcttcacaacaaacctcctaagatataggtactattgttatttttattttaccagtgaaggaaactgaggtccagagaggttaggacagtttgttagagttgcacagctaatccattgaagagccaagatttcaaatcaggaaggtccatctccacagcccaggctcagttgccacacccaaccctgtgacttccattggaaggtcccttccactccaacaggctcattggctgggaacaagaattggattcttgtacagaattcctgtagctggcaggttcatctagcttcacaaactttcttaccactgctccccaatcagcagaggaaaaagatcaagttctgctccagagggacataactgaaagctctaagctcaaacttcttttagaacctgcaaattttgcattctgctgcatatctattttgttgtaatataaaaatcaggccaggcacagtggctcatgcctgaaatcccaacaatttgggaggctgaagcaggaggattgcctgagcccaggagttcaagaccaaccagcctgagcaaaatggtgagaccctgttcctacaaaattaaaaaattagccatgcatggtgttgcacaactgcggtcccagctactcaagaggctgaggcaggaggattgcttgagcccaggagggtgagcctgcggtgagccatgttcgagcaactgcactccagcccggatgacagagtgagaccctgtctcaaaaaaaccaaaaatcaaaattttccctcaaaatttttgctttgagtgaggctccaagaaaatgaacagtgtgggttccaggatctttatataggaagggcttagggacaacaatccatttggaagagatggccaaaggacatgtctggaaatgattttttttttttggaaatggagtttccgtcctatcacccaggctggagtgcaatggcgccacctcggctcactgcaacctccacctcccgggttcaagcaattctcctgcctcagcctctcaagtagctgggattacaggcgtgcaccaccacgcccgctaatttttgtattattagtagagacagggtttcaccttgttggccaggctggtcttgaactcctgacctcaggtgatacacctgcctcagcctcccaaagttctgggattacaggtgtgagccactgcacccgacctggaaatgattttttaagaacactgcataagattgagaagacatcagttatctataacaaagaaggaagtgggggattaatggactcaccctctgatctttctcttgaagatgcataatgaatattatgtgactttcaattacctgctctgtgcaccctggggatacagcaccaccaccatcaccctctcctctgctcagtttcagaagcttgagtcttgtgtgtgtcctgatgattaagaattttacaaagtcacacagactcgcctgtgtccccagcttttaaaccaaagatggcagcattaagggacctaactcaggctggcaatgcaaagacaaattagctaggtttggtttctaagcttggtttctaatataactcctatttttttatgaagaaaataaaccgaaggtctagaaagggacaaagcagctggcttacacattaaaaaaaaaaattagaagtgtttgaaggaatgtaattaaagtggtgacacgggaagcccaggaggtaaccctaatattgacaagtataagtggatgatatttaatgagcacttgccatatgcctggccctgttctaagtactttccatgtattaatttacataatccttttaatagcccagataagtaggtcctattatttttattttgcagacgagtccaaggaggcaggaccactaagtgtgagagaccatgtgccctttcaactttgaaggggaattcaaaatataggaatcctggtttcaagtttgagaacagtgattttcaaggagcttcctggagctaataccttcacctccactcccagtaaaacagggttgcttttttccagataagttttaacttgaagaaaatattattcaaccataaaagaatccttcaaagtcttagcatgcccactccaaacaataatcttgaaggagacaagtggccaaaagcctgtcagattgttcatcacaaagtgatggccaggagtgatccagcccatgaagacattttgactgggcttcccgtggtgttttgtaaaaaccaagccagttgccacacttgaaaatagaaatcaggagatttcagttagcaatctggtcctggcaacacaaggcccacctttccacaaggcaaggggtcgggtagccattgtgcactttggcatgaactttccaatccccactgtctccacatggggccacttcaggcatagacattatctgctgaccctgcgggcatctggtgcacccacccagctctgaaagctaaagtcctccttctgaatttaaatgcatctcagattatagcatcacttgtgaaaattcccctagaatttctgaaaactccctctagttcaattcttccttccaatgcagctggccctgaaacaagtgtcctgacccacttcagacttcaaaggagctggcagagcctgctgcttaataatagtgacctatgggcattcagatcaagcctaccaggcccatgatggtctactggtcgacataggcagaagggcctcatggctcaactttcccaaaatgttgagattattttataaatgatagaagcgttgagaaaaacactttacatttccagacaacacaacccattaaaaataatatattctgcgggtatataaccccttatttgattgccctgagttcatgtcttccaagtagcaaaagggtcttcttcatgtcttcattaaggttctaaacactatcatcttcagtctctccatcctctttctgattcttcaaagctagattgtattttttattttttctagtcaggctctgcttatccattatttataattacaattacacatatctaccttcatccaaatcttgctttagtcagtcttgagatgtgtgcccaacttggtcctcctcaaccaagaagagtggggcgtggtaagagggaaaatgccacttttccctcttcagtagctcctttactgacaggccgcgtgaccttacaggggtcccgtcagtccccggaacggcaatctcctcacgtgtaaagtggagagagtgactgtcagtcacctggtcagtcagtcacactcactgaggtaggcctgtggtgggctaggccaggctccaagcactcctggttcagggcgagcaaaagctctaggtctggaggggagggatgaggaggacgcctgatgggcactcagtgaggaggaagagacctctgcgagggggagtgaggatgagcagagattcctcaggagaaggcagatggggaccacgttccatccaaagagaagtcgctgtgggaagactctgggccgtggagcctcctgaaagagaagagcaggagaggggctggtgaggaggggctgacagcggcgtccctcgtctgggcagcctccgctctgccactctcctcccgtcctgaggatgggacccccggaaaagaggcctgccatggcacccagagcagccattttcctcccagttctggggctttggaaggagcttgcggatgaggagagggagcctccgcagggctctggctcccctccaggggccgaggccgcacacaaagccgctctgtgggtgagcttcaaagcagagcgccgaggagcagggagccagcgccagcaacacctccccggtgtggggccgactccccgcctgggcgtttctccgaatccttgaggcccccttggcttccgcaaacaatatggccctcttcaagtgccaaagaaaataacaagggggtggaagcagagaggggaggggagggaaacgggaacagagccttggcgaaacctttccatgaaatcaactgtgccctccgacggccgcacaccgatggccatctagggcagggcccgcagctgaaaaatgtcaaggctcataaacatctctcacaggacgccagtaaagtccaaaaggcccctcaggtttactaaagccagaaatcagtagatgaaagctcaggccgaactcaggaatggccccttgttctgccaggaacccctgcctgccctgaagagcccccacgggcctggtaagccagctccagccagtggccagtgagcaagacctgagtcatcggtctcaccggctccctggctcttcctatctgccaggtagaggctacgacatcagcctcaagcaccctggcacaatattgacgctttgatcttaatgcatataaaattctgaaaatttttaaataaaataaatcaactgcccctccacccacccttcggtggtaaaagagatctctggaagacctttgagttttaaggggagcctctatttccttttttgtggaatagcccaattacacctactggataggattgttgaggggacctgagaaacttgagacgacaagaacgcgtagcgcctcggctggctgagggtgctgagtgagtagtagcacctgacaggcagaggacccacctcctgcctggaatcatcagcaactgacaatggtgcgagttctactcacctttaaacgctgcaaatcgcaccactgctatttgctgtggggtataacatgtgagggaccctttctgtcatcgtcaccttagccactctctgctctctgcctttcttttcaggccctcgtgttgtgttctctccagctttccccgtgcctcagccactcttcacgttccatctctgctctgtgctgacccggtatggtggtgtggggagagcaatggctttcaagttcaggctagggttcaaatccagctctgccacacgctggcgtgggttcttgggaaagtccttcatgactttcaagttcctcttctgtgatctcctgggggacgggggaccaaacctgtccaccatgaatccttaacatacaacgtgtggctgcacacatagtagatattcaataataatgtttgtaatagcatttaaatcctccaggctctgttccaggtacttttatgtatattaagtcatttaatctgcagaacagcactatgatacaggtgctgtaattattccaattttaccagtaaggaaactaaagcttttatttattgaatgaaatgaataaatgaatgaatgttttccatggcagatacaataattgtttatgtcaaagagcctgaccaagtacctaataccgcacctcttccataccttatgtccaccccactttccatttctcctaagaacagaaggacagaactgttgaacaccaaatctctacccctgggccaggcagagccacatgccagcctcccagacagatggcactcacaactgtctaggcatgtacacgactcctctaaaggagtgggggctctgatctcaggatagaaattactctgaacaccaccaaaaacacaagaacaacaatacaaccaactctcccatgaccaccttcctctggaggtgcctactatggtgacgcaaggactgtcagactctgggcaatgtctaataacccaaggttcttggcacaagattgccagtaactgtgcagaaacaaatagccagcattgggcagctgccctttaaagcatagggaatcaaaaccagcttcaaatggtttctgacacacggtaggcatttagtaactattgaattggttggtaagtttctgtgtgccattctacatacattaaccccaaactccataatagtcctgggcattgagcatattatccccattttacagatgaggaaactgagacttcaatgtccacagaccttgccaagcggaaagtggtagaatcagaatttcaacccagcttgtcaaacagctgagtttgtgcttttgatatcatgttatctggaatcaaataactgaagggctgttttctttctttctccactaaatgcctttttttttgagcatcagcaccaagactggttctttcttgcccctgtcattccctctatgatgccaaagttcatctgtaggatccagtccctctggttttctctgcagaatagaaggtgacctgggctctgcagaacacccagggctggaggccctttcaacttattggctgaggaatgaggatgttacttaactgatgcatccttcaggggccctctcgaaggctgtcttgggactgttgtccctcacttctttctcctttggtgcagcctgtgactcatactggacatcagtccaccctgaatactggactaagcgccatgtgtgggagtggctccagttctgctgcgaccagtacaagttggacaccaattgcatctccttctgcaacttcaacatcagtggcctgcagctgtgcagcatgacacaggaggagttcgtcgaggcagctggcctctgcggcgagtacctgtacttcatcctccagaacatccgcacacaaggtcagtgttcagagggccagacctccaggggagggaccaggattaggaccaaacaactttgagaagtcctttcccatcgtgtgacttgcacagcaaaattttactaactggagttctcgttaatccaaaccttcaataactggaagctagtatgccagaattggggattttagggaaaagggagcgagttacaaaaatgcaaattgagtgcatttaaaaaaagagaaagaaaaacggacaccacgttcagggactgcccaggcaccaggctgataataatacagtatattcataatgatttgaaaccacacaggatggacaaaaaagaggtttgtgcttcatctctcattaagcagaagaggaataaaattaaatagactaccttcccttttctacaggagtccaactaattatcatttcatcacattcctaatggtcaaggatcaagtggccagaaggtggcgccaatagcattatttaactcttcaacaggccttttgcatgcagaatgtcgatgaacattttttcaatccagaaaggttctttgagaacatcgagctctaatgtctcaaagtcacacatagataaaggaactgatatcctgagacattaaatgacttcctcaaggtcacacagcaaacagggctgattcacagaaagtcagtacaaagcaagggcttggagatccgaaagacctgtgttccaaccctggctccaatactccgagctacggaacctctggcgagtggcttaagctgtctgaatccccactgcctcatctgtccaatgggataatgacacctccatgggctttttgagaggattcagggaaatattacctagaacagcatatgaagatggaaatgcagtaaatggcagctgtttttccatcatcattaatataatcaagaggcatattataggatgttaaaggaagcctatctcagctcagttttaagaaggatctttttaaaggttagtaccttcttttgaaaaggtaattcagaagatacaggagataggacgatccccaccactggagataatcaagtagtctaatagccccctgcttgaagaggaggatatgacagcgcctcttgtttgcacagaaaaaccacagaggaccctcctgctctgtgattctttggcctcctcttgatcctcatccatcatgagcgcttgaaggcagaaaagctaagaatggtggcccttgggcactacatggctggggccctgggagccaaaactccagtgacaatgacctgccaagagctgggatctgtgtcctgtgctcagagtgggcactccctgaaagaggacaagtttgaccaagtcacaacggctccagaagaaggagcttgggactccatttaggatcctcccaagggaacaggctcgcacaaaaatcctagggccacagagaggggtgtattttattctggaaaaagatgcagcttggcaatgccagcttggccaaatgtcaagtcaacctcatttgtctccatgctcttgtgcagcccctgtgctggcatctcccaccacaagcacctctcttccctggcaatggttgcatcaaaaaacaaacaaacaaaaaaaacctgttggccaggcacagttgctcaggcctgtaatcccaatactttgggaggctgaggcaggcagatcatctaaggtcaggaattcgagacaagcctggccaacatggtgaaaccccgtctctactaaaaatacaaaattagacaggcatggtggtgcgtgcctataatcccagttactcaggaggctgaggcatgagaatcacttgaacccaggaggtggaggttgcaagtgagccgagattgcaccattgcactccagcctgggcaaaaagagcaaaatcctgaaaaaaaaaaaaaaaacaaacctgtccctggttttattaccccagggccctgtgcaaaactaataggctaaacctaaaaaagccaactgctttttaataggtcatacattacctcttcttattgtaaggaattcctgcaatcacaatgccacctttaatggtgggatttcaagcactctctaggccaggagtgttccatattgagcagtaaaactatctactccaccaatctactccattctgaaattcctcttttaatgtttctcaatcagatatgtggattgtagattgtggagatatatatattgtgatcaaagttcacactgtctcccatttgcccaggagacatcgtttctgcctgtgatcctagagtaattattattaccatagcactacctttcatcctcaaaagtgtctccatttagatcataaattctacagttgactgggggttattacctcatgtatgccttatactaccccataggttttgactctggcagaacaggacacagaataaggcagttttatggaggagaggagctggaagggggttgtaaggcctcagcaccatccagctcggtaggtattgcagtaggatttaagggcctagcaacctggggacactggttgctgggaagcaaggtcagaggttggcttccacagcctaggaggggaatgagcccctcttcaatctcccatcctgttctcagtcggccctttggacagagtcaactgaggcgcgtggctgaccaaaaccaatgagaacatgacgccaagaataaaaaatcacaactgtgccctgctccagtctgcttagcaagtagagattagtcctcgtgttggaccaagctaggacataggtatccttcagcctaaactgctatgtgaaaacacaatctcaaactcctcattcaaccccagcccaccccattctacagaggagagaaccaaggtcctgacatcatcttccatatcctcattaaactcagcattcacatagagctttgcacttcttgcaacctcctatgcccattctccccactgaccagcacataacaggcattccaatccccaagggattagaggccatgtcagagactatagactcttagccacaggggagcttagtgggtattttatctcgtgatgtcaatgagaaaaaccaacaagcccagagactgagtgagcaaggctgcacagggatcagtagcccggcccagctcagagcccagccctggaccccagaccagagcttactccccagtgcctgctcagaaaatctgcagaggctgctgggaagcctggttctgggtgctccctccaaatgacctttaataatgaggaaattatcacctctcagggatggcttcagggtgacactctaagaccagatggtctccaaggttccctctaaattgtaaccaacctcaagagggacagtcactccacttccctccaacaccccctctcctggcctggccagtggaaaccaggattgcatggtatggtttctggatttctttttctttcccaggttactccttttttaatgacgctgaagaaagcaaggccaccatcaaagactgtaagtaaccaagctcaagccacccaaggctctgtcaaggttgtcattggtacatgggcttgaccattcttttaggatcatactgaaaagctgatgaaccaaaacaatcccagacctggagaaagcagtggggaaaagcgtggtggaaagagtgtgacagaaagagcgtgggtgtgggtctgtaggaccatagcttgggtctatggattgcttatcgtctgagactccattcccctatctgtaaaatagtgtgacccttgtgggtcgtggtaagtttgagaaatgatgcacacaaagagcccagcatgcgccaccagtgtagatgctcccaaaccagtatccatttgtcatacattaataatactattagaagccttgtggttcataatgcttaagaagactctgagctcactaagcaggtagagtttataattataagacgatggaggatctcaaatagccttgttgatgctgatgattaaccttccctgtttcacttgggcagatgaagaaggctcgggaaagggatctttggtgctttcatttttcaaagatgacaatgatgattactattagttactgagtccctggcccagaggccaggaggaaatgtggtcctgggcaaaccccattcccccatgggcttcagctcagtcatctgcagagagggagcagagcgcatggtgatttccaaggcctctgagggctgcaagctggaggggcagacacagagggactgttcttatgggttatgattttttcctccttacagtcccaaacaatcaactgaggactcacgttacttggatcctagttaacaaaagtttttggaatttcgtttttcgttttgtttttggtgctttagcacaggaatggccagttcgtggaccacacgctacgggcttaagcaggtgcaccctgctctgcagaccgcagctgccctcacacgagcagctctgcattctgccaggtttcatcactcggggccccggggtgtagcatctcacccacctgtgaacaaagctcacacactgtttcctggtgctggtagaatcccttgtgatccatctgcagcagcctgggggatgtaaatcccagcttttaccaccacacctaacccagtcaaagcccctggaagaaatgagcctgtgaagcctgggagacattactgtggccaaaggcttgagccacaggcaggcatttgctttactctctaagtagtagtgacctagacctgaccaaccctttctccaggggtcagtgtcttcacctacaaataggaatcacttaccagcctgccttccacacgacaaaaggaagctaatacaatggaaagagaaggtgtgtccagtaagttcttttgaagtaggtgtaacctgaatatataactagccacagttagattcaatgtgctgatgattatgatgatgaggataaggatgaggatgacagctagcatttattgagtgcttcctatgaaccaggccctgtgctaatatctttatagacattgtgtcaggtaatcttcccaatatgagacaagccctagtgctatagcctttttataggggtagaaactgaagcttagaggttaaaggtgacatgcttagaaggcaacagatgacccaggtgtgtctaaatctaaagcccttcatgcctttgctccccttacccatttatttctctcctgtttccttcattctttgaacaaacatttattggacacttactatatgccaggcccagagctaggcactgtagctgtggtgatgagcactatttgagtcttgctctcattgaggcaaggtcggggtagagatattaaataacccaaatgataaatacataactgctcatcacgatgatattataaagggaaagatcagcatgttttgtgtgtaatggggaaagagtgcatttaaactgggtccagggacagctatttggaggaagagatagttgaattaaagcatgagaagaagttacccaggaaaagagagagaagaaaaggttccaagcagcgaatggccagtgcggaggtcacgaggtggaacaatcttggtgtcttagagaaagaaccaaagaaggccagtgagtctagcattagcttggccagtacagtagccactagccacacggggccagtttaattacttaagttatattaaaattcaactcctcagttgcatagccaaatttcaagtgctcaatagccacaggtggctgccatcttgaaccgctcagattctactgagcggttcaattctgtgatagtggaggcgtaataacttgtataacactcacagcatcagtagtctcagcagcatcagcagaaggaggggtgggagctgaggccgagagcaggatagggccagatcactcaccactttgtgggcagcagagttaggatttcattctgagcaagctgggaagccactgaaaggtcataagcacgaaagtgatcagatcacatttacattttaacatctcttgggctgctattgtctgggtcagaaagcagtctagccaggatgctcctgcccagaggagtgatgatgatggtggcctggacccagcgatggggaagagatggggagaagtttctagaaatagaagtggtggggcaagggctctgggctagcatctctggagcatgaactcatggagacaagccctctgctgatggttggtgccatgggctcttccctgtctgctccatttgggagcctagaactagactgaactcagggttaagaagtttaagtccacctgagagccagccccagaggctttgccttattccagcctcaatgccctggccaggacaccatggccttcccccgagacccctgaggaccatctctggctctcccccaaccctgatgatcatgctttccccaaacagaaaccctaatggatagtttgatgggcacaaggggaggtatgaagacgacaggttggtagtttatacaatgagcccattccagaaagtccaggacacgtgatcatggtgcctatggctcaggtgatgtttcctgatctcagatattccctgacccaaaaatgagaggctgcctttcagtgctgatgtcccatccaaagaccaagacctggccaataaggaaagtggcatcctggggctttcagcaatgttcccattgggtcttcaacgaaaatgaatatagctgtctttaccatttattaagcacttactatgtactaagcataacactgtgccaagtgttctgcttacattatcacatttaatccttgttctagctccattagggagtgttattatctccatttgcatctgaggaaactggaggtgtaataacttgcaagtaagtgcaggggtgagattccaacacatttcctcaaagcctgtgctttttacattgtgtgctatgcacactcacacatgcacgcacacacacacatattcacataggcacacatgttcccatgcccttctattcactctgctgcccactaagttgagatccaaggcctggaaactcctcaagttctgggcccagcttgacaataattcaaacaacaggatgattttcaacttagtgcccactgaaggtgcccagacacacaagctacaaaactgtcagagctggccaaagtgaaacaacccattccctttctgcttggtctcttctctccacctgtcccactccccacccacctccactgcagaaatgccagtagagggtgttctgggcccaggaaccaagcctacagtcctgggttcactgccaggcacctccctgctcctgagcctcagagcttctctgcaccagcctggcatggggtgtgggctccatggctggactgctagtgtcatggggatacgataaacttgtttcggaaaccctgcaactcaggcccccaccccagcttctggagtgcttgcaataaacaattgaggatacatcctttggccacattttaaaagtgtccaggctcaaggccaaccaagcctctccaaatcccacagactgcagagagcctgggccatgtctcccctcatcccccaccagctgcagggacatagtcaagatgacaaaagttgtgagcaagggagagctgcaccctgaaacacaactggcatttacagagaaatatagtgggttcacggtggtgctacagatccaccacccagcgctggtggaggttgatttgggaacctgcctcagtattaacattgcagtaatgactttggccccctgcccctgccaccaccagccaagcaaggccttgactagtcaaccaatgagtaccttcaaagccatcactgcagaactaggaacagacagaacagggttatctcagcaagacccacggaagaaattcccatcagcctcataaacccctctcatgctgatctgtactgtgttcctcctaccaagccagatccccttcatccaaaacatgggagaaatcattaaaatcaaaaggacaatgtttttcctcccacttcttgccattttggcatttcagtgaacgcttgttgtctattcacacttaataattcacctttgtttatgactccatttgttttctcttctcctaaaagattaaatcaaaacaacagatcgatctgggggtagtaatagacatatctcataagggtggggaaggttgagtgagcatctgacaatagcaaatgctcaacaaatcttagctaataatggttcattaaatgtctattgaacacctgctgtgaaagacatgataaagtagtagttatgaacattagctttgcaatgagaactctctggttccaccatctggaaaagattcttaagctctctggacttccaatccctcctcaataaaatgaaaatcataatagtatcacccagggttgttataagtttgaaatgagatactctatgtgaagcccttaccaagcacttggcatttagtaagtgctccgtaaatatcagctgatagtggaggagaaaaagagatggatctttccagtaaggtaggcccagtgttgtgataccaaggaactcacaggtgctctctatggggctcataaggggtctaacccagagggtcagttcagagaaggcttcctgaagaggtcttgtgagaggtccgctgggtagaagtggagagtggggagtctgtgcaaaggtcctgaggcagaagaaagccttgcctcaatggaaccatttgacctaagggaagggaaaaagttgggaagcagaaagagataagactggagatctggatgggggtcagtctgtgaaaggcctatctaatgtgcagccttcatcctggaagaaatggggaaccactgcaggatgttcagctggcgaggtgacatgacccagtggcactgagagaggtcaccctaagcagcagtgtggggcacaggatgtcattcctgcccttccttcattcagcagtgacagtgtacatactagacgatgcagcagggatagttgtacagtataatatagtatagtatagtatagtatagtatagtatagtatagtataggtaggatagtatagtatagtgtagcacagtacagtatagttagtatactacagtacagtgcagtatagttagtatagtatagtgcagtatagttagtatagtatagtacagtacagtatagttagtacagtctagttcatatagtacagtatgtacagtagaatacaatatatggtacagtatagttagtatagtatagtacagttattacagtatagtgtggtatgattagtatagtatgctacagtataatacaatatagtatagttggtacagtgcagtatagttagtataatacagtacagtatagtatagcacagtacagtatagttagtatagtatactatagtataatacaatatagtatagttggtacagtgcagtatagttagtataatacagtacagtatagtatagcacagtacagtatagttagtatagtatactacagtataatacaatatagttagtacagtacaatacagttaatatagtatagtacagtatagtgtggtacagtaaatatagtatactacagtgtaatgcaatatagtatagttggtacagtacagtacagttagtatagtatagtacactgtagtatggtgttagtacagtacagtacagtaatagaatagttagtatagtgcagtacagaacagtgcagtatgatatagtatagtatagttgtcatggtatactacagtacagtcagtatagttagtatggtatagtgcagtataatgtagttggtgtagtatagtatagtacagtatagcatagttaatatagcatggtacagtacagtatagttggtatagtatgctacagtacagtatagttagtacagcatagtatgtacagcacaggatagttagtataatatagtacagtatggtgtggtatagtacagtatagttagtatagtacagtatggtgtggtatagtacaatatagttagcatagtacagtatggagtggtatagaacagtatagttagtatagtgtggtgcagtacagttactatagcatagcacagtggctgctcgatgatactgagcacctactatatgcccggcagtgtgctaggtgctgcagggttatgttgggaaacacaaatccctgccccctcgtgtgcacagacagacagtgaacttcatgaataaatacaccatagaatatgctcgaatattctatgtaaaatgcggagcagtggggaggatgtgcagacccaacttgagtggtcagaggagacctcactggaaggtgattttgaaacaggattgagatgagggcgtgcaccacaagtatccaagggaacaacgtgcaggacaagtggaagagcaactgcgaagtccctgatgtggaatgtgcctgcacgtttccggagagcctgaagccagggtggctggggcaaagcaagcagggggctaagagaagcggtggagacgagtgtgagctggaggggcagatctggtgccaccattttaaaaactcatatactactctggcaatgcttgtcctggtgtctcaggttgtgactcacagcctgagttattagttaaatcagcacggagttaacgtcttgctttctacccttcataagctctagtctctttgcttctacttgtgtctcttccagtctgttctccacacaggagcaagagagatcttcttaaattgaggatctttgctctacactttgatataaagtcccaagtccttaccatggcctcctaggaaggccctgcacggacctcgatcaaaaccagatttatttattctcatcagggtggggtgagattgaatacaagtgctcctcaaaggcacatcttaaagcatcttgacacctgccacctagtaatcacccccaaagtgcctaatgtggtgtcttctactacaaaggcattcaattagtatttgctcatttgggtatgacttgaggtctgaatgtggcctctatatccctttccactgctataaattattctatttcagatgctgattccaactgcttgaaaacaagtggcatcaaaagtcaagactgtcacagtcatagtagaacaagtaagtgcaggatgccagttttcattctaatttcttaaaaccattcctcagacaaagtcatctactttaataagctttgaaactaaatgtttgagttggaccagttactccccaaggaaggtagtaaagaaatcagtgattgcttttatacgtattatcaaagtcagattgatttcttctcatacgagtgggtgagattaagcatctgacaatagcaaacgctaaacaaatcatagctaataattatccattaaatgtctattgaacacctactatgaaagacatgatcgtagttgtgaacattagctttggaatgaaaaccccctgggttcaagttctggctccaccatctggcgccagatccaatcctgggtccactgtggcttcatctcagaggaggataacaaagaaaacaccgggaattggcaatcctattagcttccccagcactaagagatcggcccagagcagtgtcaagcttgtaatttcacaaatgtgtgtgtagaaaacaattgctatgtgctgggcataattctaaccacttggtatgtattaaatcattaaatcctctaacctgtcctaggagacaggtactctttattatcccattttatagatgaagcaaccctaaaagtttatggttataaaggtaggaagaggtgaattcaggacccagactcagataatgggactccagagctggtcttaaccaccatatcatagaataagagaaataccagcctttcatgaaaaacgaatttgcaggatcagtccacccagacagttgtggctgtggaatcagtacaaccatgctgcctgtcagaaagaagaatgaaaagatcatttgactgtcatttcactcattccataaaagttaaactgtagttccatagaacatctgtgagtcacagtgttgccagtcatgtaaattgggtgtctctgaatgtgtgtttcacaattgcttcgatgggagacacagacatgtcacagctcagtaagtttccaggtagagcaatcagtcataacaatgggaaatattccacaaagcagcaattctcatgacctagtgagaaattgtacatctcttctcttaaaattaaaaaaacaagctgggcacggtggctcacacctgtaatcccagcactttgggaagctgaggcgggtacaacacctgaggtcaggagttcgaggccagcctggtcaacatggcgaaaccccatctctactaaaaatacaaaaaattagccaggcatgatggtaggcacctataatcccagctacttgggaggctgaggcagaagaatcgcttgaacccaggaggcagaggttgcagtgagccgagatcgcaccattgctctccagcctgggcgacagagcaagactctgtctcaaaaaaattaattaattaattaattaatttaaaaaacaatggtaaatagttaatgttttccccttttcaaaaggcctccaaagttctcatctatgggaatttgtacgagacctgcttctatctcctgaagaaaactgtggcattctggaatgggaagatagggaacaaggaatttttcgggtggttaaatcggaagccctggcaaagatgtggggacaaaggaagaaaaatgacagaatgacatatgaaaagttgagcagagccctgaggtaagttaatagcataaaatactatgagccttcaagaagagttatatacaatggctggctgtagaaaattacactgtttttgcaggttttttacttgataatggaaaggtcatgagacaaaactttggttcttagttacaggtaggattatggtttgtaaattgacacgctgtccttagcattcttggcagcattccccagggatcactctgaatccaggccatctcacacgcccacacacacaaagaaaaacacgttttgagctgagaatggtgaggttcagtcttcaagatgtctgggaaaggtttaagtgtaagttgataacagggcatgaaaataccagggtaaccaaagaccagccttgtcacctgagaggaatgaggagacagtgtttgtgttctgttgttttcctagggtgcaagctctcccagaatttctcttctgcttgctttttcagatactactataaaacaggaattttggagcgggttgaccgaaggttagtgtacaaatttggaaaaaatgcacacgggtggcaggaagacaagctatgatctgctccaggcatcaagctcattttatggatttctgtcttttaaaacaatcagattgcaatagacattcgaaaggcttcattttcttctctttttttttaacctgcaaacatgctgataaaatttctccacatctcagcttacatttggattcagagttgttgtctacggagggtgagagcagaaactcttaagaaatcctttcttctccctaaggggatgaggggatgatcttttgtggtgtcttgatcaaactttattttcctagagttgtggaatgacaacagcccatgccattgatgctgatcagagaaaaactattcaattctgccattagagacacatccaatgctcccatcccaaaggttcaaaagttttcaaataactgtggcagctcaccaaaggtgggggaaagcatgattagtttgcaggttatggtaggagagggtgagatataagacatacatactttagattttaaattattaaagtcaaaaatccatagaaaagtatccctttttttttttttgagacgggttctcactatgttgcccagggctggtcttgaactcctatgctcaagtgatcctcccacctcggcctcccaaagtactgtgattacaagcgtgagccacggcacctgggcagaaaagtatcttaattaatgaaagagctaagccatcaagctgggacttaattggatttaacataggttcacagaaagtttcctaaccagagcatctttttgaccactcagcaaaacttccacagacatccttctggacttaaacacttaacattaaccacattattaattgttgctgagtttattcccccttctaactgatggctggcatctgatatgcagagttagtcaacagacactggcatcaattacaaaatcactgctgtttctgtgattcaagctgtcaacacaataaaatcgaaattcattgattccatctctggtccagatgttaaacgtttataaaaccggaaatgtcctaacaactctgtaatggcaaattaaattgtgtgtcttttttgttttgtctttctacctgatgtgtattcaagcgctataacacgtatttccttgacaaaaatagtgacagtgaattcacactaataaatgttcataggttaaagtctgcactgacattttctcatcaatcactggtatgtaagttatcagtgactgacagctaggtggactgcccctaggacttctgtttcaccagagcaggaatcaagtggtgaggcactgaatcgctgtacaggctgaagacctccttattagagttgaacttcaaagtaacttgttttaaaaaatgtgaattactgtaaaataatctattttggattcatgtgttttccaggtggatatagtttgtaaacaatgtgaataaagtatttaacatgttcaactgtctgtgtatcattcaattcagcatggtagcctcagcaaaacactgacaacctgtaaaacctttggtgattcttccatttcctagcaggtgtggttggagatttatcttttatttttggagatgggttcttgcttgttgcccaagccgtcctctaactcctgggctcaagtgatcctcccgtctcaacctcccaagtacctggattactatgaacttttgctaaatccacaccacacctggcaggctggagattttcaaagagcccaaaaaggtgcaagaaatatatggagtaatcttaccctccacctttaatatcataagacagaggttcccatgacaaaatggagttcattgacgcacatagcctacagatgcatttttgtttggtgcacatagtattgtctgttttcttgaggttttcttttatttcttactgttacttcattgcctaatttagaaatcgaaagattcacctaaaaatccaggtttctagcttctcttttaaaatcatatctggcaacactagtttctcagtctcttgtggtggtaatttcctggagctaaattgaagttgcacctttggacagagga

SEQ ID NO: 15517 - DNA, 83497 bp, Human
gtaaccgcaatccagatcccatgaaaaaataagggcccaatgtcaccatgtgttctgaggttttaaaagaagctgaaatgattctggattttgaaatgttggcttggcagggcgtggtggcttacacctgtaatcccagcactttgggcagcttaggggggtggatcacctgagataacgagttcgagaccagcctggccaacatggtgaaacccagtctctactaaaaatacaaaaattaactgggtgtggtgacatgcgcctgtaatcccagctacttgggaggctgaggcaggaaaatcgcttgaaccaaggaggcagaagttgcagtgagctgagatcacgccactgcactccagcctgggcaacaagagcaaaacgtgtcaaaaaaaaaaaaaaaaaaaaaaaaggttggctcaaatttttcatgaacattgagtgcagcaaaaaaaaaacatgcctgtccaccaagctgtctgtgggccatgtttggtttgagaatcctagtttattctcgggtcccttaaggctctctttgatgctcattctgatgacattacactaagatttactgattgagggtacggacacttctccatacacacttgcccaggaacgatctccagttacctgtcctgtctccaagatcttctctctctcatccaatcttgcctatgcagcattctattttcagagtcgtctttgctaatttggggaagtcacttattcaaacaagaaagtggttgacaaatgtttagcaatgaaatctcccgcgagttactactttttaattaggattttcaaccctaagaaagatatagataggaggaataagatagggggaataaggaaactaattttgaggggtttccctgcctcttaggtggggtttatcatattgtgctgaaactgcttattcgtctagttctccagaccctgggccatttatcttacgtatccctatctctgagcgtgtagaaggcgctccataaaactgttggtttgtgtaaatgaccgaaaactacatgcagcgtgagggtggatttccctttgacttcggcttaaggaagaatcgttcccatgatcatcccacaattcatctaaacggagataggcaaggagcaactgctcaaaggcaaagcgctggcagctgaggcacagctccggttcggcaaacgtctcccgagtgccaaacgtccccccaaacgcctaactggtcgtcagggcgcagaaaagaagcttggggggcgcggtcttcgccccagctccacttcggtgcttcacgattccttctctggcctgccttcctgataaatacccggtgaggtcacctaaacgctctcctctctcagttatttgcttctttccaacgtttggcgcccagctcccgccatcggagcgccccgcccgagaccactgatctcctggggcctcgcagccttgcttccgaacgccaaggtcgcggtgcgccggggtagcgaacggccaggcccgaaaccccgccccgcagctaaacgcccggcccgctaccctgcgcccagctccagccgccgggtcccgcctgggcctctcctcctgggaataccgggcaccggtggccccgcccctacctgcgcgccgcatctccgggaacaacagtctccctcccgagcatcacagccagacatggcccagaccagggacccgcgcggcctccaatctccgcacggctttgcgcgcggcgcttagcctgggatacggcagcgaggccgcaaatgcaatcaggcggcgctgagggcagcccgggggcggggcgaacggggcgggggccggggtctggtaaggccccgccggctgagatatccagcggcgcacctgacttcccgggaggcaaggccaacgtggttggaggcggggctgggttggggggcgggggttcaagtctgagagacctaaaggcaccgctagcgtctgggggcgtggccaaccatgcgggaggcggggccttgatgctggacatcaggctgtgctgcgggcagccagtgagaaggccgtcaagatggcggcctcctggaggctgggctgtgatccgcggctgctgcgttatcttgtgggcttccccggccgccgaagcgtagggctggtgaagggggctcttgggtggtctgtaagccgcggagctaattggagatggtttcacagcacgcagtggcttcggggtgagtggccggggctcgctcagcttctctgtgtagctgagtgatgggcctgggacaggggcagttatgattgagggcctgcttttgggtgtgaaggtgcgcgggctccttattccctttcctctttctccggttggggtccgccgacttggcctaatgcatgctgtgaagggctttcttggcagctgagagaactcgactctgccctaggccccctggtttgtatggctttgtgaccttgccttggaatttgggttatttgtgaggcgcagagagggttcccaaactctcctccctcagccccctttccaatcaaggctcaggtttctttagggttgtcaaacgtctcggacgagaaaaagctgcccaaggttgccgagattgaaaagccactgttgggagttcttacttattctctaggcctctctctgttaggaggtgttttcattgaggccagtcgagttttaccccacgccatgactcgtggaagacttaaatttgtaaattcctacggcatcacgatagacaaaggtccaggagaatgtttcaagcaaatattcgcttgaaagagcaaacatttaggagataaatcataccaaaaatttattatagaaaattgttgtttagtaatgatattgatgcagttaacacaattcttgcagtatttaacagtatgcaaaatggcaggccgggtattatttttccttattttgggagaaggttggagggaggcggggatggagaataggactgacgttttttagtgtgacgtattacctgccaatcatcgttcctggcactctacagaatgaattttaatttaaataggtctagtagacgttgccttcatattctgagctaccttaggctcagaaaaaaaaaatcacacaaagtcatatggtaagatgagtgtattggggttcctaaaggttccttaatgggaacaatttatttcatttttggtgtaatgtttcataacatattccttggagcagaggtgctttaacagtgtgtgcagaattccttctcttccctcctccaagtttgttgaaattaaacttttttccagctcctagagattcggtctggtctggtgtggggctcaggaatctgcattttacaaatgttggatgagttttgatgttttattttgacatttaatggaatgagctttgagactcactgccttagaaaatcatggaatattaaaagtttagtattggatataatctaggaagagtgctcttaatcttgtttatcaagcagatccttttgagaatctttgaaaatgttacagactctctgtacagaggaagtaccataaatggtcacacacaaaaatgtgcacgtagtggctcacgcctgtaatcccagcactttgggaggcgaagctggaagattgctagagcccaggagttggagaccagcccgggcaacaaagtgagacccccgtctctacttaaaaaaaaaaaaagaaagaaaaaaagccaggcgtgctggcatcccagctactccaggggctgaggcaggaggatccgttgaacccaggagttagacgtttcattgagctatgatcctgccgctgcactttagcctgggtgacagagtgagaccctgtctcaggagaaaaaaaaaaaaaagtatacataggcccagtttaatgcctttagaaactcagttaggcaagcaatccttatctgcatcctcatgatgcttttttacctattccctatcccctagacatataccatgaacaacttgtctaccccagtttgaataccatctgtcaggaagaaggcatggcatctcaaggaaagccaaattagttttctagtgctgctgcaacaaattaccagaaattagtggcttaaaacaacacaaattcacatctcatagttctagaggtccgaagtccaaaatggatctaactaggctaaaatcaagctattggtaggagctgcattcttttctggaggctcgagaccccattcccttaagttttccagattctagaggtttctaagattctttgactcatgggcttcaaagtcagcaatggctggttcagtctttatcacattacgtcactcttaatactcccctctgccttctgccacttacaaggacccttgtgattacattgggctcatctggatgatcctgaatattttccccatctcaaggttgagtagaaaccttaattccatctttaaccttaattccctcttgccatgtaacagcatattcataggttctgggtattaggacgtgaaccttttgaggcatggcattctgcatgtgaagctgtggaaagtatttggaaatactaagtatttggaagtgttggacttttttcctaataccgagccaaaatatatccgcttctgactttcacctacatacagatttttgttttgccatgccgaaaacacgtggcaatccttgaactatttgttttacaaactgtgaatttacggtggtgttttttctctgagcttggtagaaactgtagttttataaaactaaacaactatttggattactgtaaactatataaattaagtacatttattgaactgtttcgtctttcacacaaatatctttaaaaatttgtcagtcggaactacctttggagttttaatttccttaagaggtgctggcagcatttttatgagctatgacatatgccattttcttagcactttctagaatttctcattcacttctcacataacctagtaaagttggcatcatctgcatttagttggacaaaaacaccaaggcttagagaaattgagtctcctaaagacatgtaactgtgttgatgaactgaagtgcatgtatatatttatatacatatattaatttgtttaacaaatctttaatttgtatcattctctcaacagatttattgagaatgcagagactatcttttttaccacttacattattgaagaatgagtgaagaaattagcatctattaggtgccaggcacatggtaccctgcttgggaagtagtggccagctgaatcaaacagattctcagtatttgccacatggcacatttaatcatacttagctcctggacatgcaatccaaaattctatatagggctgatccttaaggtatttgtagtctctttggggacataaacaataaaggtatgatttcaatagtgtatacagtaagctcagagggggtaagtttgaaatgatcaggaaataatatataaggcagcttcttagaggaagaggtgacagcccttacaggctgaaggaacagcagaaacaaagacccagagaccagagtgatcattatataattgacacagcatctgtaaacagtttttcaacctactctagacagttaacttcagagagtttaaattgtggtcctttcagagtaggtagcatgatttggaatataattggtaagatgttaattaatagtattggttttaagttgtctctgaagaataacatgttgaatttaaaataacctgtgaatagaaaagtaactgaggttcaatcttggtggcgatttgcctagtatataattataggcaatacatattatagatgttcaataaacatatctaaggaagctagtaatctaggaagttataaaagaacactagagcctacagtaggattccaagttggcagccagggaactgacccacattgttttagcagaaaaacttatggcaaaattttaaaatcaggagactttacagagaaatctagatttttgttctctctttaaaattgatagttaaatcctatgtggtgacaattatctaacactgagtaatgattgttctttttaggtaggaaattgcttcctactttgtcactatgccgcctactctgtattacatcttagcaaggctgaatgtcccttggtatttgcatcacctctagttgtcatttttttttcttgtactcttatctctacggaaggcagaagacaaaagaccaagaaaaatgggagaaagcagatattgtgtatatgtgtaaaggaggaaaatgcttatccatttaatatgaaaataaaggatgtcagaatctaaagaaaaaacctgaagatgctagtcctcttctctcacctgcctgttttttgtaggcatctgagtttttgacagcagtgctataaccaggagagagggaacttctttgatagagttaatggtatggtatttctgccaaaacacggatactcttttaggcctggttcttattaagtgcttatacactgataagattgatattctcctttgaattctcatttaactgtggaaacagaaacatgtagaatagctctagtaaaagtaggatttattaaaaggatagaacatcacttataaaatgctgcagggccatggggaaaccataattattccatctatttcttctagggctcatattatttgtcttctttctcttatttactttgttttcctgtacagacttgcaattatcaatctgtttactcctggcttttctttctcagtgtcagcttgccttgcctcagtggtgattcaggcctttatgcacgatgcgctgtcagttttgtttaagtgctcaccatcatttctgtaatctcctttcaaattccttgaatagagaaactgacccaaagtagaccagttgtgctacagggcatgcaaggctgattctttcgaaggctacgatttggacattttctttaagaaagtagttgagaatcaatgattgacatttctgttgctatgaccatctgactaaaataggccagtaatgcagtattttattttattttatttattttaattgtttctgcgctaagtaatgaccaagcaaagtgtatcatctaagcaaagcacttgtaggctactcagctgagatgtttgcccatccaaagaaaataggacaggggtaaatgagatcttactacaggcagcaacaggagggactaagaagatttagatgatcaggaaatactttgtatatgtttaccttgttttaaaggattttattctgtctatgaaagcagggtattagaagtagccatcacatactgagctctcactatatttgcattacttctaaccatcataaaaaccctgcaaaggtttgccaggtttcacgggagaagaaatagactcagagaggttttagcattttacccaaggttagtggataagtggatgaccactttggaactgtgcacgtgatgacatccagaggaagaagagaggacctttcttcttggatgtcttttttgcagaacaagaaacatcttctgttaccacagcagaattttcttatattgtattgaccagaattgggtcgtatgccctttcttaagttaggcactggcttgacttcactgtgtgaaaaatgtatagactttggctaatcaaggggatgggtgtggaatcactaactctgagtacatatgcacaagaaaagtatattgctgaacaaagttgagctaccagcaagaaagaaatttggggataggtttgggaataataagtagcatttgttgagagcttactatatactatgcacccttgtaagcactttacatgaatcagctcatttaatactcacaactaatactatactctggtagatagttcaggtttcaacccagatctgacaccaatgcctgtttccttaaccatagtctacctcagtatcaagtgatagcttgattatagatttcagcagaacagtgtcagcatgctgacgttttaaagttcaccgtgtgtacatcctaaatgaacatttttgctttttttaaaaaaatgaaatcagacatagtaataaccgcattgtagactagcatttctgtgacagcctatcattttagaacaattaaggacaccaaaattcttgactacgtgtaagggtggcaggactatttaagagagttagagtatatattgacttctcctatctgtaaatttctaaggtgatgtactcttaaatataccttcttgttgttgtcttgagcttaatttgccttttacgacaaaatgtgtaaattcccaaagtatcgttgtgtgtgtgtgtgtgtgtgtgtgtgtgtgtgtgtatgtattcttttgctaggctgtaaatggaatggtaatttcttttggctcttctcccaagatggcaaagtaaagtgaacttcatgtagaattttaattttatagtttaataccaagaaggacagtattccaagctgaaatctcttctaaaatgtttggtttatttcattcaaaggaaatgcattctacaccatatgctatctaaaaattctggctaacctcttttctaatgtgccattggatactaagtagaagtataataatatagaatcagcagattctatgaacaagatggggtatatgggtgattcatttttttggtaggcagtacatttactatagctagtgatctgcttgatatctttctgttactgtataaatcaaggactttattatatgaaacattcctagggaaaaattaggatcagcaaatgtataattcaggagagatttcttgggaatatattagccctggtttttggaggggaacaaatctgttaaactataaaagctataccactaacttcttcaggaaagtgcatacatacacaattttatatataattctgagtccagaggactcagatctccctgtaatttgtctgtaaataccacctagtctagagactatttccataaacattttggtcatttcctagcttttttttggataatagccatcctaatagatattaagtaatactagtacagatttttttgttgttgttttccagtgttccatcaggtagaatctcagctctcataattctttgatggtctaatggcatttttatctactactgtctagtacttgtgtatttatcttctcatctaaattttaatccttttgaggtcgagaatctggtttggtctagggctaggataacaagtgttcagtaggcatttgttgaatgcctgatttggcttttagctttggaagtgaatagtatgagcactgaaggtaaaacatttgccagtgattttaatgagaggttggttttcaagtatgaaatgtagttagaatagagatcaagaattagtgtactttagtcatgagaacactgctgaataaggtaaaggagagagtaaaaagggaaccttcaagtttaggctgggaaggtgaaaggaacctgtgaatgcatctctcattactccaagaaggaactgtgatattctacaatattgtgacatcttacaatgtaataggatattgtgatacatctagccagctatctggatgcctccagaatataccctcttaattgtttctatgctgcccatcaaaaataaataactaacatttttgagacttattctttgccaagtcccatgtgttaccttctttctttctttctatttttttagatggagccttactctgtcgcccagactggagtgcagtggggcggtctcggctcactgcaacctctgcctcccggtttcaggcctcccaagtagctgggactataggcatgtgccaccaagcctaatttttgtatttttagtaaagacgggctttcaccatgttgtccaggctggtcttgaacttctgacctaatgtgatccacccgcctcagcctcccaaagtgctgggattacaggcatgagccactgctcccggcctaccttatttctttacaaaaatctatttatggcaccattttagagaagaggaaacagacatagatagaataaataacttgtaggtggtggatctgaaattagagcctaggcagtttgattccagtacctattctctaaatcactgtggtattctgcttctccttgagtttttttaaattaaatatttaaataataaaatatttcatttagcacaatagtacatgcatatagtttaaatagtactgaaaggcttgtaacagtacagtggatctctgccccatctcacccaactttcccagtcttccttagaagtaactagttttgtctcttaactttcttctggcatttgcccatctctctgtttctattttagccgttttctgtggatgactgccggtcagtgccgccctctgttttccctccccagtgaaattattttgtaattcttggtcaaatattcagtgtttacattaaacaaatattatgcacaattgaggattgtcccatattttgtttgttagctttctttttgctgcagttattgctgccctttaaatttttagttagttttttctgtgataatttctaatttatctcacggtatgtaatagcttctccacacagttttctgtaatgtcagccacatcagatactttctcacttaacttatttttgcagtttttatatatcctcagctatgtagattgaacttcaagctcttctttttgccctctgcagagaaaacaagcttcagtcttctgttgaatgagggtagggttgttacctaccactggattaagagaggggatccaggtatctagctacttttcaaacagcagccacccaaatcctccctggcttaggatacagctttctagggtctctttaattgattattacgtatctatttacttttctgcttccaaaattgtatgctgttattccttttctctgtgtccttgtgggtttctgcttaaaattaacaaaagcaaacagcacatttttaaacttagtgttagttaagtttgaaagaggaagtaagattggataaatttattgtagacatgtatgaaaatgtaggttatcagaaataaaagaaataaaaagcccttatagtaatatcactagctagaatgactactattgtcattttggagtatttcatttcaatctttgtatgtgtacaagctgggcaggtagtaattggatgatgccatatacaggtttgagcatctctaatctgaaaatctgacatccaaagctttttgagcactgacatgatgctcagaggtgatgctcaaaggaatgttcattgtagcatttgggattttggactttgagattagggatgctcaaccagtaagaataatgaatgcaaatattccaaaatctgaaaaaatctgaaattaagaactcttatagtcccaaacatttctgataaggcatactcaacctatatattgcttatgggttatcttttttatgtttgttagcatgccaagacctgtaaatgctgttttcacacaaactgttgtgcattcattttctgttgtggtccattgacattttcagtctatttttactccagtaccacaccaaaataactatttgaacaaagaagacttatatgacaaacgatcctttaaaacaaaaaatactataactgcctttattccaagtgttaatattactctgtgcctagtgctgatttttaaattacttttactttattctgccttatttcatccagcctgcagatggcagaattgtttcatttgaacagcaattttgaaggctccgttttatttagtgtgttctgacattggaatgagaagtgattaaatgaacagtctctctccctattagagaagaagcaaattaatgttagagacagggagccacactaagaaagtactggataatttactttttcatttggtctatcttcatttcatgatttttgcatgcttggattataaatgaactagagcctataaatgaactagagcatgatgtttaagctgtaccatatgtaaactgctgaattcccttaattactttagtcagagtaatggagcttaaatctgcttcatattaaccataaagcagtttgttctgcatttgtattttaagagtttgcttgtattaaattttttttttaatctagagaccttttagcattcatgaatcaatcatcaatttaaagctttgatataattgagtttgctgaagtatgagcattttgttcttaggataaaagaaatactttagggaagaagaaactagaattagattagtgtaccatatttgaaattgaagtcagaattatgctgtagaaaaattggaagagcccatttgaggaaatacaggaattgcttagagggattactgtaaaattcagtgattggtaaattgctcatgtagcagaaatggcagggaaaacagcaataagctaagcaaaaaattttaatgtattgtgtcattctgttgatgtaaaaaaagagtaaaatagttatgagtcatgagactttacttttaaaatcagcaagtttaaatataaagtactggaccacatacattacaatagtcatttaaaaatttttaaaaatgttttgtaactgctgtggaagggtagacttcacaagccaattagatataatttgctagctttataagaaggagcagaacactgaagtgactacaaaacgttaaattttaactaaattttgagaactttgtgaatactaattgaaaaacttgtgtaatgagtgcagcaaactacttacctgtagttgtgggaaactaatactaggaaacgtaattggtgcatatcttaaggccttcttaatttgacaagagaatggtagaatgtacagcttactggaataaggagggagtctgcatataagttcaaatgcaaattaattaatattaggtaaaggataaaattccattccaaggagtctagaaaagtctacactatcttagtagagttgacagcagccataaagggcagatattaattatgtgcaggcctgtcacttcaagtttatcttacgattgtgtaattactttcccatcagaaaaatacgtctggaaaagataccatatagtgttctaatcaaaagagggtatgctagaatgaaatatgtacttttattaacacattaatgcttatgaaatgatttttctagcatgaaagcctgaggatagattagttagaataactacaaaatatattgcacatttaactctccgtaataagcgagtgtaatctatcaagagatagtattgaataatggagatgtccaaaatatctttctttggtttttgtcaccttcatttcagagtaaagataatgatctactacagaatttttgtattatcataattcagataagcaatttcaattcatttcatgaagggtgactaaggaacgattatgttctttttatttttaaaatatgaaaatttttgaggttcttgatgtggtaacttgaaagataataataaatgcagaggtttcataatatagtccttaatgtcaagagtaatggaaatgtgaaggtctcttaggtgagagattatagcaggagatagaatcataaaataaatgtgaattgtgtcgtgacaactggaaccaaagcatacaaatattggagagagactttaagagaattaagttagtatttgtcgtaaattggaatctggctatagaagcattgaggtccatttagttgcttctttgaaatggaactctttgatatataaatgtaatatgtatatatttatgaaatattctgttcataatgcctggcttgaactttttgatagaaagaacacattgggacttttttttttttaagcctttgttttcgaaaagaggctggcctcttaccgtggtgctatttaaaagataagagtttttttttgcccacccccctccttttttttttttttccccagaacaagtgagtttgttattctgagcttaacaaaataaatgctgaggctcaggctgacagtacattctttaagcaactgtttttgattttttcatcaagccatgtaaaaaagaaaaaggcagtagacacaccacatagtgtagaggattagaaagctcattctgttatctccaaatgcattcagtgtgttaagctttatgcacgttttaagaattcttgcaattaagtgtaggattgttatggtttggatttggagatgcatcactaatgttataagttttcctgtgtgtaagagagtatgtgtgtatgtgtgttttccaagtgcacttccctaattttagttcactcaagaatttagttctccagcattttatagacaaaacattatggttgtatttagtagtttgcattattttttacctatttaatattttaatcacaaggacttattttactaagtaaaaaatgcaaagattttgaaagctatcttctagttataatttagcatttcaactagaggtagcttgggaattcagtgaaactgtttcagctacagttattgagagtcatggtggactggagttggatggctttgttcttcagtgtcttccaaaataacggtgtttcgtaattaggagttaggaaactcattgtggctatttttcctcctgtttttcatatataatgcacttagagataacctgttctcttatgcatttgaaatattcattgtcagtagtaaaagtggtatttttgttttgtttttctcaggcagagtcttggtctgttgcccatgctggagtgcagtgatcttggctcactgcaaccatctcctcccagattcgagtgattctcatgcctcagccccccaaatagctgggattacaggcgtgtgccatcacgcctggctaatttttaaattttaatagagtggggtttcgccatgttggccaggctggtctcaaactcctggcctcaaatctgcccacctcggcaaaagtggtgttttaatacaagaattctgcatgttcaaggtggggaaaaggcttataaggatatttgattagacatatgaagaatgctcacatggatctgatatgtctggtttgctatatttggatttctgagtgaatataagctatcaataaccattaattaattgatgatccatatttgtaaggaacattgagatgtaaagttagcacagctttgagagtttagcatgaagattcgcatcctgtaatcagtctggattgtggttttctcattgatgaaatgggcgtgtttgacttggactttggtttgggctgtgtcatttttggggcattaggagtgataattctacttttccagccttcttagaatttggtgccagttgagagagagaaagggtaagacagatagagatcaaatgctgatagttacattggattggagaatgtgacttagatctgtggccttctaagactgggcttcttagtacaaccccactttagactttgaactttctgttttagagggagactgtgtgtgtacaaagcaaacacgcatatccgaattgctgcctcatacctggtgggccctgatggcaagaacacagagaggtggggcctgtggagctgcttttgaaaggcagcgccgtgtgtgtctagcacgtggatggaggagctgataggaaactgcaggttgtctatgatcaggaagttcttaaaataaggaagagagtgaggcaggtatgcatgcttgcattctttctccagaccttcagagtgaaggaaaagtggagaggtacagaaactttctcttaaatacttcaaagaggtggaagcgcctttatcacgaagccataggaaatctccatttgaaaatgcagtacaagttattcagcttcccaagagaaatatttattctcatttaacattagtgctcaatttccttgcttttaaccctaaaacatcaggggagacaaaagaagccctgttcttccacatttgaaatatgttagctatgctacagtgttttgcttgtttgggtctggaaagttgagtaatctgaagagagaatagggtctatggaaagctataggggatggacgtatttgttaccatggtattttattagtaaattgtaatctaaaagccatggtgctcttgaatgtaaccctggacggtggattgggaagtgcagccggacaaatacatagtgtttgctttttcgatacctaaggaaaatgtagttatgtttcattgggagatcattctggtttgaggtctacttctctggatccccagttgaattgtggtatgcaacaaaatgtgaggttaatttaaccatttaaattctgatcatccttgacaaggcaaacgtttcctttcatacttattagtaggaacctttgaatcttgaatactataatattagatgaaaataaaaacagccagtttcttaaagtctgatcttgattattctgttgtcgatcatcagaaccgtgtttttgttgttgttgctgttttgttgttgttgttttatttggctttttctttggtcattttacctgtaaatctattttgcagaaacaaaagggaaaggaggaggtgaaacctaaatcaatcctaaatcaatttttctcctttttttttgacttataagcacctggcttgagaagatgcatagaacactggggaattatgaaaacagagtttaaaatatcccaaaaaacacttttgtggttataaaaaattgaattttatgtttccatacaatttactggagacttagtttaccagttgggaatcttttagactttggaataccttctttttcaaattgaatttgacgttaatttacttgaacttatattgatgcctcatgaggtgcattatttgttgtggctcatctttcctttttttcaatttcaggtgatcccattaagatactaatgccatcactgtctcctacaatggaagaaggaaacattgtgaaatggctgaaaaaggaaggtgaggaggtaccttcctaatgtcctgtgtgctttgttatttggttattttgttttgtttttttttttcctaatctgtcctgttatacagtatgtgatataaattaaataaattgtgttcctttggtagttaatgtaagtttggttgaataaaattttcccatgataaagcagcaaaggttttctgggttcagcatatatccttacacaagcacagaatggtaaaaaatattttaaggctttttccccaacttttagtccttatgcctagcttttagtttcaacatcatagttttgacattctccttaatttataactttatcatgattgtgtgtgtgtgtgtgtgtgtgtgtgtgtgtgtgtgtgttctgggaggtaggcaagttcatcataaattttattgaaaagaacaaataagtagaatataaggaaaaccctcaaaagcagatcagcggaggagggttgtagccctgctaattattgaaatatagtattaagcatttctaattaaaactctgggattggtgcttaaaagacagaccagtgcagctgagtagagaataaagaaatagatgcagttgcacatggaatttaagtatataataaaggaagacaatattagatttattctttatgttatgtgaaggataaattacaaatgaattatacacttaatgtataaaaatgaaactatgcaagtcttgaattcctctgaacccggaagtggaataaacaccctaactataactcaaaatccagattataatatgggaaataaaatttgatggtaaaagtactaacttttatatggctaaaaatacaagttaagtaaaaaaagaagtgacaaattggacaagagtatttgcgatttctatcacaaagggttaatatccctaaaaaatcgataagactgtcaactcaacaagaaagtgggcgatacatgaacagatagtttacagaaaaataattgcaaatgactcttacacgtagaaaaagacgcctaacctttcaactggtaagaaatacgcagacactttactgaaatgtcatttcttactgattatattgacagtacttaaaaagttcgacaagctgttctcttgatgatgctgtggagggaagggaagaagcaggactctcagacattgctggaggaaatgctaaatggtgtaaatactagggaagagaatttggcactatatagaaaaattacatttatgtttaccctttggcccagcagctctacttcgagggatttgtctcagtgttacaccagcaaaaataagaatagacacaaacacacactaggctgtttatcacagcactgtttgaaatagcaaaaggtagaaacaatccaaatgttggttagtacaggatttgttgaataacttttactgtatctacacctgtaaaaaggaatgaggaatatctctttatactgctatggggtgatcttcattgaaaaaaagcaaggtacagacaagtgagtatagtatatatcatttatcaaagaaagaggtggcagtgctaatatttaagaaattagaaaggataaaataaaactttaaaaacaacaatagttggttatctacagagtaatggagggaaccgtgtgggggagaaactggaagctggacttctgaatatatcttgttttgtctctttgactttgggacaatatacatatcttgcacaattttaaaacaaaattaaagtgtaaaagagccctaaagattgaaacgagacaggtgattctaattcatttttttctctctctttttctctctctcaatttgcttacataaccatacagagaggcactatttcaaatgtcagatgtttgattatatggccctaatagattataactgaaggataaagcgtctccaaaagtataatcctcaactgttagagtaatcgtattatgcttgttatgttggtattgttattctaaggcttttgtgtgtattttatgggataaagcaaatgactggttaagataatatcattggaaacttggacttttagtgtagtttaaaggagaaacaggtaaaagtttctaaggttaggaacgaccctgtgatggtaaattttctagctctttcccctggcaatgcctggaaacaaggaccaatccagtcgcagtaagcacccctagaacccagactgtctctaaatatcagttcccactaaagtaaatgaaggctccttggagagtagctacttgcaggcctagggcaggagatgtgcagatgagcttttaatatcttgtcagttcagaaagcaaggaagctgtcagaaactcctgagggcatcttaaaggactcaggagccagagatgagatagtttgaggatcactaaggataataaggataatatatttaatatatttcaatacattaaatatatttgaatcctaagttcacagtaatactaaagaaaaaaaattaataataattggttagctttagagggtgctaagaaattaactcattttgaaaacgtaataaatggaaagactcaagcatttttctctacctcttctgctatatgaaccgtagctctgagtaaccaagtaattgatgagaagtttctcattattagcatatcacagttgttaaaagatagaagaatcatagaacatcactgtattgccattttgcaatctctggtaaaatagtatagccagtgatcattaatagctgctaacatcacaaaaagagagataaccagatattacatgtttcccactgtgaagtagtcttgccagaaaattgaaccaaatatgttcaagcctgtagctctatcattttccaggaaatacaggggaaaatataacgtgttcaatgacaccatgagaagtatatcagcaaaagctagactgaggaattctgtatgccagtttcttcaaccaataaatttcagggtggtagggaagagcccgggggaggaaggtgggggaacctatagcatacaagagatttgagaccagtgccaatgtatggacctaattttaattatgattcaagcaaacaaaacacatgcggacatttgaaaactggctggatatttaatgatattatggattttttttttttttttttttttttgagacatggtctcactctgttgcccagcctggagtataatggcgcgatctctgctcactacagcctcagcctcctgggctcagggtgattctcccacctaagcctcttgagtagctgggaccacaggcatgcgccaccatgcctggttagttttttgtatttttttagagacagggtctccctgtgttgcccacgctggttttgaactcctgggctcaagtgattctcctgcctcgacctcccaaagtgctaggattacaggcataagccaccgcacccagcataggaattattaattttaaaggtttaataatattttggttatattttgattattaaaaaaaaaaaatctcacctataagagatgtgagatgaaatacttacgaataaaatgacagtatctctgggattagcttcagaataaccctggttgaggttgagagggtagggaggggtataactgaaacaagatcggtcatgaatcacttggcagttgtataagtgaggtaaaaggtatatgtggcttcattgcctttccttaccacttttgtataattcaaaatttattttttatatataaatttttttaatatattttttaaaggttgtgcatagtgctttcaggatataatttgagatgagaaactagtaccagatgaattggaatgttgatattattaagagaatatttgatacaataccatctataaagctgtattatgtcactgtttctggcaaccattttgccagattttaagtacctaatatggtgcttagaaaataaagactatgaataaaagaggtgagtatgttacagtgcttatacagaaggatagaggaacagttaatgtgaaggaagctgggctttttgtttttctggcagctactttcttttccttttcttttcccctttttcctttgccatgtgtggcggtagagtctcccctccaggtattggccactggataacctcttttagcaccctatgtagctgtctttctctgtgcttgattcattctgtatcaggttaaactattgtggaggaaagaggatgagtctacagtacctattagggattgttagacagaaaaatagagaaattagaggtgactgaatgagtcccccacagccattattatgcgtcatctggagcaatggtgaatcaagtgttaaaaagggaaagaaagaagggaagtgcaagtagagaatgaataacatggtctggggaggacttgtctaattccagagactagccctggcaaggacttccagggtatcctaatgtgatttagtaggcacagatgtcactcatacaaatgttggtattgagtggtccagtctagtgcttgtaaaatagtatcaaaagagtttaggcagtgggcaggacaccagagtctggaagagctgtgttgtgattctagaaggtctagcctttcatagcatcacttttgccactaatgacagatgtggggatcaggaagagggctaacaagtatttacttgagaacactagccaaatgagctggggagtttgggacaagcaaggcctcacttctttgagggagtctggggtgtaaggaaaggcaagaaaaattgctgtgggttgagccactatggaggttaggaggtatggtgcagtgaggttatccaaatgaacattactggtccttgatagacccaaccaagtctgtttgggcatattacttaattctgttcctcagtggggaatatgtctgagtttgttcatgtttgtgcttcccataatgactaacatcgtaattggaatagaactgcagtgctgtaagtggtcagttagtaaaggtaatggcagaggggaaagtaagccaaaagcagggtacatgacagggatccaagaaggctttgcagatgaggtagtatttgaactggtccttgtagaataaatgggctttttaaaaataatgagaaggacattccagctagaaaaacatgggtaaactcttggaagaaagatgtcactgagacatacttttgcaacagcaggtaggtctggctgcattggggacataatggctgtaagatcagatagattattggaaggatcttgaatgccaatctgcagtttatcagtctgtgagggtccttatcctaaagccaaaatagatccacattcatggtttcttaataggaagtggtttcttttcttttcttttcttttcttttttttttttttttttttttgagacagagtctcactctgtcacccaggctgtagtgcagtggcccgatcttgctcactgcaacctccacctcccaggttcacgtgagtcttgtgcctcagcctcccaagtagctgggactacaggcgagcaccaccatgcccagctaatttttatgtttttagtagagacaaggtttcaccatgttggctggtctcgaatttctgacctcaagtgatctgcccaccttggcctcccaaagtgccgggattataggcgtgagccactgtgcctgggcaggaagtggtttctacatacttttctgagccctattagtagcattgcgttgaaaggaacagaccctaagagtaacctggtatgaggagataactgtaggcaatttaaagtagcctccttttcctgctctcatttgaaaagccaacactgagaactcctaatcaatgtgataatctaaacagatggggtaaagcatctgctctctatcggatataatattataagtaaatcttttcaatgttaagtggtgctggaatgcagagaaaggaaatcaccaagtgtccccacatctggagtggtgaatgggagttgaggccatgtgcaccactagggctgagctggaaggctggagttgctgacttttttttttttttttggtggcggggtgggtggaaggagcaaggaagggaaatcaagaatcagattaaaatttgaatatggtaagatttgaaatgcatatgaggcattcaagggaaggtgttcaatagataactgattataggagttgaagttcaggagtgaagtctgacttggagacagaaatttgagagtcatcagcatgtggatggaatttaatgccatgtgataacaggcaaaatgattttgaatctatatggaataagaatgcctactcccctaaagagtcctcctgagggtcaaatttatagaacttgcattttctgggaacccacagatagaagtgaagttgtcctgggctgatcgcctccctgggttacctggtagaagccattattctggaagaatacagcttctaatccaaaccatacagaatttgcagataaagtctcaccaaaagtcacaatcccacatttaataacgtatgtggaagaagtcttttaggagtgaagtcagtaggcataacaagcagcaggactggatcccaagaacttcagttaattggaattacaaaagtccaggcagatttgaaaaggataaacagaacttctagtaatgaaaaatatagtctctcaaattaaaaccccccaaacctcaagggtgggctgaagtgtgattagacaggactgaatgaagaatttgtgaacagaaggacgactagaggaagttaggttgcatgtagcacatagagacagcactggaaaatatgaaagagaagttgacatatgaagggtaaaatgaaaattattcaataacccaataggaatttcagaagaagaaaaaaagagggaaatgggaagaggtaattttcaaagaaaaacatggcagagaattttctagaatttaagaaagatatgtgtaatgtaaatgaaagagccagtaccccattggaaagcatttagagcaattggctctgcatggctgctgctatcttttaaaataattgtcagtatctaagaaagttttacctttataaataatgtaatcagttggaatgtgtttttaggtttcttttctctgatgaattacagagctttggctatttccatattcgatatgacagggtgttggtgtcattaaataatgattcagacacagaacagtcttttagggattattttaaaaagattaactttcttcacactttgagaatttataggtaagcagatgaggggattcttgggccacatttatctttcagacttccagctcactggcaatctaataagttattcacacccgttagaatatgagcagtaagataaagagccagcagacatatggtctcattattctgttcttttttccttttgattacaatatgctattttcatgtaggacaggccaggatgtattttaagtccctggagcatgtttccctgaaggttgctcttaaaattctgtgttctgccaactgaagggaaatttgtttttgccaaaacacagtaaataattgagagcaatcttaatccttggttcttagtggttcactggcttctttttgaagctcatcacctttgtgatttgtgatcttttgagtataattggctgcttttcattaacacttatttactgtatacatgggtgtcaatatatgtttaagtatgcctggttcttggtacatttatgataacttgctccattcattttatattaaaaacaaatttatattctgacagcatacttttcatatattttttctcttattaactgttttttgtttgtttgatttttgagatctttttaaatgtatggtcaccataaaacaatgagtttaaacctttatgcattaagaaaattgatatttttcatgaaaaatgatagtgttgcatcgaattatgaatctagtttacttctaagcgaagactagataagtatttgagaacattcaatggacagcagttcagtcttaaaaaccattaagttttttcaaagatctgagactgattcacagcttcttttactaatggtgtgtgtgtgtgtgtgtgtgtgtgtgtgtgtgtgcacttgcatgcgcgcagcgttttacaccaaggaggtaagggtgcaaagaaaaaactctggcccaggaatcatggtttttcctttggggttcctcctctgccatgaactacctgggagtgagttgaactagctgaaatctaaggtacggaatatcctggatttataattctatgataactcatttttattttctttttttaagtaactgaaatatgcagtattatagcatataaattatttccgtctttgttgaactcatgattctaagaaaataagttttataatgactattagagtacttcatttcagtctgaggattgactaaaaccttatatatcataaaattagtacagaaaatgctctgaaagtgctaggtaacacccacaatttcaaaatcttttgaaaggtcaattgagctatcatttggcatttttattacaagttttttatttggagggggcatgtgcttcagatattttcagtttaaactgcacctagtttattttttcatcaattgaactgtcaaatctgttaaaataacagaaaggaaaaaaaattcttgttctccttttgtaagagaatatttgaggttatgaaaaaccttgttttttttcctcagaatatttgagatttttctgctctgccgtgaagcactatggaacaaaaccaggctaagataattccatcaagcacttagccacacccacagtgcctagaatgtacgtagtaagcatgcttaacagtggtgcttgttgctgcggtattccttatgtcatgagacaagggatttttttgtatttcaaatagtttttgtctaatatactgttactgtataaaattcagaaataaaaccattttgaagaaagccttatcctatatcactagatgccactagagagttatatgggtctctggattctactatagaagacactttggttccgttatttctggcaatatgtatatgtttgtggtgctaaaatggaaaattttgaaaagtccatttcacaaatagcttcctttttttggtgtactatggttttcacagctttattgaggtataatttacataccataacatttacctattttaagtattcaatgatttttaataaatatatggagttgtgcagccatcaccacaatccagttttagaacacatttctgtcaccccaaaaaagatccctgctgcctgattgcagtcatttttttcctcccatctctatccctagacaatccggatctgttttttgtctctaaagttttgccttttgtctatgtttcatataaatagaagcatgtaatgtttggtcttttgtgactagattttttcagatttagcatgattaaggttcatccatgttgtagcatttatcagctgttcattccttttgttactaaattatattccatcattatgcgtttttacatttattgctaaatctttgtattatatcagaatttttaaattagtgaatggaattatagattatagttttattcaatagaagtttctgtggtgatggaaatgttctgtgttaaactgtcgaatacagtagctactagactttaagaagccagagggatgtgtgggtggttgaccttgtctaactgggcccttctcaaactctcctactcatgccttcaccccatagggcaggacctcaactggcctagcaaccaggttgcctcaggtctttggccatgcaaatattatccttctttgtgtgtgtgtgaagtgaaaagggatgacaaacactgactaggggtccctcctctacattcccattctgctgtaggtactaattggatgggattgtcattgcctgcttgttgtactgttcttcaatcagattaggaacttcttgaagcagttctgtcttattttattactatttttatcatagtgtcgcacacagtgtcattcacatgggcagctagtaaatacttgtagagtcaacaattgaattatttttgtttctgattattgttatcattatggttcaacatagcactaagaagaggaatttttctttaatgttcatgttaatctgataacttggtcttacagataaaaactagctctcttccaccaccaccaccacacacatcttttacgtaaagacttttattcttaatttttggcagaacaaaattattttgtgaaagcctcaggacttattctattaataaaataaacatcaccattaactgtgtttgaccaaggctatgcttaatatctagaatttaaaaagagaaagggaagcctccgtatacttcagtcctcagctctggcagctgcccatcggacaaaggaacaggacgatgatgctggcgtcggtgctggggagcggcccccgggtgggcctctgctctggcccctcctggggcccgcactctcgctctgggcccgctcctcttccgccactgccatggaccacgagaagatggtgcaggaacactccagggctgccatctctttcttcaatcagtcagctatgaacctgacagctgagaagccatctgtcatctcacgctgtccaggaccctctatcctagctgctgagtcttttccactcttctccactttaaactctttgtggacagaaccttctctttttgttgttttcatacccagtgcttagtacagtgccttatacattaatgtttgttggatgatctggtagaaatgacagaatatggaataaatgtgtcctgattctggtagaaatgacagaatatggaaaaaaaccgtatcttgattcaggtagacatgacagaatatggaataaatgtgtcttgattcaaaatggttgtatagctaacattttatttttacctagagatgttgtaaagtgttacataaagatgtatgtgaagcattaacacttccagccccatgacttaaaaaatatatatctatacatttaaaattttcctgagagtcagagagattaagtaacttggtcaagatcactagtaactgtcagagcttggaatcaaactcatatttgaattaggagaggttccttgtaactactctgccaaggagtctttctaagttatagcactaaatttttgatcacagctgaaactcagtagatttgaaatattcatggctcattatttgctctcagagttttcttttggcatttacatgatgtttgattattgaaagatagaactttggttttgtgatgagttaggggtaatgcttccatacgtaatattactatgtttttaaaacttccctgtgatttattggtaaagtgttctgtgtttcttttccctacctccctctcttttgtcctctccttttttccttctctctcctcctgcttttctcttctaccctctcccttggcattctcatctagctaacatatatgtctgtgttatgtgaatagatatagttttttaaaaaagaaaaaaaggctatctttttaaatatcagaagcatgctacaaatcaaatgttagaagcaaaagaaatgtaaaagataatttgatgtataccttatgaggaaataaggattcgtgaagttatcatgtttttttctaaagcattttaatctaaaattcattgggtatggtgcattggccatgaaacctgaggaatggggatgggaatataaaacatttaagtgtcctgtccgtattgtgaagaagctcatagtctagtaaatagaggaaatcacaatttaaaaaagtaattagcagtaatataacattttatatgcaatttgtgatttttaaataaattagacctactataggaatctggaatatgaacaaaattatgtaggtcaagttactcagagaaagttatatagctgaagtcgaatctgtagttcttaaagtgtggttggaatttgaatactgatgaacacaaatgatgatatagcatcattttgtttttctgtggctagagtctgttttctaggcatctaagaggtatttaattgctgggtttactagttctatagtttttcccgtgattatagcagaaatctttgagggtgtgctttttttcccttttgaagtgcaatctgttttaaccactaaaacatttaaagaagtatgtaagatgatataatctgacactgtagctttctctatgacatacaaaggtcatttttggtctcttcctgcatatcttaccagcctaatctctcgtcacttctctcgcatactatttgccagtttctctgaagtttcctgttctctctgcctccagggctataagtgtattaccttctacctggatcactgcctgtttacagattgtctcctcctcacctcttcaggctcagaataggtggtcattgtattctaggaagccttttctcaccttacaaaaactgaattagatgcccctcctgaacattcccaaagcatcctgacctcaccttatcctgctgtattttccagtttacttgtcaatggatattaagcaagcttcttgaggtcaggaatcttaaatctttgctgttattactgtccattgctgtatcctcagtgcctacatatgtatatatattttatatgtaatatataaatatataatacaaatatgtgtgtgtgtgtgtatatatatataaaatatatttatataattattattattttttagacagagtttttgctcttgttgcccaggctggagtgaaatggcatgatcttgactcactgcaacccccttctcccaggttcaagtgattcttctgcctcaacctcccgagtagctgggaccacaggtgcctgccacctctcctggctaatttttgtatttttagtagggacggggtttcacaatgttggccaggctggtcttgaacccctggcctcaggtgatccacccacctcggcctcccaaagtgatgggattacaggtgtgagcctacacgcctggccaccccaatacatttttaataaatgtttgttgactagggacatctctttggagttagacaaaggaccttttaggtggtaaataaatatcatctaacatatcaatttatttttaaaaataacttatattagtgtctctgaactatttaacctgaagatataactatcaatttgatcatcttggtacacaatgaagtactttctgtactgtgaacgttcagagcatatttgttaatttagtgttttagattttctttcatattctcttatgatgcttgcctgttaatattgctattccagctatttttggtgtgtgaggaggtgtatttatatgttacatattttttatccccttgttttttattctgtttttgtgttagggctatctcttgtaagctacatttacctagattttattttcatatccattttgataatctctacttttaatgggtgattttaatccatttatatttattgtgattacggatacatggggacttatttctaccattttttgtgcatttttgtttttatcctttgccttttctttccatgtgcctgccctcagttagataatcaacttcttatttttcctctgtttttctaatgctgtagattatatttctgtttttaaattttaaattaaattttgccaataaagtttagtattattcagtatttttctcctattataagttgatgcaaaagtaattggggtttttgaaagtaaggtggtaaaaataaaattacttttgcaccagctgaatatatcaaagttgttagcatgccttaccatctaaacatttccttacctatcttattattttttagagtttgagttttacactttttaaaccctcaaacattactttaaaaatactagtagttaacattttagtaattttcacaataacttgtttcttatagcccatgggttccatctgcttccacttttcttcttgatgaactgcatcttgtaagagctttttaaagagatctttaataggtggtaaaatttcctagcctttatatatctaaagaatacttctctttcattctcaaatgatggtttggcagcatacaaaattctagacagttatttttcctcagttttttgaagatattacttcattgttttctgacctctgttgcagctgctgagaagtgtactctcagtctttccattgaggtaatctgttttttttcccctttgatagatttttaaaagattatgtttttatcgttgatagaatgcggtttctttacattgtatctaatatggattcatgtttatatagtctaatactcttttttctgtttaagtttttatcaaggtataacttgcataaactttaggctcaattaaattttgtatacatgtatacccatgttaccaccacctagatcaagatttagaacattcttagcaagctacacagatccgtatgccccctgctagtcagtacacctatcctaaattcattcaaaactctttgatgatgagagtatacatctccagttctgggaaattctcagccactaattcttcaggtattgcttctccaccagtgcctccagtgtcttccctcagaactccattagcaaacattgcagcctcagtctttgtcacttaactgctcttttctgttttttcgttttgttttgttttttgtttttaatgtttgtatctttttgtctgcctgtatgaaattctgcgtagttcattagtgctacctttcaatttactaattcataccttcactattccctgtctagaatatattctgttgtttctttttatttcaattacttaatttttcatttttaagatttctaattcgtttttttatttctacctgataccatttttttttaatttcttgttcttgtgatggctcttttactttcatttatgtttttggatgtcctcaagtacttattttacaatctttgacagattgcactaaataaattgcttctgaaaagaatttttgttacaattactgattttgtggcttgctttcttagcttttgatttcttcgtgtgtctcagaactttcttgtgcaatttacttttaagtggaaagtttatgttttaatgtcttccctcctacgcagtcccccctcgatccttgccaccatccaaggaattttgcaattgatattggggatattggcagatacagccccggagccagagggtggcttgactttgttcctggtactgaggcagtattctggtccccaccttcctagacccatggttgctgattaaaatcatagtctcagtcaacaggttttgattgtgcattttatcagcctcacattatgagtagaagaaccctgacttagccctagctccaaatagtgaatctgatttgagtcccctatatccaacagactacttttagttccctttaatccccaaaggaaactgttgtacctcttttcccctgtttgctccaaacctgctcctaaatccagaagctagtaagcctggaacttcaggtcttcctccatatttttgagtttccagatattttctgttgcagagaaatgatctgtatttgacttcagttgtgtctttgattttctctttttatgctttatatgctttattcatttatactgtgtgctgccaacaggttttttgaacttgccctaagatgtgaacccagaagtactgttaattgtaaaacttttcttcagggaatatagtcaaaatgtttgaaaaagtaagggggatatggagtctggaattgatttgttcagaggtggatacacatttgttgctgatgtctttaaggttgatttcatttttacatgctcagtaatctttgtaatagcttttttattatcacaagtataatttatgtccattatagagcttttggaaattacagcaaagcatacacatacacacacacacacaaacacccacacataatgagaattacttgtatttccacaacccagaaatagctacggaatattttggtatttatttatgttttattcatacgtacatatatacatagtaatatttatattttaaaaaacaaaacaaacccagtcttgttttgtaggtgaagcggtgagtgctggagatgcattatgtgaaattgagactgacaaagctgtggttaccttagatgcaagtgatgatggaatcttggccaaaatcgtggtaagtttttattttaattttcttcaacaggatgaagatttcttgagtggaaagttcattgtagtaaaattaccttttatttttgcctccttatttttaatgtgtattgtctactacataatacatttttagttcaagtgtttaaaatgttttagagttaaggtctaatagcctatttttctgtattttctaaattttctgtaatgtgcgttatttttataatggaatattagagcttatgtgaaaagtaagtgaaataaaatgcgtagagctacatatggtagaaacatgactatttagcattgtgtggtatattccctgattgagccaaccagcgtgtttgtttcttaacttccagaacctttactaggtagtatggtggagcatctaagactgtggactctggaatcaccccgctgactgattcatgttatatctaaaaagttctgccagttattagttacgtaatgataagcaaattcttcatcccctgtgcctttttcttcatgttaaagtagagatgataataatacctacttcataggacagtagggaagattgagagagtacatatatgctcatctcaagacctgttacccaattgctcaataaatgttacttttcccattattagaactgtttcctcagctcttggtgaccattagtccccaagtcagtctgtatgtttgcctaataatttgtattggttggttgcaactggataataagtatccatttgtgcctctggagttcaatttgtacagatgagctgcatgtctattagcagtcccttgtggatgtgtttttatttctgagccaccagcttacctctgctttgagcatagatgtaacaccttcctttgtatattctattcaaagactacacttcagaatgctatactctaactaggtgcaaatctagagacaattttttatttgtttttctttctagaaaatcctcttttccttttttttttttttttagccacttatgttgtatttttaacttcgaatatgtcaaactcctttacttgtcatctctcatattagatactagatataacattccaggttgaaacatgttgataatacagttaacttccttgtaggaatatgaatcaaagcctaaaatttctgtacatttgtaactaggaaaatataaatattcataccaaaaatagttttcttgactaatttatgcagcatattgaaacagattgcttgaattaccatgtaataaacccagctacattttattatgtgtgcttttggcaaactgtgttcttggccccaattctggattgtttggctgtggaaatcttccagaattgatagcatttttccacttagctgcttagtaatacatttcaaattgctaaccatgtcagtgggtcagcagtgccaattcatctggcccctatgctctgaaaaaggttgggagtgggagtgcatatagttgatagtggctttggtggcacagctattttcttgccaaagaaaagactgtatattttaggcctttgtggctttattattattccacatgctttttggataatatttgggagtctcttcacaacaagatgttgcaattttatcagggacaaactagtaaatctttttttcttctgttttttgtttttgtttttgtttttgtttgagatggagttttgctcttgttgcccaggctggacacgatcttggctcatcacaacctccgcctcctgggttgaaatgattttcctgcctcagcctcccaagtagctgagattacaggcatgtgccaccacactcagctaattttgtatttttagtagagacgggtttctccaatttggtcaggctggttttgaactcctgactcaagtaatctgcccaccttggcctcccaaagtgctaggattataggcgtgaaccaccatgccctgtcaaaactagtaaattttgatacaaaaatacttcagttattatacatttaaagatcagttcatcagcttattcttaaagttagtatttagcaaattgaacagcagctgttttaaatgataaattaataaagtagaatcttaggatgacatatttggagggtttattagaggttctctaatttggcttccagtgtatttggggttgctatataatttggcacaccaattaggatatttgtgaggatgaaaagggtataagatgtcaaaattatttacatttatgtaatgtttgcaatgtatttattgactagcaatatatttattgatagatttttattgatagaccattattcaaaacaattttcaaaagtagaattttttctaaaaaatagcatccatggatattaaaacaaattttttttaaaaaaatggttttttaattgatcatctgaatactaaaaatagcagaataattattctcggtactattcaccttcttcagttggtttcttcactttatctcactcaaatactgtcattggtatttttctaaagaatacatttttaaatattactgtattcgttagataccccttccccacccttattttttcattaagttgcccacaatcccattcaaagttgccttttaatggtttgaaagtttatggttgaaatttgaagttgtagaggcttcaaatgattcttctgtctagaccgtgatatttttaattgagaaaatagcctctcagagctcagagcagttctattaaatggaagatattctcaactctaattttttctttttttaatgtttgtttatttatttatttattttattattattattattattatactttaagttttatggtacatgtgcacaatgtgcaggttagttacatatgtatacatgtgccatgctggtgtgctgcacccattaactcgtcatttagcattaggtatatctcctaatgctatccctcccccttccccccaccccacaacagtccccagagtgtgatgttccctttcctgtgtccatgtgttctcattgttcaattcccatctacgagtgagaacattcggtgtttggttttttgtccttgtgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcagtaaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccagcagtgtaaaagtgttcctatttctccacatcctctccagcaccttttgtttcctgactttttttttttttttttttttttttgagacgcagtcttgctctttggcccaggtgggagtgcagtggcgcaatctcggctcactgcaagctccgcctcccgggttcacgccattctcctgcctcagcctcccgagtagctgggactacaggcgcccgccatcacgcccggctaatttttctgtatttttttagtagagacggggtttcaccgtgttagccaggatggtctcgatctcctgacctcatgatccacccgcctcggcctcccaaagtgctgggattacaagcgtgagccaccgcgcccggcctgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcataccctttgcccactttttgatggggttgtttgtttttttcttgtaaatttgtttgagttcattgtagattctggatattagccctttgtcagatgagtacgttgcggaaattttctcccattttataggttgcctgttcactctgatggtagtttcttttgctgtgcagaagctctttggtttaattagatcccatttgtcaatttttggcttttgttgccattgcttttggtgttttagacatgaagtccttgcccatgcctgtgtcctgaatggtaatgcctaggttttcttctagggtttttatggttttaggtctaacgtttaagtctttaatccaccttgaattaatttttgtatacagtgtaaggaagggatccagtttcagctttctacatatggctagccagttttcctagcaccatttattaaatagggaatcctttccctattgcttgtttttctcaggtttgtcaaagatcaaatagttgtagatatgcggcgttatttctgagggtcaaactaccatcagagaatactacaaacacctctacacaaataaactagaaaatctagaagaaatggataaattcctcgacacatacactctcccaaggctaaaccaggaagaagttgaatctgaatagaccaataacagtatctgaaattgtagcaataatcaatagcttaccaaccaaaaagagtccaggaccagatggattcacagccaaattctaccagaggtacaaggaggaactggtaccattccttctgaaactattccaatcaatagaaaaagagggaatcctccctaactcattttatgaggccagcatcatcctgataccaaagccgggcagagacacaacaaaaaaagagaattttagaccagtatccttggtgaacattgatgcaaaaatcctcaataaaatactggcaaaccgaatccagcagcacatcaaaaagcttatccaccatgaccaagtgggcttcatccctgggatgcaaggctggttcaagatacgcaaatcaataaatgtaatccaacatatacacagaaccaaagacaaaaaccacatgattatctcaatagatgccgaaaaggcctttgacaaaattcaacaacccttcatgctaaaaactctcaataaattaggtattgatgggatgtatctcaaaataataagagctatctatgacaaacccacagccaatatcatactgaatgggcaaaaactggaagcattccctttgaaaacgggcacaagacagggatgccctctctcaccactcctattcaacatagtgttggaagttctggccagggcaattaggcaggagaagtaaataaagggtattcaattaggaaaagaggaagtcaaattgtccctgtttgcagccgacatgattgtatatctagaaaaccccattgtctcagcccaaaatctccttaagctaataagcaacttcagcaaagtctcaggatacaaaatcaatgtacaaaaatcacaggcattctaatacaccaataacagacaaacagagagccaaatcatgagtgaactcccattcacaattgcttcaaagagaataaaatacttaggaatccaacttacgagggacgtgaaggacctcttcaagtagaactacaaaccactgctcaatgaaataaaagaggatacaaacaaatggaaaaatattccatgctcgtgggtaggaagaatcaatattgtgaaaatggccatactgcccaaggtaatttatagattcaatgccatccccatcaagctaccaatgcctttcttcacagaattggaaaaaactactttaaagttcatatggaaccaaaaaagagcctgcatcgccaagtcaatcctaagccaaaagaacaaagctggaggcatcatgctacgtgacttcaaagtatactacaaggctacagtaaccaaaacagcatgctactgctatcaactctaattttttcatattgaaatagttatgacagattgtgaggaaagatagtttatattccccatgaatcaaaagctaaattgttacatccactttataccttttaaacttgtttttttaaaatacagacaccatcttgaggtgctgcatgataattttgatcagttggatataatttacagatttgataaattattgatttggtagcgattatattggataccatctctgatgttagactacatttaaatcctgcctctgctacatacttgtcttgtgatcttgagcaagttacataacctcttcgtgccttaattttctcatctataaatgggaataatgatagtatttacctcagaaggttgttaggattaaatgagttaatgctgtgctggaacagtgcttggcacttgaaagccagacaactgttattcaagggcttaatgaatgtttcttcttcccctctgtattttagcttatcattggtttgttctcattttcagtatttcttatgtacttccttataaaccaaagttcattgttcatataagataaacagtatacattgaagaatcaaaacagttcaaaattgtataatgattcacaccatgatggaaaatcatagtgatgaaccagataagtcagtcacgtgactcaggtcatctccactcactgctgcacatgctctgtcagtagtcactaggtagctttcaaactgctctattttaaagaataaaagtacttaaataattacttaatatattgattttaatatcagaattaaaacagacaatatttacttgtgcctttaatggaatgagccctctcaatttctctgttggacatactgctgtaaatgttttgcatctcatatccctgtgtacacagatgagattaggtgagctgtttgtagcacatttgcaggtgattgattggttaagatgtgagaatgtctctggtacagaagcctcacactagtgacctgggcttgagggatagaattcagcctctgtctgagaattatgaagaaatagtttgtcacagaccttactacccattatcgtatatgttgatgtttgccctttagtgctgccagccacatgctaagcctttaagcatgaatttctaacccataccaaggggtcagtcccctgtagtctaatcttgatccatgttgaatgtattgttttaaaaaatccataatttgaaggaaaacaccacagcaataacaacagcaataataatgcctttaacaatgaaaatgaaaacaagttactagctatcagacactattctaagggccttacatataactcatttattcctcataacaacaatgtgaagtagctactgttatttgcatcttacagctcagaaaacaagcatggtgagataaggaaactttactaaggtcacataactagtaagtggtggagccagcgttgaaactcaggaagtctgtacacaactgggagggaaggctaatatttgaaatgatagactcaacattcaatatttcagtatcgatgagctctaagttgatagagctatgtgtaaaaaccctgcatttaatattaagaaatcattggcagaagagtaagagagggctttggtcaagtaagctgagtgcataagaaaactctggcatttgaggtgtccttagctccagatgctttggtagggcagagtgtatccatggaggtaccatgagctaccatggaggtagctcagagaggaaagggaacagtaacagaggcctgcttggtttttaaacagttttgcaaagagtattatttacgtatttatactaagtctacaccagttttgagtatttgcctactacagtgtaagcaaatgcttacaggaaattagcacacctctgaaagatctctgcaccaaaggaatagaaaaggttgaagaaattatcttaaattcatatagagattttaatgactttaaatggaattataatcaactgtattttatcttctgttatatattcaagttgtatggttgtatatcacttgtccttgtccattgtatttgggtttcatgcttcatggtgtcacttttttaaatagaaaaaaatgtgaatagttaaaaataaattttatttgatatttagataatggtaaaaattgaaatgatgataaatgctgtttattgcctacttgtgaaggtgtcaatgttacgttggtagagtatatatggaatcatttatatgatttacagtaaatgaaacagaaggtgaggtaccactttcagatgtagtacagttgtctgactcagattttagaaatctattgatatttttaaagcaaaacttaaatgctttacatttgaatgatgttctttgtacttggatattgatcctatttctgattcagttttgaaaggaattaacatcaagtggacttcatgtcacttaacagtgcttttttgtatacatttttaaagaaaattagtcattttactttgatttttgagttagcaattcacaagcaggtaattaaacacttttagaagaaaaatattggtctaataataatcttaactcatctttttgacatagtaaagaaaaaggaactctgcagaagcaaaattttttagtatgtggcaaacaactaagcaactagatttttcttggctttcttagtattcttccatagcttgtaattcattaaacattcctattcagctttctatactaatttcatatatatatatatgtattttgcttcatgaaagcattgctgcttttcttcttcatcagtaattagtaaacttagcttcctaaccccttataacttatgccttattaacgatagtgaacataccagtaagcattgaaattagtgttactctgatatgtcaaactcattctagaagttatgcttttccttaccattactgtattagtggacgtcctgcagcctatcattctattgttcattaaatacagctaatgaaccttatttagagtaattgaaagggaataatagaagattttaagggaatgacattttcttccaggagtgaacttataaaatattgttatttgaaggttttctagggacttctttttagtaagtaaattagaattagccctttctttataaattaatgctgctgaaatgcttaaaatatacttaacttttaaaaacattatctttgattttatttaagtgtttaattggcattatctgtggaagaaatgctttattaactgagacaccactgtgtttctgatatacttataaaaaaactcatgaggttttattttatttttcaggttttgtaaatagatatacagggaaataattaaatataaagaagtagactatatttaacattaactggaatagttaaccagttctatctatacattagaatgttcatcttttcagactaagtttactgaaaagattcttgcattaggtaaattttagtagattggactaagttgagggagttaatcccttctgagcttttagaattctaaagccattgcatagaaactctctgggaaagacaaatggttaagatatgtagccacaggctcctgtttggatttgtattgacatcaaaaagaagatgataatgatggatcttacatgtttatttgaaggctctcagaaagaggatacattctagatttatcctttatttcagaaggtagcattagcaagtgggaagaggagaatggtgaaggaaggcataagtgggagaaagtggagaaggtgacaggtggaaggcagaggcaaactgtcttggaagcagcttttagctcaaattaagatatcttaaggggagaattacccaacaaaagaacaaactacttaatgcagtcatggggttttacttctctacagttacttcttttttaaatataggttgaagaaggaagtaaaaatatacggctaggttcactaattggtttgatagtagaagaaggagaagattggaaacatgttgaaattcccaaagacgtaggtcctccaccaccagtttcaaaaccttcagagcctcgcccctcaccagaaccacagatttccatccctgtcaagaaggaacacatacccgggacactacggtgagtatatatttattcaaaggatgatgtaaaaaaaaaaagttatggcagttcttatggaattgtaatcattatcatattcgcacatcgttgtacatcacgtaggaagttgctgttctcagcacactcagaccttagagtgtgtgtttttttttttaaccatcattgttcattcagtaaataaatagttactgaatatctgctatgttccaggtactctaaaagccctgcttgcacaatggaaaaccaaacagtatgtgtccatgttgaggttgaattaggttttagaagtctaaaatggtattcaatataccaaacttgatactctgttcccatttatggagttctaattactgttacaggaattccaagctcaaatgtctatctgatataaaatagaattcatgttttaacatgcattcgttttcaaactagtctgcattatgactttccggcacagactagagctcaattttgtctgttctgtaacaaaacagataacttaatacacatcatttcactttagttttacattgctttaatagaagaactctgtaaattctaacatttcatttatttagtattctatataattatacaacattactttttctttacgagaaaaagatcttcataaagtagacctcttcattcttaaacattttttcctttagtttatcattgtcagaaaagaatccacagtgctttttttaggggggggcgtgcggaggtgggtgacggagttttgatctcattgcccaggctggagtgcaatggtgcaatctcagcttaccgcaacctcggtcttctgggttcaagcgattctcctgcctcagcctcctgagtagctggaattacaggcatgtgccaccatgcctggctaatttttttgtatttttggtagagatggagtttctccatgttggccaggctggtctcgaactcctgacttcatgatccgcctgcctcggcttcccaaagtgctgggattacaggcgtgagccactgcgcctggcctgctttttgaagtactgattttaaattcctagtgcaaagtgtttctgactctgttgccttgactcccatttactgtctcctctttcatttaccctaaaaattggaagacagtctcactgatgctttctaactaatggtcttctgcccttgcaaagataataatagtatgtaccctaattaagatcagtcatcatcagagactcgcatgaatcaggccccactgtgtaggttaaaaacctactgacctgtgaactctgcatactgttgggcacacagtgaatgaaaaaaaaatttttttttggttggttggttactaatcctatataaaaatctaaaatttcagattctcttgaaaaatctaaagatttagtaacattgggcccatatcagagttatttaatacttccctgaaatgcggcaagttccacagttgtttctgtctcttagctttaatttctagatccagcctgttttaatctgtactaatcaggcttattttctttatctgaccatgtagtaatttgtttactactttgcatacaagagatataccattagtcatgtaatctgaggtatcctatatatataataaatatatataattgtgtatacatacaattcaacctcagcaaaacaacccaattaaaaaacaggtgaagaactttaatagcatttctcccaagaagatacatagatggccagcaggcacatgaaaaatatgttcaccgtcactaaccattagggaaatgaaaatcaaaaccacaatgagacaccccttcatacccttcaggatggctagtatcaaaacaaacaaacaaacaaaaaccaaaccagacccagattataacaagtgttggcaaggacatggataatttggaacccttgttgttgcctagtggaagtgtaaaatgctgcagctactgtggaaaacagtatggcagtttcttagaaaattaaaattaccatatcatctagtaggtccacttccagatatatatgcaaaataactgaaagcaaagactggaaagagatatttgtacatctatgttcatagcaacattattcacagtagcaaaatggtagaaacaactcataagtccaaaatgctatgaaatgtgattcagctttttaggaaggaaattctgataaatgctgcatggataaaccttgagaatattatgctcagtaaaataagccagtcacaaaacaaataactgtatgattctacttatgtgagttacctagagtagtcaaattgacagagacaaagagaatggttaccaggggttgggaggaaggaggaatggagagttactgtttaatagatacagagtttcaatttggaaagatgaacatttctggagatagatggtggtgatggttgcacaatagtgtgattgtactaaatgccactcagttgtacacctaaaaatgcttaaaatgataaattttaggtatcatttgccacaatacaaaatatatgaagaaatgatagaacaaaatatacgaaggaaacaattggtagttgtgatgagcacccatgtgaaagtaattagttgaaatagcagctctttcccctaattaatatttattcttattaaaatcatatttagaaatagtaactaaatttttacgaaagtgtttaaagaataaaataaaccaaattggtacagattatttgactgtgaccatctgtgggagtcattttagctttattataagatttttttttaattatttgcgaaactgttgacatttagatctatttgaatcaaatgtaagtgttaattggttctattaaccttcatatttttttcttaggttccgtttaagtccagctgcccgcaatattctggaaaaacactcactggatgctagccagggcacagccactggccctcgggggatattcactaaagagtatgtgtttgctttttgtaataaccagttccattatttattatgatcatgtttttttgaaagaaaataaaaagagcttattcagtcttaagatttaaaaggaggtacactgttcttcttttgtacttttaattgcttttatcattgtaaattgtattctatgcaagagttgttttctgaataattatagcattactgaagaacagctctaatttggtaactaagcaagatccttagaagtggtaataaatgcagaaaattagagcgtagaacagtgaaactttatacagtattaaatatgtgaaatcatgcaataacatttacatttctaaaacaaggaaatatatttttaaaaaattattttcattatccctttgaattttattcacttgtgctgttataaagcaatttccatatacagtttggtctctttttagattttcttttctatttcactgatccatctgtccatgagttagtaccatacttttttagtaccacacttttaattagaaatgttttattgtatgctttaaaatctgataacaatagctttgctctttttttaaatcagttttcttagttcattcttattttattattcttccaaatgaattttaagcagttcgtctagctccatgggtaggagtgaggggtatttttatgggattgtatcacattttaaattaactttgtgagaactgacatctttatcatgatgggtctttctgttctgcaacactggtttaaatgtttgtgtctttccattagtttaaatgtttgtgtctttcaaaacagatggcccctgttctgttgaaacttagtctagtagggtagacaaagattaatcaaataggcttatgaactaatgtaagatttcagtagtgttatgtgctacatttttattggcagtaatagtaaatgtttcaaattgagtttatgttttaaagcaatgtactcattccatatttatctaatattgataggaaataaaaaataatattggccagaatttttgtaagtcgagagagagcaatggttgttaaattataagtggcagtgttgggccaggcaatgttttcttttttccactgggttattttactcttcatgaaagctttggcttactgttgggtgtttattttattgaaagcagtatatagatttaattcttagatatcctcatttatgtgtattacactcttactaatttgttaactgaatgtatgtggttctatcacacacatactgtgaagttcgtgccacactgcatgagttggaaatcagctgtcctgagagctgactgaaaggcaacatcccagaccatgggatttttagttaaaggatttaaaagttacacttagctgtaaaaaattaaaattaagaaccttggttgccagttaatcccagttttttccccacaccaatcctgatttgtgtctactgttggtatcttaatcttgttagtctctaccagtctgtgccttagtagcactctctgtaaaaatgggagaaagcaactatttttataacaaagtagatttgccttgctcataattctgaggattaggaataagagtctgtatttaattcattaatctttgaggatttggtgaaatgtaaaataatgattgctgcaccttagggggatcagttctgcaaatttgtgtaagataaactggagcagaaaaagatgagataaggagataaattaataggctcctaaagtaatccatgtaagaggtaatgaatacttgaatgtggttagaagaactaaaagggagatccctgatacagacaacattgtaaggataaagtccagaagcctttgcagattaaatgtggagtgtaggccagagtagcaacaagtaagggaatgaatttggatctggtctaggtgatgatagtttggtctccataaatagaaataatggatttgggaagcatttgttttggtggagttagtaatgtttgaagcttattgtcaggacttagaagccatgtaggtattgggatcaatgagatgaagatgtatctcaggagatagttggggattagagaggtagatttggtagataataaagcaatagttataattgagatcatcaatagggaaactagaggttaaaatccttgagttggaggatacctgggaaatgtgggaaaagtcaaggatggtaggatctaagaaaagcctcttaaatttggtaatatggtgttcagtagtgtgacagcagtaaaataaagaaataaaggtttcttccttccttttctttccatgtgtgcttaatacatatatgatgcgcaaatatctttttttaaacctgagttgaaagttataatattaatgaaacatttcttaagaacaaaatggtattatctcctgaataccataaggaagcagtattaaagagttaggcttttagtattattgccatcttttctaccctgttacccttttctcttccctgcctttattccttaactctccacgagaaaggcatcagcctttggtcttcaaaataagaactagtacaaaagatttcatgagaaaaatggatcctgaaagcatatattattgaggatttttgcttttctatactgctaaaaatgcctgcattttaagtttatcattaaggtgagctttggaaaaaattttagcctaatgtcgtcttctgctatggttgaaaaattgcaggctttggcatagctgtccccaaaatatcttagcacacttttttattttttaacgttttgaatttttttttctttaagagagagacaggctctcactctgtcacccaggttggggtgctgtggtgtattcatagctcactgcagctttgaactcctaggctgaagtggtcctatcacctcaacctcccaaatagttgggactacaggtgtgccaccatgcctggctaaatttttaaaacagttttgtagagacggtttctcactaggttgcccaggctggtctcaagctcttggcctcaggtgaccctcccacctcagcctctcgaagtgctgggaatgcagacgtgagccactgtgcccagccaacacacgttcttgacacggtgaggacatgctccataccatgtccactaaaagtctgggtagaaaaatcagttccaaatgctgaaggaaatgcctccagcccactgtatttgtgaagaaaatcttgggtatcagggctgctattttaattttgccttaaaacaagcattgctcagaatacatgttgtaccaaagaatatagacttgactttgcttgtacatgtgactgttttaagaaagcagtgtcgaggccacaattagaagcagaacacatttagtttctttgcctgcagccccaatgtctttggtacatctgtgtcctaaatcatagttgtagtaatgtttgtattcatcacacagcatcaaaaattaggtaagtatgacaggcaagtgcctagtgtgttttagtggtattttcaaaatgaattcatgtcacacccaaatgaattgctctctcagggaacccagtagagaaggttgtacctgagttaacttccagagcatcctctgcctatctgcctatttctgccagtggccagaatgaatttgtgtggtatatttttctcctaatttttatagcttttaatgtctacctaatgctccaagtttagtctgattatttaatgtgcagaaatcattaaaaccattttctgcctcacaaaaaactaaatcattggctgttactaaacaataattaagatttatacttcataggtatgtaagtataaaatcagcaataaaaagaccaggtgcagtgactcacacctgtaatcccagtgctttgggagaccaaggctggcgaatcacttgaggccaggagtttgagaccagtctggccaacatggtaaaaccccatctctactaaaaatataaaaattagccaggcgtggtgatgcacacctgtaatctcagctactaaagaggctgaggcatgagaatctcttgaaccctggaggcggtggttgcagtgagctgagatcgcgccactgcactccagcctgggtgacagagtgagactctttaaaaaataaaaaaaaaataaaatcagcaatacaagtttttgtgagcaagaagaagcaattttgttcttgcttctttatgattaacctacccaagaaccttaattactacagagataaaactaaactgctttttaaaaaataaagtagcagtaatagttatgctaaatatgtaatattagcataactaatattagctattagcataactaatattagctagctattagcatattattagcataactaaatattacatattactaaatatgctaataagtaatagttatgctaaaaatgtgtcaatttagtgtcagcaaccttttttttaaatagatgtattcgggcattaacgatacagatttttgcaccccagttagactgttcctgcttgtgttgatattctattattgcataacaagttacagtaaacttaccagcttaaaataatacctgtttgttttctaacagttcaataggttagaagtcctggcatagcatggccaggttctgaactcatggtctcacaaggctgaaatcaaagtgttggccaaggctggggactcatgtgaagcttggggtcctcttccaagctcatgtggttgttgacagaatgcagttccttgggactgtaggactgtggcccttgttttctttctagctctcagccaagaaccactgacagctcccagaggccacgtgcagggccttgccatgcgtggtctccataggcggttcacaacatgcatgtttgcttctcccgggccagcagttttatctctttacttcaagtctcttcttccaggaaggcctaatttcttttaagagattacctgatatatctgccctctccagggtagtttgccttttggttaactcaaatgcaactgatttggagcctcatatatctataaaatgccaccaattttgtcacataataggacctaataatgggagtgacatccatcatattcacaggccagatacagtcaagagggatgatatggggcatgtacaccaggggcaggaatattggggccatctcagaattcttcctaccatgttgccataagtaaaggggtcttctcaaatatgctcaacaggtgctagcttttatctttcatcaaatttttggaaaaataataccaaaatattaactgagaaataatttttccttagattttgtgtcatcctgaagttctttttagattatataaaacaattttttttcttaaattggaaaaaatactttccaaaatacttattggatattaaaatgttccaaaaattattttaagaaaatatattgcctaataccactgtaacttagcatagtgagttgagggcttagcatatttagtaatctaattatatcctcttacaagacaaaaatacctttgttttacagagtaatacaaaggcaagtctgtaactagttatttttcattctaaaagatatcataggttagatttgttatattagattgtactgatggcatattagcaaaattaaaaatggtttgatttcctggtcataaataagctgatttgcactataataaacaatgaataaacaataagtgaacaatgatgtaggaagtatcctggtgaaagccatatttacaataaacttgacactttttgaatgccatgtgaatattatttcatgagtataaaggatgagagtggtttaattaattgttcatctaccaaataacgtccactgcacagaaaaaaagactaatttcctttttaaaaatcactacttatgcccaattttaataacattttaattgtttggcttttgaaaatatgcaaatattagaacgtgacaaataatggtcagcagaccaggtaagagacaggatttaattttctagctcaaattactggtttttaattataaccttgacatctgtatatttctgtatcttttctccacatctcacctgcgttttctgaaagttctgttatattccttattgctaattatggttatctactttgctcttatttccagggatgctctcaaacttgtccagttgaaacaaacgggcaagattaccgagtccagaccaactccagcccccacagccactcccacagcaccttcgcccctacaggccacagctggaccatcttatccccggcctgtgatcccaccagtatcaactcctggacaacccaatgcagtggtagtgttctctaagtggatttttatttctttttcttgtttttctttttttttttgagacagagtcttgcactgtcacccaggctggagtgcaatggcacaatcttggctcactgcagcctctgcctcccaagttcaagtgattctcctgccttagcttcctgagtagctgggattataggcacgcaccaccacacccacctaatttttgtatttttagtagagacggggtttcaccatgttggctaggctggtctcaaactcctgacttcaggtgatccacccgccttggcctcccaaagtgctgggattacaggtgtgaatcaccgcacctggcctagatttttatttttcagattcaagtgtgagagagaaaataagaacaattactatgtgttttaagagtagatttaaaacagattagttttattaatccgtttcaatagtagctaagtgataaggataaaacactccaaatgctttgttttacagatttcctatcagaaaccaaaatttgtttgtgtgttaacttccaaataaacattagaactataattcaatttaaagttaccacaagttccacaacttcagtaacatatatattctctacaatctcatgtttcatgtcttaagtgtgatactaataattagtagctgacactagctcccttttgtggatatgttctactttttaactagggaattgataatctcactatgaagaactatgtagctagtcattctttccttctcagatgcatgcagtataacagcccctttttgttttcaaattactccattttgcctctctgtgcctttcctattcaggttattttcttcctatcagaagaaatgtaggatagcccagtttatttaaaatcgaatgggcacttaaaaaaataaatagataaatgtgtactcctagtggagaactatataccatatgatattttaaaagagttgaaaacagtacaactttcatgggaaacagatttttaaatatccattaatgattaatatactgcatacttgaataacctgctctttaaggacatgcagttggataagatactatgtatattgagtgtatagtccactctttgactatataatgtatatggactatgaaatatgtataattcaatcatatgtcttttaaaagtaggttattcaaggctgggtgtggtggcttacacctgtaatcctagcactttgggaggctgaggtgggaggattgcctgcacctaggcattcaaagaccagcctgggcaacatagtgagacctcatctctacaaaaaaattttaaaatcagctggatgtggtagtgtgtgcctgtagtccaactactcaggcggtggagattggggaatcacttgagactgggaggttgaggctgtagtgagctatgtgcactccagcctgggtaatagaggaagaccctatctcaaaaaaaaaaaaaaaaaagttattcaaattaaggaggtaaaccttactttcaaattcttatggtatgtagagagcatttattctacttgaccaagtactttgctaacataaaatgtttaatttcttaatgatatttgtaaaaatgaaatcagccgcactttcatttgctttgtattatcttgaagtgattgtaatgaaatcccaaaatagagtgaaggacaagaaaggaattagatataatttaaaatctgtcatgcttttttgagagatccaaggaacagaatggaaaaactacagtgaagttataggaatattttattatctcattcatactttctattatgaatctgtaagaaataagatactcatgttatttttaaaaattacaaatccaaatagaaataattgaattgcctgtatagaaggtccctaatcttctaatgtcccttgtgatttctttgatccatgagttgtttataagtgtgaatttaatttcaaaatattggaagacccttcagttacctttcatgatttctagtttaactccactgtgtttagagaatacactttgagacacacttcattttaaaacaatcttctcaaatttattgagatttattttatatttataacatggcctgtcttggtggatgttccatgtgtacttgaaaagatggttcgacttataattttttgacttcacgatggtgtaaaagtgatacacattcagtagaaagcagtgcagtatttccttgcaatgctgggcagtagcggctagccacagctccaagttagccatgtgatcatcagggcaaacaaccactgctctgcagtgtactgtgtagccaggtgattttgcccaactataggctaatgtaaatgttttgagcacatttatggtaggctatgctaaggcttacctgtgatgttcagtatgttaggtgtattaaatgcactttgacttatgatattttaaacttacgatgggttcatcagagtgtcacttcatcataagtcaaagggcaactatatattaatagttggtttgttgatttattggctgttttatttcaggtggttttttttcttttttttttttttcccgaaacaatcttgctctgtcgcccaggctggagtgcagtggcgcgatcttggctcagtgcaacctctgtctccccggttcaagtgattctgctgcctcagcctcctgagtagctgggattacaggcacgcgccaccacactcagctaatttttgtattcttagtagagatggggtttcaccatgttggccaagctggtcttgaactcttgacctcatgatccacctgcctcagcctcccaaagtaatcctgagattacaggtgtgagccaccgtgcccagcccatttcagttttattaagtgatatttgtaacaaaagctgcttacagatggtgtatgtctatgtctgtcttctctctcctctctctctctgtgtatgtatgtacacacacatatattgctccttgtgtgtgtgtggtatgtgtgtgtgtacgtatatatacacacacaaacacacctgtgaaggaattgttcattatttggtaggtttctttcttatcatcttaaatatagtaacataagatatcccattcacaattgaaacatgaattttattacttttttctgtagttatatgctataaaaccaaagcgtctcagattttttatattcttcccttatactaagaattttaatagtgcttttcttgtgttaatctttaattaataagttaggtcattgagaatgaatttcttttcatttataaagttgcttgttttttgttttatttttctattccacttgtggtttaacggacaggttgctgtctttttgcagggcacattcactgaaatccccgccagcaatattcgaagagttattgccaagagattaactgaatctaaaagtactgtacctcatgcatatgctactgctgactgtgaccttggagctgttttaaaagttaggcaagatctggtcaaaggttagtaaaattgaatttacttaatacaaaacacatgctaacttaactttcatgaaatcctttataaaattataaaattaaaagctacattgtgtagcttttaatttcaatttcataatgtacttgcactctactctgggtatatttgtgctagaggaaaaaaattagcaatggtttccttgaaaaagtgaattggttccacagtattaaataaatcacagatgcctttatgcagaaaaaagcattctgttctaccttgcttttatttcctctttgtcatatttgaataatgtacagttagttaacatttatttagcaggcaattactgagttcaattctctgttacatactgagctttaaaaatacaggttgagcaacccaaaaccaaaacttcaaagtgcttcaagatgtgaaactttttgagtgccaacatgaagctcaaaggaagtcctcattggagcttttcagattttggatttttggactagagatgccaaaacagtaaatgtaatattacaaaatctgaataaattttgaaatctgaaacacttctggttccaagtattttggataagggatactgaaatctgaagtactataatttggttggttagtttttttaaaagcaaaagtgggcttaatgttttggtgtgctttagcatttacataggtcaatttttttgtaagaacacatgaatgagttgtgtagaccaaatggttattttttgttttgaatattttttggtatggtatttaaacaaagcagtcaatatttcattaagtttaaaatccaaaacttttaaggatgttttagattataaatatcttatatattcttctttatacaaattttgattttatatttcttgttcagaatgcatttacagattattaaatttgtaatatttcttccaaaaatcaattataaataaggttgctgagagacatacagattttttagcatgaactgatagttttatttctttatttttgacctatatggcctttatattattttcttgtcttattgcactgactaggacctctgtctggtataatgaatatagatggtaaaagcagatatttttgccttgttcttgattttgggggaaaagcattcagtcttttatgttagctataggttttttgtagaatattattttcaggttgaaagaatttccattcctaacttgcagagagttttaaacatgaatagatgttgaattttctcaaatactttttgtgcatcttttcagataacttttcctttttctgtctgttaataaggtgaattacattggttgattttcaaatgttgaatcaactttgtattcctcatataaaatccacttaatgattaaccttctcatatattgtttgattctgtatcctaaaattttgtttagaatctttacacctatgcccatgagaaatgctaacctgtagttttcttttctggagacattttttcagatttgttatcttatctagtggaatgggttggaaaacatgtcctcctcctttattttctggaagagtttggatacaattggtattatttcttttttaattgtttagtagaattcactagtgaatttctttatgggaaggtttttaactatgaattttattttaaaaatgggtgcagctttttttttcttgaatgaattttggtagtttgtgtctttcaagaaatttgtgtcatctaagtcaccagatttattggcataaagttattcaccacattaccttattatactgtcattttatctgaagtaatgtttctgtttttgacattagtaatttgtgtgttttactctctagatcactctgactaaagggttatcagttctgttgatctcgatctcttcaaagaaccagcatttggttttattaacttatctagtatttctgtgatactgatctcattgatttctgttctttattttttttttctctttgctttcagtttactttgctcttttatttctagtttcttaaggtgaaaagttggatcatttatttgagacctttattttttaatataagcatatagtactcttgaattatctttaagcactgctttagctgtatcccacaaatgttgattttttttttttttcttcttgagacagggtcttgctgtgtcacccaggctggagtgcagtggtgcgatctcggttcacttcaaccaccgcctcctgggttcaaatgattctcacgcctcagtgccctgagtagctaggattacaggcacaaaccaccatgcctggctaattgtttgtatttttactagagacggtgttttagcatgttggccacgctggtctcaaactcctggcctcaagtgatccacccacctaggcctcccaaagtgctgaaattacaagtgtgagccaccacgcctggcattatttttccttttattcaattaaaaatgttttctcatttatttattttgtgatttctttgatcgatgagttatttgtaagtgtgcacttaatttcaaaatatttgagaactattcatttctcttttatgatttctagcttaactacattgtgtttagagaacacactttatatgatttcagttttcttaaatttgttgatatttattttatgtttgtagtatggtctgtcttggtatgtgttcttgaaaagaatttttttatttttgcaaaggaatgttctataaatgtcaggccaagctggttaatagtgttgtttatgtcttttgagagcagtgttgatattcctcattataattgtttatttgtggtttctcctttcagctctgtcggtttttgcttcatgtatcctgaagatctattattggccacatacacagttaggaattttgttttcttgaacagaccagttattatgtcatgtccttatctattccttgtaatattccttatcctcaagccttctttatcacatctgtagccactgcagatttctttgactcgtgtttctatagtatatctttttgcatctttttactttttaaatgtaaatatgtttatttaagtaggtttcttgaaggcagcgtgtagttggttcttgctattttatccaattctttagtctcttaagatgtttagaccgctcacatttaatgggatagttggatttaaatctaccattttgttctttctttgcattctctttgtcccacctcttttattcttctttccttatctttttggttacttattttgttatcattctattgtatttattcattttatcttcttttttctcttcttacctgctttgcaatggttttcttagggtttacaatgtaattctttaatttatcacggcctggcttcaaattgtattacaccccactccatgtttaatataagaacctcataactatatacttgcacttcctccctctcatattttgtactgctgttgtcatgttttacttctatatatgatgtaagccccagaatacatgtttaatgttttttgctttagcaaataaactcttttggagttttaaaatgagggaaaaaatgtcttttatatttatctgtactttttttcatttctttgtatagaattaaagtgctgtctgctattatacttcttacccaaagaacttcctttaatgcttcttatagtacagattgactgacaataaattttctcagtttttgtctgaaaaagtctattttgtctttcacattgttcctttttaaaacaattttttaaagtgtagttgaatatataacatgagtcttaccattttccgtgtacagttagttcgttgacattaagtacatttacattgtttgcaaccattgccaccattcatctgcagaacgtttttcatcctgcaaaatggaaactctgtatactcttcattcctctttcccaccacccctgacaatcaccattcttctttctgttcctataaatttgatgattctaagtacatcatattagtgggatcatatagtacttgtccttttgtgactggcttattccacttggcattatgtcttcagggttcatgcatgttgcagaatgtataaaaatttcctttttaaggctgaacagtgttccattgtatgtatctaccctactttgttaattcatgtgttaatggataaatacattaggttgtttttaccttttggctattgtgaataatactgctgtgaacgtggctgtacaaatatctctttgtgtctctgttttcaaatattttaggtatatccccagaagtggaattactggattatatgataattctatttttaattttttaaggagctaccatactgttttccttagtggctgtgccattttgcattcccactaatggcgcaccaatgggtcaggcatgatggctcatccctgtaatcctatcactttgggaggctgaggacaggggttcgagacctgcctgggaaacagaacgagaccctatctctacaaaaaaattgaaaaactagtcgggcagatggcatatgcctgtagtcccagctacttgggagactgaggtgggaggattgcttgagcccaggagttggaggttacagtgagctataattgcaccacttaattccagcctggctcatagagcaagacctgtctccaaaaacaaaaatgaagtgcacaaaggttgaaatttctccacatttttgccaatacttgttattttctggtttttgatagtagtcaccctaatggatatatctttatcatttttaagaattatttttgctggatatagatttttcagttaataggggttttgtttcagttctttaaataaagatactatttctttattttctgtcttagaatgtctgctgccgttcttaatatttgttccattgtatatgatgttttccacctgtctggttgctttcaagattttctgcattaccaatttggctattgtatgcctagatttttttttctattgtatttactgtttgggtttctctcagcttcttagatgtatggtttgttgtcttcctttaattgtgaaaaatttccagttatttttaatgatatcttctgttccatgtggtttctctttggggctccaattttaaatgttagactttttgaattgcccaaagctcttaagtgctctattttttttgttcattcttttttctctttatgtttcatattggataatttttgtttacctagcttcaagttcactgatttcttagctgtgtctgcaaagcttagcaaaatatatattttttatcttggttagcatggattttcccctctggatttccaattgaatgtttttttagtttccatttctctgctgctagtcgccatctgtttatgcatgttgtaccatactctgccctctttactcctgtactctgacagtgggtatttacttcctgtgtttgtctctcctctgagtggattatcactctttggcattcagttcacctgtttgctttgtaacctccgctccctaatgagctcaagaaaagttacgattttgtaatttatcctgctttttctttcaccctgtcaggatgggaacagctttcttttgcaactttctacatcccaggtgaaagcaggacttttatcagtttatatacagagtttcaagatttcatataaagacaacttgagagcttttaaaagttcaaggaactaaatggaaagctattttaaagaaagtgagaagtttctaaaaaatgaaccctggaaacactcctgcagttctcagatcatacttgcttagtcatgatatagaggttaatatgggaatcactttcctgttttcttactctaataaggcagaaaacagtaatatttcagaggagatatggattagtttattatctttgcatggtccagttttggtacaccttggtaattaggaattttcttaaaaatctttacaccccacattatctatcttcactcctctttctcatataaagttacaatacataacattctgtatgcatgcttcacactttgcttttctgtcttgacaatgtgtaaatgagaatgtttgatattaccttacaaactgttttctactcagtaaatgtaacagcatctcctttcaatatgtttggaaaatctccattataaagagttaaaaataaaggaattcaaagagaaacctactttacacatgttagatttgagatgcttgtaagcgatgcaagtagaaatttcatgtgagaagttggatatacaagtctgaagcctcagtatctcagaattagaggtagaatttggaagagtcatcattatataaatggtatcaaaaccttggaattggaactggaacttctagcctggggagatgccaacattgagaggaaaggaataaaaatgagtgagtgggcagaaagtggaagaaaaccaggagagtatagtgacataggagccagtaaaagaatatatttcattcaactcaagaatgttcctaaatgtgggagtatgctgaatacagaattttaagtgaggactgtggacttaggtggtaggtttgggggtcattagctggcagatggttttagaagtcttcactgtgaatacctgtgggtaagtagataaagtgaagagaaagctgagagagccatgaaaggtaagcagagtaagttcatgaactgttacatttgaatttgtacaaaccaaatctttctatgtggttatcattaaaagcttgtaagcactgtaagtccatttatatttctattcctaaaggggttttaagcaaaaatgtttatatatttctggaattctgaattagaggagctttgatactttgcagctgacagttatcgtgacagtttgacagtatttaggtttatggtaattcatctaatccctttctgtagtctccaggatgcctttggaatgagctgttattcacctaaaattccgtgatactttagtaataggataggttttttgccacataccactgactagatctagatcttagagtctttttctataagctcttgcaagaaagaatcaagtgttgtttacattttctaacactgttatacccagtggcaaatgcaaagacataaacaaatactttagttatgatcagctcgtaggaagtgggaggaccccagctttatcttaaaatcattatgtatactggaaagaaattgattcaaatgcattcaccataaaactatggatggagaacctcattttattaatcacactaggacctatgccagcattgcttcatctttggcttttgttatatcctgttttgttaagttaaaaagcagttaaattttttttcacctacaccccattagtaaaaagaaattttcgaacactttcccatatgtgtatatataactgtttatatataaagtacctacatgtatcactgttctagtataatcagtatgttataaagcatacagagaataagggtatttgaaaagaacgaggaagaaaatgaatcatcttgtaaacttcctgactgcacacaccacagagagatcatttgtctttttcgagacataggagttagttctttttttctgattatgcttgtaatgggtccttcaggttcttgtgtatgatatctaagcaatttaaaaaattgataaccaaggcccagaagtaaacttacattcatggttaatattattgatccaggacctcatataatgcaagtttttctaatcatgggaaccttattgactaagcaaacaaaagcttgtaattttttatcattgtttgtcagtacattccataatttacaagtttgaagttgtaatggtcaatgttaaagttatattaggaatactaattttactaaccttatttttctttcagatgacattaaagtatcagtaaatgattttatcatcaaggcagcagctgttacccttaaagtaagtagcagacttcaaatgattttgtcttcttaagtagtttcatgtcgtggaatttttacaatgacaaatagaactcttatttttaaatcacaaaaattttataattgtcttgctaaaaatatcctatcgtttgatctccctcattttacaaatgaagaaactgtaaatcaaaagggctcacaatgaattagagcaggatgaaaaccatttattctaggcattagagatagagcagtaaacaaaagcttacttgatttctgctgtccctggggcttacattctagttggaggagacaaacactattatatgtcagatggtgaaagtgctgaggagaaaaagaaaggataaggggacaaagtaactaggggtgatttttcaaaagggaagcgagggaagcccctctgacaaggcgataatttagatacggcctgagaaaacagagggagtgagccacataggtatgtggtaaaagtgcattccacacagagggaccagcaaacaccaaggctgcaagcagaggatcgcattaaccaaagatgtggtgctgagggtggaatgtgcctagtatggagaggtgggagataagatttaaataacagtgggagagcatgaaggggaacccaaatacatgaggccttgttggacatggtgaggactagggattttattatgggtgagaaggaagcctttggagggttttgaacaaataactaatgtgatctgacttatacttcagaaacgaaaaggagaggctgccctgggtgctgtgtagaatgtagcctgtggagaggcaagggaggagacgatgagctcccctgggaggctttagaagatcacagtggcttggacaaatgtggtagcaaatggagctagggtgaagtggagatttgtgttatgtttcaaaagtagagccaacaggatttgctgatggattggatatggggtgtgagaaagagaaacaagcattttggcccaagcaatgggaggaatgagttttccatgtactaagattgggaaaactgggaggggtatagctttgggttaaggaatctagagtttggttttagacatgttacatttgaggagcctaacagatattccagtggaggtggcaggaaggcaggtgaacatatgagcctgcagttcagtggaggtgatgtaaacctagctggctggagttgtaaatctagaacccaggcttcctgccttcctgcctggcactatttttcatcatgcctcctttctgtaacgaggctattttctgggatcactgcttgttaacagactgtatttaaagtacatttataattaactttttatttcttgaaaaatacattaatgagggttccatggtgtaatggttagcactctgtattctgaaaattacattaatacagaacttaaaaagcatgccctttcagcagtatctaattattcatataacttttctcttttgatgaaatattttgaattatattaatgatttaattaattgactattattgtgattgatatcattaattgtgaatcatttttgcactccttaaataaatctctaatgggcataagctattcgttaatatttcattggataatgtttgtatccagagtcataagtagtggtaatttaaattttgtgccaacattatcagaccttttttccctaatcattggcttcattaaatgaatttggattatttcttcttttctttcctctgtacacatttcaatattataaatttttttatattttctagtttcatagaattcaccagtaaaaatatctgaacctgcttctattttgaggaggggatcttggcagctttccctttttttttttctttcaccataattactgatctgttttaattttcagcttttttaaaaaatcaattttaaaagcttatattttcccagaaaatcactcatttaatttagattcccaaacttactagcctagagtcattttaatttgtttcttataattattttaacatcctcagtgcctggggttattctgacctctatctcacttctattgcatatttatatattcttagcttgtattgttttgttatgtattttttccttcatttccttagattcattttggtcagaactttaatgtgtaattcattttaattttttttaataaggtttaagatagtttcttttttttttttttgagcagcagcaagatttattgtgaagagcaaaagaacaaagcttccacagcatggaaggggacccgagtggattgccctaagataatagatttttaatgcaactttgaccgtgtcccataagtcttctttacattttgtaattaaatttatttgccatatattcttcattcatgagggttttgtttagtttctcttttactttagtgttgtctatgaagaatttcaaatcttctgagggtttgggactttattcttttaacataatgatattgttgaatgagtgaaggaactcagccttgaaagatggaaaaatggaagagcaattgaaaagcaatgtgaaggtagccttgcaatggaaatgagcgtagcatgacagtgagccaagtggaaaattcatctcaggggagtggtcacaagtaaaatgggatagatagagtggaatcaaattgtatattgccatgcttaaatgacataccaggaggcctggatctttttctttagaaaacaaagaatttttgagaacagaaatttgttttcagtttctgtttttcagcatcattttcacctgtgatacagggcaagattattaataggcagggtttccaggcatttcatcatttgatgaaatctttttttttattattattatactttaagttttagggtacatgtgcacaatgtgcaggttagttacatatgtatacatgtgccgtgttggtgtgctgcacccagtaacaagtcatttaacattaggtatatctccaaatgctgtccttcccccctcccccaaccccacaacaggcccgggtgtgtgatgttccctttccctgtgtccatgtgttcccattgttcaattcccacctatgagtgacaacatgcggtgtttggttttttgtccttgaggtagtttgccgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttataatcttttgggtatatacccagtaaagggattgctgggtcaaatggtatttctagttctagatccctgaggaatcgccacactgacttccacaatggttgaactagtttacagtcccaccagcagtgtaaaagtgttcctatttctccacatcctctccagcacctgttgtttcctgactttttaatgattgccattctaactggtgtgagatggtatctcagtgtggttttgatttgcatttctttgatgactagtgatgatgagcattttttcatgtgtcttttggctgcataaatgtcttcttttgagaagtgtctgttcatatccctcgcccacttgttgatagggttgtttgtttttttcttgtaaatttgtttgagttcattgtagattctggatattagccctttgtcagatgagtagattgcaaaaatgttttcccattctgtaggttgcctgttcactctgatggtagtttcttttgctgtgcagaagctctttagtttaatgagatcccatttgtcaattttggcttttgttgccattgcttttggtgttttagacatgaagtccttgcacatgcctgtgttctgaatggtattgcctaggttttcttctagggtttttatggttttaggtctaacatttaagtctttaatccatcttgaattaatttttgtataaggtgtaaggaagagttccagtttcagctttctacatatggctagccagttttcccagcaccatttattaaatagggaatcgtttccccatttcttgtttttgtcaggtttgtcaaagatcagatggttgtagatatgccgcattattaaaattgacaccctaacattataactaaaagaactagagaagcaagagcaaacaaattcaaaagctagcagaaggcaagaaataactaagatcagagcagaactgaagggaatagagacacaaaaaaaccttcaaaaaatccatgaatccgggagctggtttttttgaaaagatcaacaaaattgatagactgctagcaagactaataaagaagaaaagagagaagaatcaaatagacgcaataaaaaatgataaaggcgatatcaccaccgatcccacagaaatgcaaactaccgtcagagaatactataaacacctctacgtaaataaaccagaaaatctagaagaaatggataaattcctcgacacatacaccctcccaagactaaaccaggaagaacttgaatctctgaataaaccaataacaggctctgaaattgaggcaataattaatagcttaccaactaaaaaaagtccaggaccagatggattcacagccgaattctaccagaggtacaaggaggagctgttaccattccttctgaaactattccaatcaatagaaaaagagggaatcctccctaactcattttatgaggccagcatcatcctgataccaaagccgggcagagacacaacaaaaaaagagaattttagaccaatatccctgatgaacatcgatgcaaacatcctcaataacatactggcaaaccaaatccagcagcacatcaaaaagcttatccaccacgacgaagttggcttcatccctgggatgcaagggtggttcaacatacgaaaatcaataaacttaatcccgcatgtaaacagaaccaaagacaaaaaccacatggttatctcagtagatgcagaaaaggcctttgacaaaattcaacaacacttcatgctaaaaactctcaataaattaggtattgatgggacgtatctcaaaataataagacctatttttgacaaacccacagctgatatcatactgaataggcaaaaactggaagcattgcctttgaaaactggcacaaggcagagatgctctctctcaccactcctattcaacatagtgttggaagttctggcgagggcaatcaggcaggagaaagaaataaagggtattcaattaggaaaagaagaagtcaaattgtccctgtttgcagatgacatgattgtatatctagaaaaccccattgtctcagcccaaaatctccttaagctgataggcaacttcagcaaagtctcagaatacacaatcaatgtgcaaaaatcacaatcattcttatacaccaataacagacaaacagagagccaaatcatgagtgaactcccattcacaattgcttcaaagagaataaaatacctaggaatccaacttacaagggaggtgaaggacttcttcaaggagaactacaaaccactgctcgatgaaataaaagagaatacaaacaaatggaagaacattccatggtcatgggtaggaagaatcgatattgtgaaaatggctatactgcccaaggtaatttatagattcaatgccatccccatcaagctaccaatgagtttcttcaaagaattggaaaaaactattttaaagttcatatggaaccaaaaaagaacccgcattgccaagtcaatcctaagccaaaagaacaaagctggaggcatcacgctacctgacttcaaactatagtacaaggctacagtaaccaaaacagcatggtactggtaccaaaacagagatatagaccaatggaacagatatctcttttaaatagggatgtcatgtattgagggcctgctgatatatatcccagagctgggctagaaagtaaggaataatgtgatctaatattattacctgtttccactctcctcctcccctcaagatcatgttcgttatcatatgaggtaggaagtacaacagacattaaataacttcttgcaatcaggaaagaaagccctttttccccaccatgatataaaggatcaaaacatgtacctcatcagaatttcttcaaacttgcttcaaaaaggtggtatgtttaattattcttggcaaacataaaagataattgacacagaactccataccattttttcaaacgaaatttttatttattttctcttatctagctatgttcactttggaaaatgcacaatgattttatttttctgtaaccgccttggtctaaagctgcttttttagtaacatttttctttttctatttctagcaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggtatgtcttaagaaagagtgtgctttcaaaatgttagcatatacttttggataattactttctgataaagttgtgacgtaatctagtcagactgtgatttttgtgtgtgtgaaggggagagttatttcatcaagtgattgtcacatatatataggtttttaaagtttttatccaagtatgacccattgtaagaaaatttaatattcaaaaattaagagataatatataaacaaattagggaacaacttcatgctaaagacaagctttattttccaaagtccagaattcagccataaagatgctatatcaggtaggttttaaagttgaagttaagctgaaactgtatttctatggacctcaatattaataacattttattcttaaagtgtatttacttcttctctaaaattgagaccattaaaagaacttagcggccaggcgcggtgtctcacgcctgtaatgccagcgctttgggaggccgaggtgggtggatcccgaggtcaggagattgagaccaacctggccaacgtggtgtaaccccatctctactaaaaatacgaaaattagctgagtgtggtggcgcgtgcctgtaattccagctactcgggaggctgaggaacaagaatcacttgaacccaggaggcagaggttgcagtgagccgagattgcgccaccgtactccagcctggcaacagaatgagactccatctcaaaaaagaaatggacgtaatgttccagaggcaaagttactttattttttcaggatttcttgaaaagcagtttttgtaactccaatgtgtaggaatcttatttcaccaaaaaatagtacatcgaataggcaagaacacaggcagtagggcagctttgacagcctcagtaatttccaagggtattttttgacagaagtatcacaagtcttaaagtgattgcatcgaaaatttctgattcatttgggtaagtgattatctttccatttgccaaggacctgttgtatgtatagtggtagaacaatttgtatatttataagggagatatgaggtagaacgtaagacttctttggggagccgacagtacataaatgtgtagaccttcttgctcaaaagaaataagtgcaagttaatctggttttaaaagcatacccataaatactgagtttacttggaattttagaggtagatataattaaaggtgaacctactagaatcaatatttttaggtctttcttccctcctctttgaaaagatttgcagaaagtgtttgatcgataaaaatgcaattgttaattgaaaaatgaggctgcacatggtggctcatgcccgtaatcccaacactttgggaggctgaggcaggcagatcacttgaggtcaggaatttgagaccagcctggccaacatggcgaaaccccatttctactaaaaatacaaaaattagctgggcatggtggcacacacctattatctgaactattcgcgtgacggaggcatgagaattgcttgaacctgggaggcagaggttgcagtgagctgagattgtgccatttgcactgcagcctggatgacagagcaagacactgtatctcaaaaaaaaaaaaaaaaaaagaaaggtagcgtttatttggtcagttcaaaagtcaaagtaatagagattggtttactgagatatagtatgttccttgtgtttatcaagggttttcagcgacaatgagaatatttgtgtctgtgtttttgtgaaggttaaatgagattaagtgttgaaacaacctgtaaaatataaagtactattataatgttatggaactttattgtagagctagaatttccttatttttatatacattaaattttaaaaattaaccattataggaagatttccttgattctgagcaatttaccaaatttactgctataatacataagtcgtaagtagttatgttagctttctctattccttgcatcctgaagactctaagtttaagaggtaagaacgcagtctcaccagcctctcagttgggcctcacagcaatgggaagggcagtcataccactttggagtgtagtggtctctggcgggccttgggcatttcctgtaacccccaacagggactcagggtttgctgagctatggctgcccgttagcttctcattctacctgcttctctttcccaccctgctctcttcactcttgttcttacgctatgccaggcactgggctaagtgcttcatttaatcctattaacccagtacaattggaaccttaacttctccatgaaattgaggagattcagttttagcaactttgataaatttgcccaaggcaatacagctagaaagcagtggcaatgaggactagttaacccaggcagtttgattctagagccactgcttaatgagctttctattataccacctctctccttgcttttactgtttacctttcttttttcctgtctaatcattcacttctttacctcccctttgtctttttctcccgcaaagttaccagaaaggagggtttggtttggtcctcaagtagtactttcttgtatgaagtactcttgctgggcaggtctgtcatgccaggccagtgtgtcacatggtacagagcataacaacctgatgaatataatcacctttggttgtactcggaaaaaataaggggacattgaagcacactgaggcctctcatgagaaacaggcaccttgcatggcctatttaacataatagttctgtagtttacaggagagagagagagcaaaagagaaagaaagtttatgtgtgtgtgtgtatgtgtaagagagagagatctgagctcctgcaaaattagttttttgttgaagtggtttatcttgtaagcatgattatcttaaaaacttaaatgttggattgtttaaacggtggcttaaaaactaaatattttagataggctctatagagatatgttcatttagctgctgtggatgaataggcattaaaaataagtatgcaccaagtagaaaccctgagtgtgtgtgtgtgtgtgtgtatgtgtgtgtgtgttcttcacgtccaatatagattttgactcaattccaagttaagcaagattatattgaattcagctttactgtgcaaaaaacagcatctgcctgagtgtccacgtatagtagtgagtcacctttggtaataaatgcattttctgtcctgtgctttaatgtggttatattttaccgcatcccccaaaaagggtagacagtaaatgttacatttatggaatagtagtgccattttatacagtttgagtctcgtcagtatttctacatcaagctttgtactatggcttatttaaaaagtagaatgtttatgtatttaaacagataaaatttagaatgattttaattccagggtaaaatctgctccgaccagagagaaaaaactaattcatatatgaatatagtatttgtaatcctcttgtttaaagacatgcaagttctagaagtatttgtactgcttaatgttttaacaactctaacaataatagcagcgggcatactttgtaccagtttttgctgtaagccttttatatatattaatcctctttaaaaccaccctatcaagtacaagataataatttgatatggttgatgaagcaactgatgggaaaaaagagaggttaaataatttgccccaaatcttattaagtgatgtagccagcatctgaacccaatcagactgtagactagagcctcctcccaaccactcagctttgctgcttcccacatactagttacataactactgtatgactatagaggtcaggttatcagccttctagaatcagtaatgttttctgtcaaaaaaaaaaaaaaaaagaaacttgagaagcagctcctggattttcagaaattaacaagaagaatagctaaggactcaacagttataccaaatgcaccataattagttgattcaccaggtagaagaaaaggagtacaatcattggttttctgtgtctgtaagaccaatcttttggtttggaatttgaaatattggagttctctcttatccaaggtttcactttgtgtggtttcagttacccgtggtcaaccacagttgaaaatagatgagtactgtacaagctattttgagagagaccacattcacatgatttttagagttataattgttctgttttattattagttattgttaatctcttaccatgcttaatttttaaattaaactttatcataattgtgtatgagtaggaaaaaatagtacagtcatgcatcacagcagggatacattctgagaaatgcatggttaggcgattttgtcattgtgtgaacaccatagagtgtgcttacacaaacctagatgggatagcctgctacacgcctaggctttgtatggtacaaacctgcagtacagcctattactgtactgaatagtataaggaaatagtgatacaatggtacgtatttgtgtgataggaatttttcagctccattttaatcttatgggaccactgtcatatatttatgtctttgtcttaagtgtccttatgcggcacatgactgcatgtatagagttcagtactatctgccatttcaggcacctactgtgggtctttgaagtatcccctgcagataaggggggactactgtatgcaactgggagaaaaaaagggttaagaaagaagagacctgagtcaaacgggagagtactctgccaaagaagcagtgaagattccccgaggaatgtgaggttgtggtcttagcaagtaggcagtggataagagaacctgcagcaaagaaaccaaggctctctacctggtgaggcaggagtagtctttttgaaaagactgtgggatcatggacaggttgagctctggattctcactaagagacatactatccagtacacacttccctctgatcgtcacttggctggctttttttcatcattggtttctcagttcagttgctaatttcttaggccttctgcagcttctgtagctgaaatagtttcctaacactctttatctcattaccctgttttattgtcttcatatggtttattagtctttgaaattaccttgtttatttatttgttcacccttctgtgttccctactgtctgatgttcactgtccattgccatttatctaattctagaagagtgcttgggatacagtagttgcttggtgaatttattttaaaacaaatttcagtaaaacttgtttcattgaaattaatttttcaagagtttgtggctctctgcagattcatccatgaaccccaagttaagaatatctgtactacgcatttacttcttgaccctctgtaatcccaaggatgccactgtgggggctgtaggcataccccagccaagttcaagttggtattccttgaataaagtaatgtagtgacacaccttggatcctgtgttattcttaattcttcattacttataacagtattaaaaggcagaggcatagtttaccttataagtacccagtaaatttttttaatgaatagcaaggcattcgatgtattgtagaaatatttagtggtcattttttattctttcagctggatgcttcaggtaacatgtactttgattttgagtccacattgccaggagatcccagtgatgattacaaatttataaaaccaacgatccttctcagattccatacctatttcagacttactagagttcactgacaggaatttcctgttgatgtatttaggatctacagagtttttgtttttagtatgtgtgcgtgcaatctacttattaaagtgagtttttttcatttgtggtaattgtgtggtagttcatcaggatatgttgagatcatctgcctttaaaaaatgccttttaaagttcatatatgtgtcttttcaaatcatgtgaacaattacattgcttaagggaggaaaaatgcttttatagattattctctctcccgttattccaagaactgtataagtcaaaattcatctcattttttaccttgaatccaaatagttttataaataaccacatccaaatagcatacacctgtaattgtttctgttggcagtacgttacagtaatgtgtttttagatttttgatatttttaaagactttcaattttaaaaaattaaatcatctatgaattaaagttagttatcaactgtgattgtaatagtgcctatgttgcctatgtaatacaaaatattaagtaaattccacatttattttatctacccaaatgacagtgacctcatttttctgtacccttcctcttaagttaattcgttattaattttttatatatgatgactcaacctctgttcccttgcttttaagcactgaaaaataaaaattaacagaaatgtggttaattccaagtacaagtgagaggaaaatttaactaatatgtcatctgtcttgtcttctgtaagatttttagaaatcgctgtggtcaagagtgatatgaatcaagtacatccttatattccttgtggcagtgtaaattggactagctcattcaggaaatgatttagctataggatcaagaaccaaaagaagtctattctctagggcactataattccacttctgaaaatttacctgaaataattcagaagaaaccgtgaaccaaattataacactgggaaataaccaagtaaattaggcaggtgcagtctttaggaacaaacattaaaaaatcatttctgaaggctgacaacacagaagatacatataatattgaacaattaaatataaaatttattttttataaccattgtgtggggttgagattgtggataaagatgaagcaaactctgaaagataaaaacggaatgttggttgtgggattgtgggtatactactttggttgccattggataatttatttaaaacacacagattggccaggcatggtggctcatacctgtaatcccaccactttgggaggccgaggtgggtggatcacttgagttcaggagttggagaccagcctgaccaacatggtgaaaccccatctctactaaaaatataaaaaattagctgggcgtggcggtgggtgcctgaaatctcagctactcaggacgctgaggcaagagaattgcttgaacctgggagatggaggttgcaataggccataatcacaccactgcactccagccagggcaacagagtgagacttctcaaaaaaaaaaaaaaaaaaaaaactaaaaaacactagattgaccagaatggattcttgtattttttttcttaccataaagttttataggcaaaatagaaaatttcattttgcatataggaaactctaaagcattttgcataataattgatggtacacagggtaattcccacatttgaaaaattgttaaaggaagtgatttttctagagttttgattaacagctttagtttcttgaattatctgtgctcttgtttgttcttataattagagaaaattatttttatataggtaacaaaatcaaatcaaggcatatcagagatgagagtatatgatgtacaaatatttcaagtgacaagatcaactgtataacattttgttggttgtcctattctgtttgtatttttctcaggctctatcaaagaaagcaagagatggaaaattgttgcctgaagaataccaaggaggatcttttaggtaaaatttaaactcttaattatccatagcatcaaacagatagatgtaagacttataaagtccctgtcagcctttcatttatctgaaatattttttaaaatttaagctaaaaatactttatttagacaatagaatatctgaaaaaattcttcagactagtcaggctttcatattaaagctagtaggaacctattagtgttgaactaaacgttcgttggacattgactaacatggaatgataaatattatgtattctttagtatctgacccacccccaatattaatgtctgtaatattatattgctatgtgaaacaaccacttatttattattgcagcatataatattctattgtataaatataccagaattcattttactgttggtgggcatttgcgttgcttccagttcggggctattacaaattatggtgctatgaacattcttattagtgtcttatagtgaatgtatgtacattttttgttgtatagacctaaaagtagaattcctaagttagaagctttagcagctactaccaaacaattttccaaatggttatacaaatttacacctccaccaacggtcctgagaattcccattgctccacattcttgccactatttaataatgttaggttttaaattttaacaattcttggggtgtgtagtggtactctttgtaggaaaatgcaaattagtgatgttgagtacttttcactcatcagccgtttgggtatctggtaattcatgagataaagtacccactgcaatctggtgtccatttaaaaaaatgatgtatagttcttatttctggatatacagacctttataggatatatattgtttcaaatagctttcacactctgtgacttgcctttgggactctctcggtgatttttttaaatgaacggaagttctgagttttaatgaattcctatttatcagtatttttctttgtagttggtactgttcattttctgttaggaatttttgcctatctcagagtcatgaagttactcttctgtgttatcttctaaaagcatttacgttacttttcacatgtagatcacaattcaactgaaattggattttgtatataatgtgaagtttcaagtgctcttttttccccatatggatactaaatttacacagcatcatgtattgaatattgatttctcctttttcatagcattgaaaaggtgattatatatgtgttggtctagttctgtgctattttttttccactggcctgtttgtctatcctttgtttactaccaccaagctataactcttgatagctggtaatgaagtcttccaattttgttcaccctcaagattgtcttctggcttttcgtatttccaaataaattgtaaaattgatttgccatttttcacacacacaccccttgctggtttcttgattgggattgcattaagtcttttgatgatttgagaattgacatccttacagtattgagtattctaacctgtgaatatggtagaaaccattgtgtattcagttatttgatttctttcagttatgttttataattttctgtgtagaggtcttgtatatgtttcattagatttattctttggtatttgttttttgatactattataaatggtattgttttaaatttttattttctaattatagcaacttgtatgtagagtcatgtgccactttatgatggggatatgagaaatgcattgttaggcagtttcatcatgcaaacatcatagagtgtacttacgcaaatcatgcaaacatcatagagtgtacttacacaaacctaaatggtacatgctgctacacaccttagctgtatgatatagccagttgctcctagactgcaaacctatacagcatgttactctactgaataccgtaagcagttgtgacacaatgatgagtatttgggtatctaaacatatctaagcatttttaaaatgtacagtaaaaatgtaaaaagtaaaacatggtacacctgtttagggcacttaccgtgaatggagcttgcaagactagaagttgctctggaagaatcagtgaatgagtgaatgcttaggacatcactatacactactgtagactttataaacactgcacacttaggctacactaaatttatttttaaaataaagtaattgcaatatgatgttatgacagctatgatgccactaggcagcagaaattcctgagctccattataatcttataagaccaccgttgtatatgtgatccttcgttatgtgggacatgactcgatataaaatggattgttatattgaccttttatctgatgacttaactaaatttacttattaattttactagttatctatagtctcatttttcctgtgtacacaattaatttatttgtaaatactaaatgtttccttttttcattactcatatatttttttcttgccttactacactgcctagtaaaatatataaaatatgtgcttcacggaaaggggactttgattaaggacatgcctccttcagagctttttcttttccccctagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggaaaacaacttggtatttaagtatgaagtggatgaaatgtttatttatttaaggtgaaagcatttgacccagggtgtcttcatcttcaatttgggtttaatgttatagaaataaatgatgataaactctaactaataaaggaaagagaatatttggttactcagatccatttttaacctctggtgctgtataaagggaatattaaactagatgtaaatcaaagtatatgtttggctcatttgagcattttggaatatttgagaatgtatgatacatgtaaaattaaaaaaactattagaactgtaccataattatgttgaaggtagaagtgatcttcaaagagatggccattaacttagcagtgggacctcacttttacaagcactgctctagatatacttgaagaatttaataggtacagaagtttattctggataataaataaataaggatcacactgtattaggggttatggcaacattattgaattttttatgtacataaagccatatgtttagggtggtttctatctgtcttgtttttcacttatataacactgtgaacttctaaagcaagaggataaaagaagcatgaatgaaaagaatgacatttcaaaaaaatggttcaatgaaaaactatagctaaaatatgtaaacctttctaggtaaaccgcttgccttcatcttgagtcggaatatatttaaataaattgtgttatctcttgccaaacattttgttagtgtttatttaaaaacaaaatgttgtttcttaatgcatttaaatcagttttgtattgtgcagtaaaatgtgagaaaatataaacatttctattgtattttaaatgttaaaacacaaaagttcaataaaccttgaagttgattagtagtttttctagaacacctttaaaagggctctacaggagaaaagacggaatttaaaattagtatgacattaggaaagtaactgataggaaatgtaaaactttggaaagagaatagaagacttatgaagccaaacagatgagaactatcctttttatttcactaatatgaaattttcactaattattataaagtttagaagagtttgtttctctcttttggcagctctgctataactgtcaagataactatatttaagttggatggtaatgaatggtaatttaattaacttgtcacaaaaaggtttatgttagtgtcagctgacatgaatcaatagaagaaaggctaatatagtacaagttgtatggtatgacatgatgaattataaaccctaacagaagagccttctaaaataattagcaccctggtgtattaattgttaagaaaatgcttaatccaactatccaactcagtttaacaagccatttaaaaaaaatagtcttcaaaacttttgtcatattaacagttacactgaaaattataaccaaaggctattttcaaaataatttttatgttacattatttccaaggtcagttttaatcgaaattattattattattactactttttcttgagatggggtcttgctctgtggcccaggctgtagtgcagtgctgggatcacagatcactgcaacctcgacctcctaggctcaagtgatcctcctccctcagcctcccgagtagctaaggactaaaggcatgcaccatcatgcctggctaatttttctattttttttttttagagacagggtcttgccatgttgctcaggctggtcccaaactcctgggctcaagtagtcgacccaccttggcctcgcaaagtgctgggattacacaggcatgagctactgtgctaggccgttgtttttgttgtggttgttgtttgtttgttcattttaatttttatatctgaggaacagaacatgatgaggcagccataaataagcctgactcagagttctgcttttcatgaactgacgtacataagcagtagtgcatctgtttccctataggtgaaatgggcattaatatttactcagcctgccttagagagttgaactgtacaagggaaatcgctgtataaatttaagatgttttaattcatggacctcacaaccaggcttttcatataatcacctgcctctcatggtttgacttctcagcttctggtacaaatgcttgttcattctgaccaaaaatattgtctctggtatttctatactgatgaggtggtttagattaaggaagttttcatttctaaaaagaattttgttgtagtttgagatcaaagaataacactgagaaaggagtatggtatacttggtttgaactgtgtgctacactaccaggccccttccacattatactactaatttatttaaaatagataggtatcacactgagaggatataaaaaaaatttctgcctcttcatttttgtttcttgtttgaacagaaaaaatgaccaaaatattgggagtacttctaaggaaaaggcaacacacattccagttaacacttggatgtgaaaatatcaatgaatattagaatttataagtcaaactggctctgctcgctgattgcaatttttagttacattcactattttgtgctaaatttaagtcattggtatacgactggccagagtccttggttttaaacattactgagaactttatatatactcttaatgggtattttatataatgtcgaatgaaacttttatttttagatttttaaaaaatattttgcactttggacttaattttacactaaattgtatcagccagcctaagggcattatgctaaatgtaaatctagttcttggttaagcttttattgaaagataggtggtgctgtaagttaatatattgtagtgaaagtgtgggagaaaagttaaattggcacttaaatcttagttttcaaggaaaacgtgt

SEQ ID NO: 15518 - DNA, 15702 bp, Human
tgttctaaacctacttaaaagttttcaaaacactgaatccagtattagtttttaaatttaaatttaagttaattaaaatcaaataaaattaaaaatgtaaggctgggcacaatggctcacgcttgtaatcccagcactttgggaggccaaggcggggtgatcacttgagctcaggagttcgagactagcctggccaacatgtgaaaccctgtctctactaaaaatactaaaattagccgggcatggtggtgcgtgcctgtaatcccagctacttgggaggctgaggcatgagaatcacttgcacctgggaggcggaggttgcaataagctgagatcgcaccactgcactcccgcctgggtgacagagcgagactctgtcccctgccagactcccacaaaaatttagttcttgggtcgtattaccctatttataaaaattttttttatagtgagacccaatctctagcattaccccatttcgaatgctgaaaagctacatggggctagcggctactatataagacagcataggactagaccaccaggaagaagaatgacataaatgaaggatccccagctccacagaggacttgggacagaaacagcccaagacccagacagcagccagagtaggagcccagggaaagggcttttggaaacaaagagctcaaggtgactcaaatgcaccccaagatctaagcaccaggcattgcagcctgctctggaggaaggggtcggcaggagatggggtggtgggaagaaatcccaaacctgccaaagtaggaatgggtggaaaagcaagaactatgtccagggaaaataaaaaagcacttctggggttggattctggagagcgacctgtgcaggggagcttgaccttctcctgggcacctctaggaggcaaaaccaggaccaagggtggtcattataggaagctgcttggggctcaaaccaacaatgaggttttaaacaaggagagctccccagtaatggaaacagggagcttcccgcccttggaatcctagacagaaaatgttctacaggaattacctcctcctcatccagtggaatagcaaaacagaggctgggaagttacctgttgagaggctgcagaggggtttcttcctgtacaaaggattgaataataagttccctccagttaggcacctattgatactgtatttggagtaactgacctttccagaggacttattgtcaggcagctaaacccctgaactaagcactttactgccatttcatccgcactaaagtcatgagcctggtcctctagttttctacacttcttagaggaggaaactgagccgatgagttttgaagtcatgtttcccggccagaagatgctcgagcgaggctttacaggcgggcagtctggttccagggcatgccactgcaccacactgcccagaaggaggctcagcctgtcttgtcctctccctgcttggccttaaccagccacatttctcaactgaccccactcactgcagaggtgaaaactaccatgccaggtcctgctggctgggggaggggtgggcaataggcctggatttgccagagctgccactgtagatgtagtcatatttacgatttcccttcacctcttattaccctggtggtggtggtggtggggggggtgctctctcagcaaccccaccccgggatcttgaggagaaagagggcagagaaaagagggaatgggactggcccagatcccagccccacagccgggcttccacatggccgagcaggaactccagagcaggagcacacaaaggagggctttgatgcgcctccagccaggcccaggcctctcccctctcccctttctctctgggtcttcctttgccccactgagggcctcctgtgagcccgatttaacggaaactgtgggcggtgagaagttccttatgacacactaatcccaacctgctgaccggaccacgcctccagcggagggaacctctagagctccaggacattcaggtaccaggtagccccaaggaggagctgccgacctggcaggtaagtcaatacctggggcttgcctgggccagggagcccaggactggggtgaggactcaggggagcagggagaccacgtcccaagatgcctgtaaaactgaaaccacctggccattctccaggttgagccagaccaatttgatggcagatttagcaaataaaaatacaggacacccagttaaatgtgaatttcagatgaacagcaaatacttttttagtattaaaaaagttcacatttaggctcacgcctgtaatcccagcactttgggaggccgaggcaggcagatcacctgaggtcaggagttcgagaccagcctggccaacatggtgaaaccccatctctactaaaaataccaaaaattagccaggcgtgctggtgggcacctgtagttccagctactcaggaggctaaggcaggagaattgcttgaacctgggaggcagaggttgcagtgagctgagatcgcaccattgcactctagcctgggcgacaagaacaaaactccatctcaaaaaaaaaaaaaaaaaaaaagttcacatttaactgggcattctgtatttaattggtaatctgagatggcagggaacagcatcagcatggtgtgagggataggcattttttcattgtgtacagcttgtaaatcagtatttttaaaactcaaagttaatggcttgggcatatttagaaaagagttgccgcacggacttgaaccctgtattcctaaaatctaggatcttgttctgatggtctgcacaactggctgggggtgtccagccactgtccctcttgcctgggctccccagggcagttctgtcagcctctccatttccattcctgttccagcaaaacccaactgatagcacagcagcatttcagcctgtctacctctgtgcccacatacctggatgtctaccagccagaaaggtggcttagatttggttcctgtgggtggattatggcccccagaacttccctgtgcttgctgggggtgtggagtggaaagagcaggaaatgggggaccctccgatactctatgggggtcctccaagtctctttgtgcaagttagggtaataatcaatatggagctaagaaagagaaggggaactatgctttagaacaggacactgtgccaggagcattgcagaaattatatggttttcacgacagttctttttggtaggtactgttattatcctcagtttgcagatgaggaaactgagacccagaaaggttaaataacttgctagggtcacacaagtcataactgacaaagcctgattcaaacccaggtctccctaacctttaaggtttctatgacgccagctctcctagggagtttgtcttcagatgtcttggctctaggtgtcaaaaaaagacttggtgtcaggcaggcataggttcaagtcccaactctgtcacttaccaactgtgactaggtgattgaactgaccatggaacctggtcacatgcaggagcaggatggtgaagggttcttgaaggcacttaggcaggacatttaggcaggagagaaaacctggaaacagaagagctgtctccaaaaatacccactggggaagcaggttgtcatgtgggccatgaatgggacctgttctggtaaccaagcattgcttatgtgtccattacatttcataacacttccatcctactttacagggaacaaccaagactggggttaaatctcacagcctgcaagtggaagagaagaacttgaacccaggtccaacttttgcgccacagcaggctgcctcttggtcctgacaggaagtcacaacttgggtctgagtactgatccctggctattttttggctgtgttaccttggacaagtcacttattcctcctcccgtttcctcctatgtaaaatggaaataataatgttgaccctgggtctgagagagtggatttgaaagtacttagtgcatcacaaagcacagaacacacttccagtctcgtgattatgtacttatgtaactggtcatcacccatcttgagaatgaatgcattggggaaagggccatccactaggctgcgaagtttctgagggactccttcgggctggagaaggatggccacaggagggaggagagattgccttatcctgcagtgatcatgtcattgagaacagagccagattctttttttcctggcagggccaacttgttttaacatctaaggactgagctatttgtgtctgtgccctttgtccaagcagtgtttcccaaagtgtagcccaagaaccatctccctcagagccaccaggaagtgctttaaattgcaggttcctaggccacagcctgcacctgcagagtcagaatcatggaggttgggacccaggcacctgcgtttctaacaaatgcctcgggtgattctgatgcaattgaaagtttgagatccacagttctgagacaataacagaatggtttttctaacccctgcagccctgacttcctatcctagggaaggggccggctggagaggccaggacagagaaagcagatcccttctttttccaaggactctgtgtcttccataggcaacatgtcagaaggggtaagtaccctgtcctccagggctctcctccacccaccttccctctcttctctctcttccctctccctccctccttacttctctatcttatgctctgcccgggaatataggcacacacttctataacccctgtgtgggtcctgaccccacaaaaggaggaggcttaacaatgaccttgggcaaaagaactgaaggtctgagcaggcccatttccctggctggctcaggctgatgcggttggctgttcctctttttcctttctctgcccaggtgggcacgttccgcatggtacctgaagaggaacaggagctccgtgcccaactggagcagctcacaaccaaggaccatggacctgtctttggcccgtgcagccagctgccccgccacaccttgcagaaggtgaggtggctgacagtgcggagaggagcagcctagggaggcaacatgaggggaacatgactgcattctctctcctgtgaaaagggtccagcctcggcactccagatcatcctggacctgatagactggcctgttctaaggtccttcctggtggtcacggctatggcagcaactgggttgaccagacacccagccaggccagcccaacccaagactacagcccagagcctcggaactagggccctctaaactagactcaatatgagaagcattggtttggaaatggccccggggaacaaggatccaactgctgcccctgctagacaggcaagagacttgagttccagaaccagacctactttcagcttgctgtgtgaccttaggcagattgctttccatctctgggtcttgccttctgtatctatgaaagacggttggtggactagctcagaggtgatcagattgtgctctgtggaggctgacagagctgtcttagggctgctggggaggatgagaagtggctgagctgagcctgggcacccagcttccatctctgcttccttgggcatctcaagggaaaggtgctattagctccttcacactttactccccctcctttcccttccctcctcatgctgtccaaggagagagctgcctgaggcgcacggaggagttctcctgacccagcagaggggaggaatgtgaggctctgggcaggaggcaggctgccatctgccagagagccgtgtttttgaaaaaatcagaatcaagcctgggaggcagcagagtgaaatgatggaaagaggagtcccagctccactcctttctctctgggtgaccttgagcaagaatatcttcacctttatgagcctcagtctgctcatctgagagctggggataagaacacctaccatgatggtctgtggcaaagattaaaaaacacagtgcatttaaaggacttagcaggttgctaggcaaaggctcagtgagtgtaggcagtcatttttagaaacttttagactgttggccatattctgcaaatatgcgaattctctccacacacaacagtctcaggtgttgccagtgcagatgctgcccctggggcagaaaagcaaagctgcggctgcagacccctgggcccccttggctggtctagctctggcaggagactcatcacctgtgtgtcctgcccctcacccgcacctaagtttaacttcatgcacaccccaccctgttctaggccaaggatgagctgaacgagagagaggagacccgggaggaggcagtgcgagagctgcaggagatggtgcaggcgcaggcggcctcgggggaggagctggcggtggccgtggcggagagggtgcaagagaaggacagcggcttcttcctgcgcttcatccgcgcacggaagttcaacgtgggccgtgcctatgagctgctcagaggtgaggccagtgcttggagggacggccctgggaagacgggaggccatgaggatgctatccgctctcatcctggcactgaacaggcctgcttccatactgtgggcaagtcagtttctctgagcctccacatccttacctgtaaaatgggtcagctctgataatgagcgaacgaatgaatgaatgaagtgtgtcaggagcagatttctggaggtctgagtcctctcaactctctcccagtcttgggattcaatgagtaaaacttgggtaccccatttgggtgacgaggggaggaatttcccctccagacccccaccatgagaacctaagctttggctctggaatgctgcaggaaggtggatagtgcctctctcagggcagttacctaagcctcatgtgcagtggaactgaagatggtgtcagacctgggaatgaaccccggggacagaaccgctctggcactgctggctggatgaagacaggatgcctcaagaaatcatcggccggttgcggtggctcacgcctgtaatcccagcactttgcgaggccaaggcgggcagatcatctgaagtcgggggtttgagaccagcctgaccaacgtggagaaaccccatctctactaaaaatacaaaactagccgggcgtggtggcgcatgcctgtaatctcagctactggggaggctgaagcaggagaatcgcttgaacgcaggaggcagaggttgcggtgagctgagatcgtgccattgcactccagcctgggcaacaagagcaaaactctatctcaaaaaagaaagaaagaaaaaaaaaaagggggtggttccctcaagaaatcgaatcttgggcactggtggacggaaatggggtctgagtgggccctctgcaggctaatgattttccttttcctacttcttccttctccaaatggtaattcagggccatgctgtgccaagaactgttttaggccaagggatgcagtggagacaaaacagacaagttccctgccctggtggaactcatattctaatggtggaaacaatacatccaataaataaagtaaaattatatagggttaaataatggtaaggaataaggaaagaaattaaggaggtggatataaagtcttgaggggctgaagttttagataaagtggccagggaagtcccagtgcaaagggaattttgaagaaaaacccgaaggaaatgagatatctgtggggaagagcagccagggcagaggcaacagcaaagacaaaggccaggggttgggaggtgcccagagtgttccagagcagtgagcaagttgatgtggcagtctcttggcagaggtgcccaggtcctctaggggctcaaatttggtggtgcaggccacagaggtggggaactgctcaggatgggtaaggatggtgtttgtggaccgtagaggtgctgctggaatcaggagctctgtgtcctgcttggggtttggattttacttgggagcttctcctcagccctgtgcacacctcaccactcagcttatcctgtgcccagctgaaaaatctgtgtcttgtccccatggggaagaaaataacaagtaatgattatcctcatatttaagactatgcctcatgtttgcccaagcttatgatgatgtttacaccttgaatctcatttgattgccacaacaatttggtgagataggccactatctagactatctagaatagataggtcaatatcgagatcccattttttggagaggaaacatggggctcggataggttgagtagccagctcggtcacacataggacctggcaggaggccaggtctctgagtcccactaggagggatggggtagggatgggatggctccctgagggggttcctctgctctccttcctccaggctatgtgaatttccggctgcagtaccctgagctctttgacagcctgtccccagaggctgtccgctgcaccattgaagctggctaccctggtgtcctctctagtcgggacaagtatggccgagtggtcatgctcttcaacattgagaactggcaaagtcaagaaatcacctttgatgaggttagtgggggctcgcctggctcccaccctgtgggctgggttccctccctcaaccctggcctctactgggccctcattcctggttctccaggaggcaaggtctgtagagggggaaaggtgggcagccacctgccacctagccctttccaggcagggagagaattcctaggatgtgccagggcagctggaaaacccagtagctttgcaggtggagcttgatggtcaataatacatggctcttcctgggtatccctgccaagtgccaagtgggggtaacagctgtgtgccatgagctgggggctgccctgccacatgctaaatgctgagagcaacagagagaacagggattagtggactataggctggaagagattctggaaagcacaggttccaatctatttaggagcccgagttctttgtgctcatatgtacgcaattttgcttgtctgagccgttaagggggctgccccaagttggggaattagggtttgtcttgggagaactttggcatgcgccactgagcctgaaaaagattcctttaatttaaaaaaaaaaactgctacaaacttattttattttatttatttatttttgagatggagtctcgctctggtcacccaggctggagtgcagtggcatgatcttagctcactgcaacctccgcctcctgggttcgagcgatcctcaagcctcagccttccaagtagctgggattacagacgcacgccaccatgcccagctaatgtttgtatttttagtagagacggggtttcaccatgttggccaggctagtctcaaactcctgagctcaagtgatccgcccacctcggcctcccaaagtgctgggattacaggcatgagacaccgcacctggcccaaactaattttagataatgctatctagttgtgccaacacaatttattaaaaagtccatcttttttcaatgacttgaaatgccatctttatcatgttttatattttcgtatgtgcttggtctatttctggactttctattctgttccattggtctctttatctattcatactccaatatcatactgtttcgatgatagagattttgtggcatgtttaatctgttagggctagttttgtccttagtgatctgctttttggggggcttttctagctacttttgcatgtttatttccccctatgatcttcagaattaatttgtctagctttaggagaaatattaggagtatgttttggggataatattaaacataaataacaagcttggggagagctggcttctttcagaatgtcacattcctggccagttgtcctatccacaaatgtgagatgccttctgttttcttcaagcctacttttgagttttcaggagtgttttaaagatttcttcataagctatgactgtgctactgcacttcatctggggggacagagagagactctgcttctgaaaaataaaaaggttttaaaaattttttcctcacaacgttgtgcacatttttcattaaatttgtcttaggtattaattttgttgtcattgctaaaaatggggctctttcttccattatatcttctagttggttattgtttgtataaatgaaggttattgtttttgttttttaattgtatatccccctattttactgaactcttttaaaatttatgttagttttataatggattctctggggttttctaagtatactataatactatctgtaagtagaggagatagtttttcttctccctttccacttcttatgcccctgatttttttttttttaacaaattgattgcattggttagtactttcaatatagaattaaatggtggcagagatggtgaagtctttatctaattcctgatcttagtaaggatgcctctagggttttcccatcaaataagacactggctgtaggactgaaatgcacacctgcctatctgtgtgtattaaggaagagacttaaatatatgttttttcttattacgtaagtgatatctactcattttagaaaatacaaaaaattggctgggcgcagtggctcatgcctgtaatcccagcactttgggaggccaaggtgggtggattgcctgaagtcaggagttcgagtccagcctggccaacatggtgaaaccctgtctgtctctactaaaaatacaaaaattagccaggcatggtggcaggcacctgtaatcccagctacttgggagactgaggcaggggaatcgcttgaacctgtgaggcagaggttgcagtgagccaagatcgcaccactgcactccagcctgggtgacagagcaagactccatctcaaaaaaaaaattacaaacaaatttaaaatcatttgcaattctactacctagagagctctactattgacatccttccaatcttttcatacatgtatgcacgcacaatacacacacacacacacgcgcacacacacacacatttttctttttttttttttttttgagacacagttttgctcttgtcgcctaggttggagagcagtggcgtgatctcggctcactgcaacctctgcctctcaagttcaagtgattctcctgcctcagcctcccaaagtagctgggattacaggtgcctgccaccatgctcagctgatttttttgtatttttagttgagatggggtttcaccatgttggccaggctggtcttgaattcttgacctcaggtgatccacctgcctcggtctcccaaagtgctgggattataggcgtgagccaccgcacccagcccacacatttttcttacaataatgggattatattctacaataatatatcatgcacattttcctgtattattagtcttctgtattgtttttaattgttccagagtattccatggcataaatgtaccataatttcaccagttcccattgttggacatttaggttgtctccaatgttcccactattgcaagagtactgggataaaccttctggcctctaagcatggatgtgacatttgaacttgttttcttggtatacattcacagaagtggaatgtccgagatcaaagcctgcagcaaattaccccagtgaagaatgtaccaattagctctcccctcaggacctcaagccttaattattgttgcgggttagatcttacagcctgttctctctgtgcccaagatcttgcaggcatattgcttcatcctggagaagctgctggagaatgaggaaactcaaatcaatggcttctgcatcattgagaacttcaagggctttaccatgcagcaggctgctagtctccggacttcagatctcaggaagatggtggacatgctccaggtgaggcttagagttctgtcgcacggcagcctcccacagctggggaggctgagaggctgggcctcctttcatggtgcttgcagggaactgagaagttggaccacctcgcgccataaagagcagtgacagccacagtcccaaccataagcacctgcatagtgattgacagtttgccaagtattccctttcattcttccatcgactccttgagagcattctctccctccttccctgcttcatttttcaaacctggaaacgaaggctcagagatttaagagacatctcgaggtcacacagcaataaagcggcagaggccagacttgaacctgcatcttctgacctggaatcccatgttgtctgtccacatatgtcgcactgcctctctttgaatgtggattcaccccgagaaagggattatcactaaccctctgataactcactcctatatgtgctgacatgtcaggagtcctttcttagagccatcttagatctgctctgtgtattgggaaaggaggggtgggaggtggaggttgtgggaggggctgatggacaatgagggatgataatactgttcctgtcgtttgtaatagtttgcagtcccttcggcaggcaagtgggtttgaaaaaactcaccaaaaggtcaagcaaggctactttcatttcttttcctaattcccagtttaatttgcatcagcagggagagggttgggtcttatgaatcttggggcttcctccgtgcagtctgggccacagtgagccagggatccctagttgctggcctggaaataggaccttcagtgggcccttctccagggcagccctgtgatgctggacaagtctgttctatgccatgaggagaggcagcagggaatgagtgggagcctctgaggtcactggggccatggggaacggggtatctctctgtcaccgcaggattccttcccagcccggttcaaagccatccacttcatccaccagccatggtacttcaccacgacctacaatgtggtcaagcccttcttgaagagcaagctgcttgagagggtgagtacgtgggccgcccagacaatgagacaagagggctgagggtggggcctcacctgagccctcctcacactctaccatggtcctgagctatgtggatcccactgacacccaacatggagacctgcggagagaggtgtcgccaggcaaagactgcacatgatggggctttgtcctcctgcccctttcctccctcaaccctcatccttagggcacctcctcctgctcagttctgtctcccttgcttccctgcaggtctttgtccacggggatgacctttctggtttctaccaggagatcgatgagaacatcctgccctctgacttcgggggcacgctgcccaagtatgatggcaaggccgttgctgagcagctctttggcccccaggcccaagctgagaacacagccttctgaaaacatctcctgccagctgaactgtagttagaatctctgggcctctcctcaactgtcctggacccaaggctaggaaagggctgcttgagatgactgtggtccccccttagactccctaagcccgagtgagctcaggtgtcaccctgttctcaagttgggggatggggaataaaggagggggaattcccttgaacaagaagaactggggatagttatatttccacctgcccttgaagctttaagacagtgatttttgtgtaaggttgtatttcaaagactcgaattcattttctcagtcatttcctttgtaacagagttttacgacttagagtctgtgaaaacaggcaaggagcccgggttaaaatatccccctattcgcccccaaaatgcaataaaagaagataaaagagagaggatatatgttcaaatgatttggcaaacgcagcagtcctggtggcctctaggcaggctgggagttttccacacagaattccagggtggaagaggcctggaagtggcttcattcaggggtggcctcctccccttgctgaggtgcagtctgacgtgtgtggggtggtcaggaacttggacctctttccagggtggcagtcatgttccctccatctgtctgggagaaggagtctttccaccaaaagctgtctcctccagtccccttgcctggatggacagttctacttcgaattataagtggcatcttctctgagcactcactcagtcctcaagttatagagttaaagctctttttttgtcttcactctcaggcattttacggtgatgaacttacactttccaaatctgcattttttttttttttttttttgagacagggtctcacttgtcacccaggctggagtgcagtggtgcaatcacagttcactgcaacctcaaactcctgggctcaagcaagcctcctgcctcagcctactgagtagctgggactacaggcgcataccactgcacccagctaatatttacatattttttgtagaggtaagtgtctggctctattgcccaggctggtctccaactcctggcttcaagccatccttccacctcagcctctcaaggtgctgggattatagttgtgagccaccatgcctggcccaaatctgcatattttgacaaatacaaatgctttccttctgtggagttggctttcctcaagtgcttggtgattttcaggtgtgtgctcatttctgtaggtgagaatccctgttagatgccctgtttgctgagcatgctgttccctcttgggtaagtgctggcttcttctgggcatgggtctcctgagcattgacagatactttttccaagatgctacactcattttcccacatggaagcagacgctggctggctagtggcagtaggcgaggcttgttgttcccaccaaggcatcccagtcaatcaacccaagacttgtctgctcttgcctgtagggtcacccccattctttgtgggtatcaagcacccttagtgctgcacctaccttttgggccaggatattccaaccgttttctggactttggattcaattcagtcctatctgctttcacacctttgggaatttctctgatccactgagagttctctttcttgcttttcagtgaggctgtgtacatgttcatgtatatgtcaatgtatacatatgtgtgtgtgtgggtgtatatatatatatatttataaatagatatatatatgcacttatttcttacatactttcttctctcactcctagggtttgtagtgtatgctcattacccaagaaacttccttctttataacattcacagtcaacaagccatggtcataaaatccatgaaaacaaaaatggtatttacataggactcctaggctggaggaggaatcacagcaaattattatgggcagaagggtaggagatcaaccagtgaggattttgtcccaaaagttgaggcttcatttttgcaaatgaaatctcacatggaaccttggtatttaaacctaaaaagggcaggcatgtggctcatgcctataatctcagcactttgggaggccgaggcaggaggattgcttgaacgtgggagtttgagaccaacctgggcaacatggtgaaacccacctctacaaaaaatacacaaattagttgggcatggtggtgcacgcctgtagtccccactactcaggaggctgaggtgggaggatcacctgagcccaggaggtcgaggctgcagttagccatggttgtgccactgcaccccagcctggacaacagagggagaccctgtatcaacaaaacaaaacacaacaccaacctaaaaagaatgaagctgctctggtagaaggggcctcaccctgagagatcgcttatgaacatctggagctaagaaggtatttcaagtacgagaactgtcaat

SEQ ID NO: 15519 - DNA, 19203 bp, Human
  misc_feature (1)...(19203): n = A,T,C or G
gaaatgaactcatctagactgctgccatggagatggtgctctacagtagccctgtcaatcgctggctggcttctgcctaggtaagtctgccttgaattcatggtggtatgttatgttacagtggtatccatcttggtacttttgtcctctgcaatggtgagtggtggggagtttgggaaatactacctcttctaagaggtttgtgtaaaccttaatggtgtcctggtaccaccctgtgaatccttctttgtaactaatgttttccaccccagagcctccacattcatgagggatgccaaaaatcgaagaagttcttcgtagatgtacagcccagcacattcacaactgagcattgttgcctgacaattcatttattcaacaatgaatgtttgagtgccatgcatggttttgggtatccacttgtgagcaagatgacctaggtccctgctctcacttggtggaggggtagggaaagcaggtaggtacggagaaggaaagaagatagaactctatgccctgcaagctactgctagaaaactaacacttctgtcttccctcgggactctcctaggccctttcaccacttctcacctctcacccacattctgcactcccagctaaagcagccaaaggactatttgatttggcagagctttcaggcacaaagccctatgttccctctggcccaaagccactactctgaaggctgaaaactgccctttggctcaggttgctgtccagtcacagcctcacagataatttgtgctgaaccttgaggtgagggcagaggccacttctttaaatactttgtcttctctactgccttacatttgaaaagcacaggttggatcaataagtattaaacgtatagcgtattactcctttgaagcctccctgcttgactcctccctttcctgccttctcattccctactttattgcatcacagatacgtaatttattaccaaggatctttcataattccccacccctgcctctttcttctcttgcccacactgtgtgacttaacagagtcaacaatacatataattccaccagcaacaaagaaaataagttttgttttcctattgtctgttttcatgaagaggcccttcttagttaatctgaaagctatggcttataccatagtcctccatcatatctaaagccaggaactagaacttgggcttgtgcttgagtcctgggtaaagaagggttgagtggtgctaattcttggctgtctgggtgctcttgattagtgatagaatcctagtcaacactgtcgcttatccagacccaggagaataaaaatctacttggctctcctactcttcattctggtagcatcttaggccaggtaaagttcaataaatttttttgaattctaagaagtgggaattcctccctcaactcaaaggctatattgtcaaaaactcaactcccggctctgtcgcttcttcactgagggcaatttatctccataatcaaagatgaatacattcagatgaactcttctgtgtgggtttaaattttactgttcagcattcagtcttgctagtaaataagaaaagatgagagaaatggattgaaaactcccacaagaccctctatggaaaaggagccaaaagattgcagaggtatatagaactttagagcttttgagtttaatgatgtctatccctataccttctttctggaaagcagatttttgtgaattgagggcaggaacattacagaactgatgcttcatggctctggaatactaagtcctctgagcctggatctccttcagctctgccacctacctccttgtttgctaaatgtccttagagaagttaggatatgcctggggaaccctgggtcatataaccatgacaactggctgaccctgttgtctctccctctctgccctcctctagctgggaggtggaagcagcattgcccaagcctcccaggagtgacaggaattgtttctgcctgaggagacactctgcagcctgggctctgtgagactgaggtggcggtcagccggagtgagtgttggggtcctggggcacctgccttacatggcttgtttatgaacattaaagggaagaagttgaaggtaagggcctcttggggattttgctggggatgaaaaactctgcagggaaactactgagggagagattctggtatagataccagaatctagaaatagaggaattggataggcacagtggatcatgcctttaatcccagcactgcaggtggccaaggcaggtggatcacttgagcccaggagttcaagaacaacctgggcaacacagtgggatcctgtctctataaaaaaagagaaaaaattagccctgcattgtggtgcatgcctgtagtcccagctacatgagaggctgaggtgggagggtaccttgatcccaggaggtcaaggctgcattgagccatgatcgtgccaccacattccatcctgggcaacagattgagaccctgtctcaaaaaacagatagggagagggggagagggacagacagagagaaagagagaaatagaggaattaacccagagccttttcaaagatgaaacctttaacttgtttatttatttttttagagatgggcatctcactgtattgcccaggctgatctcaaactcctgggctcaagcaattctcccatgtcagcctcagtagctgggattacaggtgcttgccagtgcacccagcttgaaacttcttgttttagtctcttttggaccctcatttaagagccttaagattttatctaaaactttttatctcttatggctacctgcattttttatttcctaacctgaactcctttttttttttgagacagagtctccctctgtcacccaggctggagtgcagtggcaggatctcagctcactgcaacctccacctctcaggctcaagcgatcctcctgcctcagcctcccaagtagctgggattacagctgcccaccaccacgtctggctaatttttgtatttttagtagagacggagtttcaccatgttgcccaggctggtcttgaactcctgaactcaggtgatctgcctgccttggactcccaaagtgccgggattacaggcctgagccaccgcgcctggcctcttaacctgaactcttataggaaacattattcttggccgggcatggtggctcttgcctgtaatcacagcactttgggaggccaaggtgggcagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggccaacatgatgaaaccccatctctactaaaaatacaaaaattagccagtgtggtggttcatgcctgtaatcccagcactttgggaggtctaggcaggtggatcacttgaggtcaggagttcgacaccagcctagccaacatggtgaaaccccatttctactaaacagaaaaaaaaaaaaaaactagccgggtcgtggtggtgggcgcctgtaatcccagctacttgggaggctgaggcaggagaatcccttgaacccgggaggcggaggttgtagtgagccgagattgtgcaactacactccagcctgggcaacagagcaagactccatctcaaaaaaaaaaaaaaagaaagaaagaaaagaaaaagaaagaaacatcagtcttgacaagtaagctatggagcaactcattgctatgggaccctaaggagtggggctattgtgtgtgatattcaccctccaacctaatgccttctgttcagggcaaatgggcccccaggcagcctgggcctagttggtggccatgagaggtagggaagtgacccagtggagctcaagcctgagggcttctgatgggacctgggactctgttttgcagcttgaggagcgaggatggcagtcaacaaaggcctcaccttgctggatggagacctccctgtaagtaacttgggctcatctgtgacaggggatggacaactgagggaggaggaagaagcagggaggggagatgcaggggacttagagcaagatattcccagattataatcctagttcattgactaccatggcttagttattcttgccctcaccaccttttgtagggggcagttggaggatctgggaggggaaaaaaagatgcctattaaaaattaagcaccttgaaaaaaagggacagaaatcctggcttagggacggggggagtggagaggaaggaaactactgtttaaaccctgacgcagaagcccatgctctgtccaccacccagctggatgtgcattcagtgcagagccactgtattctgtgtctccagcatcattcataacggcaaatgtcacctgtcggagttagacggtgcacagcctgtgctgctgtgtggggggaagggtgggatattccatgtgtctggtgttctatctctgacctggttttcactgtgacttgaagtgatttgatacttttagggatgcttgatggctcctggcaaggcatctcagatttgggcacagttcggatagtgaaacttaaaaattatgaacctgtgcaatatccaccttgcccaagttacgcttttactaactcctgcactaggaatcactttgttttgtattgaatcatagaacagagagaggcgtaaaatggtcaagtacatggttaagccattctaactgacggtggtttattcccttcccaggatctctttcctccttcggttttgtgtaaaacaacctctgaagcctcgtccaaaatgttaaaaagaatgttttcttgtttatagtcatagtctatttctagttcaaatttcaaattcacctgcaggataaaaaactaagatattggccaggtgcagtggctcacgcctgtaatcccagcactttgggaggccaaggcgggcggttcacaaggtcaggagatcaagaccatcctggctaacacagtgaaaccccgtctctactaaaaatacaaaaaatcagcggggtatggtggcgggcgcctgtagtcccagctacttgggagactgaggcaggagaatggcatgaacccaggaggcagagcttgcagtgagctgagatcgcgccactgcactccagcctgggagacagcgagattccatctcaaaaaaacaaacaaacaaacaacaaaaaaaaactaagatattgtgggctgctctgtcttagtgtacatgtaggtgtcattgatgggggtctttgaactctgcctcctactaacagaacaggtcaggtcttcactttgcgagcaaaaccatgccacagtgtcatattcaaagctacagagagcctgagcatcggaatctgacctgggttttttttttctttttacttttgatatggagaattctcaacattcataagaatagacagaaaagaacataggaagccccacgtaccctttattagccccgaagaccatgaattcgtggccaatcccgcctcgtcctcacttccattaattcccccacttcatgttattttgaaggtaatcccaggtaggccatttccaacttgtgttggaatcctggctctgccacttatcagctgtgggatcttgggtaaatcacttcctgtttctgattgtcaatctcctcatcgactcagtgttggtgacagtgctgaccccagaggatggctgttagaattaagtgagctcatgtcaccaaggcacccagaccagtgcctgcagcataatggcacctggcaaatgttctttccctctgcatgcctagaatttgttcttttaattttatttatttattttttagatatagagtcttgctctgtcaccccggctggagtgcagtggcattgtcatagttcactgcagcctcggactcctggtctcagacagtcctctcacctcagcctccccagcagctgggactgtgtagtccacatgccatcaaatattagcatggccagcttttttttttttttttttttttttgtggctcagagtggtctcaaactcctggcttcaaatgatcctcccgcctcagcctcccaaagtgttgggattacaggcatgagcttctacacttagccctagaattcattcttttactcaaagaccagtgttttttcactaaggttcctaggtgacctaaaacttaattatgtgactgctgccaaaggtgcattactaacagcacagcaccccggaaatgataaacgattgttccactacacccagcacgtgcagatcgcacccagagtgctgtctttgagtgttgtttgtttgttttttgttttttgagacaaggtgtcattctgtcatcgaggctgtggtacagtggcgtgattatggctcactacagcctccaactcccggactcatgcgatcttcccgcctcaggttcccgagtagccgggaccacaggcacacagcaccatgccctgctaattatattattattatttattatttttttttgtagagacggggtctccctgtgttgcccaggctggccttaaactcctgggctcaagcgagggtagtatatttttaagaaagataatgtaaaactgtagcatgtccaggagagggggtcaccagaccacagtgtgaaccatttgtaaacgaagttaggaactggagccatttaacatgatggcggcacttctaaagggagacatatttgacttcaaatatgtgaagggccaacccatggatgaggaaataggtttgctcagttttgttccagagggcagagtgtggaacaggggggtggaggcaaatttcagctcagcaaagctgtccaacaagggacacaggccactttgtgagggggagagctctcattcagggagacattcaaatataagtcttggctgggcgcaatggctcaggcctataatctcagtgatttgggaggctgaggcagaaggatcacttgagtccaggagttcaagaccggcaagacccctcctctacaaaataaaaatattagcaaggcatggtgtcacaggcctgtagtcccagctacccaggaggcacaagtgtggggactgtttgagcccacgagttggaggttacagtgaactatgatggcactaatgcacttcagtttgagcaacagagtgaaaccctgtctctataaaaaataataaataaataaaaacaaatacaagtcgaccagaggaaggatggaaaggattcttactacaaagtcccctaagattctgtgattctgtgcagttgggcagatctaaacctacacattctactaggcacagccctgactgtggttcacgtattcagctaatattactgtgccatgtttggcctacactctggggatgcagagatgacagtctacggggagtgagatgaacacacataaccacagcacggtgtgacgaatgtggagagagccagggagggagtggtttccgacgtgatggaggagagtctggaagcttcacagggggagtgctggtcaagcagagtcttgaaggaatggcattctgccaggcagcaagggctgtgggagggaaggtgagcattctaggcagtggggtcgggatacacaggcagggaggcagtaccccagaaagaccagaaaaatgtttggagaagccaccaatcaaaggtggactaaaactctagacattaacaacacttgctctctaccagtaggtatcaggggagtgagctgaggtgggggtgggagtgatgggatctgacttggtccctggagaacagagattgccttggcagctctccagcaccccggatggtgaccaggaggacatggccggctgactcttgttttccccatgggctctcccacgctcccatgattggggcatctagagacctctttggccttggttcctcccaggtcgcttggactcaggctagttgcaccattggtccccatgaccccggggtcagcttcccgggaggctggagagggaggtgggacaacttgaatgtgttccttccgcaccaggagcaggagaatgtgctgcagcgggtcctgcagctgccggtggtgagtggcacctgcgaatgcttccagaagacctacaccagcactaaggaagcccaccccctggtggcctctgtgtgcaatgcctatgagaagggcgtgcagagcgccagtagcttggctgcctggagcatggagccggtggtccgcaggctgtccacccagtgtgagtccttgcggcgctcagcagctgcctgcttgttcactgcctaccttccagtctgtctgtccgcctctcagtctgtctgactgtctgataacttgcttgtctgtctgcttaactgcccacatcccattgcatggtcttcttatctatggctataaaggtatacatacagatctcttttcttctatagatgcctatctatggcccagctggcattttcctaggataacaatgatggccagagaatctgcaggggaagggaaggcagagctgtgcaggcagtggtgagggtagggcccatggcagaccagacactcactgtcgcagcacaggcagcagcagcagcaagaaccagcagagtctggcagaggcagaggcagccggcactagggggcctggcagggccggagggcacggagggaggggaaagctggctgagcccagcagctgatggtagcggctcatgacgggtgggggtggcagagagcctccagccagggccctagaggcagaagatggctctcctactggccttaccagatgtgcaccactcaaattgttctgccccatctgaaaatgtggtctccaaggcatacacagggctgagggaaatcgcagcaatgccaaaaagtctggtaccttccaccatcctaattacagaattatgggtagctgaggactccacacagcaaacaggagaggaccgatgtgaagtaggcccaggccctgtccctggctacaatctccttaaatagtttccttgagtctcattctgcccaactggaagacagccaagtcatctgggctctctgctgcttgagaattttgtgaagaaaaataaggtatctggcaaaagaatatatgaaagagtatgaagaactctccttgaaagctgtggcccccattggccatggctgcagagccgatgtcccggccaatccaggcgggatccccttgaagcaggtgcatctctgatgcatgcccactctccgggggcaactcttttcccttccctgtgaccctcttcggacagttgaccatctcaacacctagtggttaaaaagaagagcatggacggcctggggcctgcactggctgtgctgggagtttgtcatgttgatagctaagcaggcccagccccaaggcctcactgccatctgcttccctctcacacctctcttctccctcctcatgctcactcagagcccccttgcaggtcaggaaggaagagaaggagggaaagaacggtacttgttggtgattcatatagctcccatcattcttcttcacaaaaatcctgccaggcaggcaccattaattcaccttttacaaggtaggaagcagaggctcagacaggctgtgactagctgaggccacaggcttcttagatgtggtcacttggccttttgagtgcaggtctgagcgactccagagttcccacacagacagaagaaactggcccgggtcttgaggagtccctgcagacaagggctaaagagggcaaagggcctggggcccagagatgctggggaggcagcaggccttgggatttgagggctccaagtcacttccttggcacagaagccactgctagattctcatggggaggggcagggctcacccaaacttggccctttccttccagtcacagctgccaatgagctggcctgccgaggcttggaccacctggaggaaaagatccccgccctccagtacccccctgaaaaggtgagcccttcccacctctcgaagcctccctgcactctgtcgtcaccgcctctcagggaggagagggcaggggctgctgatgccgtgactggaagtctgtgtcccatggtgagcaccctccaaggctggcggagagtgcctgctcccaaggccacacaacaggctcctcttctccctgtgaagctaaacggaggtggggtttctgggaccagcaggcacgagcccagaggcaaacccaaacaggagcttgaggcgggtcccactgcctcccgataccgcaccctgggatctgaggttccatagtctgccctggaccacttggcaactacagctgcctaagatcatgagtcacactcattcagatcccaggagtgtcatcccatatcctcaagatccaaccttttatggaccatgagattgaaggtcactttacctggctacatatttattgggtagttgctatgataaggactcatttttggtgcttctggggaataagcttcagtctctgacctcatctatctcactgaccaactatctacccttcccacaaacaggtactgagccctaccctatgcccggggccatcacctatgctttatcaagcgctcttctttaatccacttgtcaaccctctgggataggggttgttatctccattttacagagaggaaaccagtgtctcccccacggccacacagccttaagtggggacaatgagagcaggtctattcagctgtgagacctgtgctctttgctccccatttttccagataaaaggcaacatttttgtcacaaaagagctcccagaataatgaagaaaaagacaaattatttcagtgcagaacttgtaggaagatcaagcacacctataaatcaacagaaatgctgtgttctgaggaaaggatggaggagattccttgtgagcccaagggtatcaggacaggtggcaccaaggacgagcctttggggtcatcctcacaggatgggagggatcttgacaggctgtgatgcggggtgaagaagccaggagatccaaacagttggcacagggaaggttggagccctctcctctaaagcccagcttaattccaggtacctaaatatcagtaccagttccctgggcctttaggtgatgccttcctgggagctgggctcaggccaccagaccccggaagggcagcccttgtagggcctgcaagaccacatgcctaacacccccaccaacttcccccagattgcttctgagctgaaggacaccatctccacccgcctccgcagtgccagaaacagcatcagcgttcccatcgcgagcacttcagacaaggtcctgggggccgctttggccgggtgcgagcttgcctggggggtggccagagacactgcggaatttgctgccaacactcgagctggccgactggcttctggaggggccgacttggccttgggcagcattgagaaggtggtggagtacctcctccctgcagacaaggaagagtcaggtacctgccattcggaggctcggcctgggagtgagttgtcacacacactgcctgggaatcagcaggaggtggctcatccagccactgctctggaatagggaaggccagtgggattttcagatggattcataatcatttaccccccccacccccaccccatctgtaaagagggaaagtgagttgtggaactcaccagtgagtttgtggtggacctagaacacctactttccagtcctagacatgacccagatctctccggcccctctctgacctgttttctcttctttccccccaaatccctacccagcccctgctcctggacaccagcaagcccagaagtctcccaaggccaagccaagcctcttgagcagggttggggctctgaccaacaccctctctcgatacaccgtgcagaccatggcccgggccctggagcagggccacaccgtggccatgtggatcccaggcgtggtgcccctggtaagtatctgccgtgagctctgactgacccggtgcctgggagccctgtgggcctcctagtccctcccatcccccacccatcaccccttcctgtcctgagaacattctctcttccaacctgggctggggcttcagttctaagaggacttgagaggggtagagggatggccttccagaccacagggaaagagaagggagaggatgttaagcaagggcaggcctgccttgctagagtgctccttccccaccactcacttctatctcccccatttccctctgagtctcccacaagccccagccttcatacccccaagtggacctctttctatgggtcttcccacctataagacagcaggacctccatctgctatgcaagcactagggactgtcatccttaaataaacaaagtatacaacccattttgtcagggagagtgtacccagcaccaatgcacccaaggtgaagttgccctttctaggcccagggagagttaactccccaccactccccaccactccccacctccacctctctgtatcttagcagaaataggctggatgtttttcataaggaattttagtaagaagctaaggccagaaaagaaaataaaacaatattaaagcataaaggccagcaaacaagatgactacttttcagccatcttttgagcagtacttttaaaagcatcatcaggcgtggatcattcattcaagcaagtgttgcccctgcaggaatacaggagtagtagctcccctctgtcccctgcatcaataacagctgagactgagtcacatgcctggaccccgcctgcagtgggcagaacctcacgtgccaccattcgcatggaatagagtggcatccccaaaagctgtgtaataaggagtctctgtttgtggggctccctagaggtttagaatgtgcctcaggagataccagcccccttgctcagtcaatttcttcccatgggacactctggttcattgaatttttcacgcttaaaagatctgggaggagtatctaccaaagctaacatacatatatcctatggcccagcagttccactcttaagtgtatacccaacagaaatgagcacttaagtctcccaagacaagtgaaaaatgctcagatcagcaatatccttagctaagaactggaagcgatgataatgtccatcaacggtagaatgggtaaattacaggaaattcgtatgatggaatattacacagaaatgaaaaagaaggaactacttccatttgcagcaacatgggtgaagcttacaccatcatatttaactaaaggagctattaatagatgaatacacatggtgtgactccacttacatgaagttcgaaaataggcaaaactaaggcatggtgacagagagcaggactgtggtcactcttgggggaatgtggactgagtggggacacagggagtctttgggtgttgaaaatggtctatgtcttgatctgtggtggttacacaggtgtgttcttataaaaattcatagagcttacactaaagatgtgtgcactttagtgtatgtagattaccactccataaaaagtttccagaaaagtctgctggggctgagccctgctcaccacctggcccggaccctgggggcgaggggcttgggctgctggggctccctggccttcagcaggggcagttgagccagcaatctgctgccatcctccctcagagcagcctggcccagtggggtgcctcagtggccatgcaggcggtgtcccggcggaggagcgaagtgcgggtaccctggctgcacagcctcgcagccgcccaggaggaggatcatgaggaccagacagacacggagggagaggacacggaggaggaggaagaattggagactgaggagaacaagttcagtgaggtgagggggagagtgggagcctcaaggtcccccagcccacagaaggggtgagaagcagaggcatagggtgaactcagggcctctgccccagatgcaggggcacggcatgtgcgtgcaacacccttcaccccacccccaaatgcccagctggcgagggacttccatgtcattctctcagctgacccttgcaacactctgtaaataggcagggcagagattattgtcccattttgcaggagaagaaacagaggttcagagagggaatgtgacctgtccaaggccacactgctagtggcagaataggcctgaagttttgtaaatttggtattctcatgctttcccctctagccctggggctggtggggagggaagggtcaggggagttaccacaggaggcactgaccctgctttggcccccaggtagcagccctgccaggccctcgaggcctcctgggtggtgtggcacataccctgcagaagaccctccagaccaccatctcggctgtgacatgggcacctgcagctgtgctgggcatggcagggagggtgctgcacctcacaccagcccccgctgtctcctcaaccaaggggagggccatgtccctatcagatgccctgaagggcgttactgacaacgtggtggacacagtggtgcattacgtgccggtgagtaccacccctggcaaactgttagtgtcccaagggggcctggacatggcagataaagtagatttgactgaaggggctgcagtccccctcctttcccctactcctctggagaccgccccccactccagtcctcagtgccctggcaacattttaacatactgggcctctcccagccccaggagtatagaggcccatggctctggcctgaggcctctccccacggcccctcccacctgctggtagaggagtctccagccatcagtcccaggatcccagtggctcaccttcacccctttgctctcaactgaagggctgggcgggtttgcatgctgctgcctgggaaggggttggagaggcttccagggcaccctgaggggtgggccatgagttccaggggacagcagcaggctccacccaattctatcacctgtcaccaataggaaaaacccaggggataccaatgccatccctttgggagcccctttccaaagcaggttacagattatgcaggcctggggggcggggctggtcagggcagaaagcacccttagagctggtaagggggtgggttactcagtcactctaccaagcagcatgccagggatcttagcagcccgcctgttcatcctgcgctcgggccagccccaggaaggtgtaccggtccctggccaggtcactgtgtgggctgcaaggaagagttaggaaagctgatgacctcccattgagggttcccctcaggaaggcctaggggatcctgaaactttgggaggcttggcttgcctgagcagcctggtccatggagaagctcagagtgggcaggacctcagggctttccccggtgccccccaaactactgaaccgctccccagcctgtgtcctcctgacggccgctcccgggggaacaatcgaggggcccgggaaggggcggtgggtcagaggcgcagggcccagggccaagccaggactctaaggcggctgccgggccctcagctccccaggctgtcgctgatggagcccgagagcgaattccgggacatcgacaacccaccagccgaggtcgagcgccgggaggcggagcgcagagcgtctggggcgccgtccgccggcccggagcccgccccgcgtctcgcacagccccgccgcagcctgcgcagcgcgcagagccccggcgcgccccccggcccgggcctggaggacgaagtcgccacgcccgcagcgccgcgcccgggcttcccggccgtgccccgcgagaagccaaagcgcagggtcagcgacagcttcttccggcccagcgtcatggagcccatcctgggccgcacgcattacagccagctgcgcaagaagagctgagtcgccgcaccagccgccgcgccccgggccggcgggtttctctaacaaataaacagaacccgcactgcccaggcgagcgttgccactttcaaagtggtcccctggggagctcagcctcatcctgatgatgctgccaaggcgcactttttatttttattttatttttattttttttttagcatccttttggggcttcactctcagagccagtttttaagggacaccagagccgcagcctgctctgattctatggcttggttgttactataagagtaattgcctaacttgatttttcatctctttaaccaaacttgtggccaaaagatatttgaccgtttccaaaattcagattctgcctctgcggataaatatttgccacgaatgagtaactcctgtcaccactctgaaggtccagacagaaggttttgacacattcttagcactgaactcctctgtgatctaggatgatctgttccccctctgatgaacatcctctgatgatctaggctcccagcaggctactttgaagggaacaatcagatgcaaaagctcttgggtgtttatttaaaatactagtgtcactttctgagtacccgccgcttcacaggctgagtccaggcctgtgtgctttgtagagccagctgcttgctcacagccacatttccatttgcatcattactgccttcacctgcatagtcactcttttgatgctggggaaccaaaatggtgatgatatatagactttatgtatagccacagttcatccccaaccctagtcttcgaaatgttaatatttgataaatctagaaaatgcattcatacaattacagaattcaaatattgcaaaaggatgtgtgtctttctccccgagctcccctgttccccttcattgaaaaccaccacggtgccatctcttgtgtatgcagggctatgcacctgcaggcacgtgtgtatgcactccccgcttgtgtttacacaagctgtggggtgttacgcatgcctgcttttttcacttaataatacagcttggagagatttttgtatcacattataaatcccactcgctctttttgatggccacataataactactgcataatatggatacgccttatttgatttaactagttccctaatgatggacttttaagttgtttcctttttttttcttttttgctactgcaaacgatgctataataaatgtccttatcaaaaatgtctagtgtacatgtgtggctatgtgtatatatatatatatatatatatatatgagatagacgcatgacttgtaaccatgacatactgggtgaaagaatatgtgcattttaagcattactagataataccaagtagcctgccaaaccaaaccctatttttctagttattttcacctgcagcttcagaaatatgcacagaaaattatgagtcttcagtcagtccttttacacatccatatatttatactcatcttccacaggtccccctcagacacataagcacccactctattagctcccactctattgcacacctggaagccccgctccctgaaactgactctgtggccctggaactgactctgtggccctggaactgactctgtggccctggcactgactctgtggccctggcactgactctgtggccctggcactgactctgtggccctggaactgactctgtggccctggcactgactctgtggccctggaactgactctgtggccctggcgctgactctgtggccctggaactgactctgtggccctggcgctgactctgtggccctggaactgactctgtggccctggcgctgactctgtggccctggcgctgactctgtggccctggcgctgactctgtggccctggagctgactctgtggccctggagctgactctgtggccctggcgctgactctgtggccctggcactgactctgtggccctggcactgactctgtggccctggcactgactctgtggccctggcagatctttggtgtaatgagtcatgggcctttatctgtggttttggagtctgaggatgccaagaatggtgacaggagagaagctggtagatatacacataaagacgtggccaggcccctgaaccagccatggaccctgaccaccccacttgcacgatataaactacacccagcagttccctggggggtggggagggaagatggggggtgaagttggcaagaggggttcttagaagctgatagaacagggctgagcagacagagcccagcacagccttggcagagctcccatggacagatgctggagaaatgacctcaggcctagatgtgcagaaagaaacgcctgcctgtcctgggcctcacccacccatgcagctttcttcctggtgctccggaaaccacattcctagctctttactcctccccggtcctgcggctcctcctgctaggctatactccggaaggcaggaaagctgcctcctcagccgcctgagggctgtggccgccaacatgcctgctggtcaggcccagttccttcacccagccctgggcctgagcacgggtgctggaggccgcatatggaataggacagcccaggaagcaaacagtgtaagttataagtttctttttgctcttagaaacctcttgattaggcagcaaggtacactaaacctgcttctcagtattttgaacacatcttggccagtaacaagggcaaagtagctcctctaaatggcagacatttgcttccttggctctaggctcaatgggggactttcctctgttctgcggggcatcactttggcaaggtccacccatactcagtatcttcagtgtagctcaggacctagcaaagacctccacttcacatcgggttgcccagggtccttcagagaaatacccaatgccttccatcctagcttacaaaacccgcttctaactcagccacagcttttggagatgcaaacaattacagacaataacatacatttatccaggcaattatttaccccttttccctcccataattttattttgagaccgtatcactctgtcacccaggctggagtgcagtggcaggatctcagctcactgcaacctccatgcccccaggcttaagcgattgtcttgcctcagcctcctgaatagctgagattacaggtgtgcgccaccatgcccagctaattctcacatttttagtagagacggggtttcaccatg

SEQ ID NO: 15520 - DNA, 29172 bp, Human
  misc_feature (1)...(29172): n = A,T,C or G
cctggctcacagggtgcatgctttgtctcgtaaaatctttctaggggaacatctagagatatgtattgaaacagctctgcctccaggaattcacagaaagttgtgcaaagacttacatatctggatgttcatgacagcatgatttgtaatactaaacaaataaaaaatgacctcatcgctcgtcacctaacactagggattgtctagataaagcacagtatatcctgctataaaagttatgttgtggcaggctgggtgtggtggctcatgcctgtaatcccagcattttgagaggctgaggtgggaggatcacttgagcccataagttcaagaccaccctgggcaagatagggagaccccatctctacaaaaaaaaaaaacttagccgggcgcggtggcgcacgcctatagtcccagctactcaggaggctgaggccagagaatggtgtgaacccgggaggcggagcttgcagtgagccgagatcaccccactgcactccagcctgggcaacagagcgagacctgtctcaaaaaaaaaaaaaaaaaaaaaaaaaaaattaggtgggcctggtggcacatgcctgtggtttcagctaattgggaggctgaagtgggaggatcacttgagcccaggaggtcaaggcagcagtgaaccatgatcaagccactgccctccagcctgggcatcagagcaagaccctatctcaaaaaaataaataaataaaaaagaaaaagaaaaagaaaaaaagttgtagaagtataatatgggaaggtgtttacaaaatatgaaaggagttaaaaacgctataaattagtatgatcgtttgaaacactccccctgctcccctccagcccctcttcaatgagctaggaaaagactagagtacatacaccaaaatattagtattgcctctgggtggtgggattatgagtgatttttactttcttctttgtgtttttctgtattttccaaatctctacaattatctctgtatttttaaagaaaaattagaaaatcaaatttattttgacaatatacagactaagcagacaatatacagactgttatactgctgaacagagaaacatggggatcattggcctcccagtgagatcagaaggaattcccagacctaaatattatggttaactcatgtcaagatcacagatcttaaccagaagacagttcctgactatggaccaatgaacttgtgaaaaactcttaaattgttcttacaatcctttatacgtgttttttttcttaaaacccttgtattttggaataattttagatttacagaaaagtggcaaagacagtccccatatagcccttactcagtttatcctactgttaacattttacataaccatgacatttgtcccaactaagaaaacaacatgggaacgtcactattaactaattttcaggctttatttggattttaccagttttccaattaacatcctttttctgttccagggtcaagtctggggtagcacatcacagatgtctccccaggccgctctgttgtgtgacagtgtcccaaacattccttgtttctcatgtgccctgtatgaatttcataatcagaaaaagaaaggacagatgatgatgcagatgatgatggcagatgatgatgatgttgatgatgatgacttaggtctgggaattccttctgatctcactgggaggccaatgatccccgtgtttctctgttcagcagaacaaaaggagaaaggccccagtatcaacgggacacacagaatttggggcaccctgatcctcctgcccactgccttagcctctgctcctgccgctgtcccccagcccgacgcggggaatcttttggggccctcggcttgggttgggcccctgccagttgggcgagcgcgcgggcggtgcccgagtcagctgctccgtgccccacgtggccgccccgcccccctgcccgggtctcaaaagccccgccggcctccgagcgtccgaaccgcccgctgccagcccggccaggcacccctgcagcatggcctggaacaccaacctccgctggcggctgccgctcacctgcctgctcctgcaggtgattatggtgattctcttcggggtgttcgtgcgctacgacttcgaggccgacgcccactggtggtcagagaggacgcacaagaacttgagcgacatggagaacgaattctactatcgctacccaagtaagtctcgccgcctgcaggcccagcggaggcatatccgcgccggtccccacctggccaagggctcggcccagagctgggcagaggaggggatctaccctgcagccgcggactccgcatctcgccggcctctgcagggcatgcgtgggaaattgtcagatgtgcacaaactccttttccccgtgaaaaactagtagggaaaacaccgggatgaggtttttatttgaccgccctcccagccgtcagagccccccaacatccctgtcagagagccctgcttggtatactaagaagatccgagtcctctcgccccattaccaaccagtggatgacctggctcccttgtccagaggagcgcttactccaaataagcgccagccctgctgtgggcagaggtgttgtgggaccactggtgggccaggaggccaggacacccacccccttttagcttggagagggaaaacaagcgcccctgaatcttctggtgtcagcggtgctgtggttaagagcatgaccctacaatcacacacctccctttctctcatgctctcgtggctcttgccacaaaccaggtggctggcctcaggcaaatgccaaccttcctaaacctcaatttcctcatctacagaatgaagataatggtaggacctccttcacaggggttggggtgaggctgtggcgaggaagtgcatgtaaagctctggcagagttggggtgggatcctttcttcataatggagcaattgctacaagagcaccaaacacaggtgccctaggactcaggagcagggagagctagcccaaggtcactctgagctgcccgacctctggactcccagcctggggctcttcccaaaatcagaatgcccttgtactttctgattttccactccatccgccatcagccaatgaaaattattctagccggtggtgttcatgtagtcattgactgttagctttgaaagggaccctaaagcccctctccagcagccgcctatatcaactggtattccctccacaccttagacattctcggcaacaggggattctctatctccaagaaaacaactgcacactttcagaatggcagcctgcatgaaaaaagactgcgtttggggggctgcaggcttggtgggagccagccatattaagtggctgccaaaaagttagggctatcatgggctgcatttaatagttacatggtgcctagaagggaagtaacagataaggggtgcgccccctgctggggagaccacagtttctcctgggctccatttagggctgttttttaaaagatatcttagacagctgcagccttgggattcaggctccaaatccactgttcacattgtccacctttcctctcctcaagggggggactttccagcaaacagtgaggcaggcaagcttgagaccctcctttacctgttcttctccctccctcccgcacttgcttcccacttgaccccagagcataaggggcaagaactcccatgggcgttcacaggtcctcaatgtgtctggggagtggaggacctcaagaccttaaataggctgggtgcgatggctcacacctgtaatcccagcatactttgggaggctgaggtgggaggatcgcttgagcttgggagtttgaagctacagtgagctatgacagcaccactgcactccagcctaggtgacagagtgaatctctatctctctccctttcaaaaaaaaaaaaaagaaagaaatgagagagagagagagagaccctataataggagctgcagaacctcaccagtggggaggtacagtccttacatctccccagctcttatcctcctcgcaccacacttgcccacccacctttcacaccccaggttaatgtgttcatgcaacaagtgcttatctgtagtgtgatcatacaatttatcatcatcagaggacacctctgagagtgaaggtggtgctggtagtaatttgctgggacccatggataagccatgactgtcctggcaaatcagggctatggtcactctggataaataagttgaatatcctgggtctctgtccccagactttttggaagcagagaggggcaccgtggcacccagggcctcagtgggaccaagtgctctgagcagaagtgatctgtgatggcttcctgggaagtggtggatggtgaggaggggagaagccgagcagccaagggggccactaaaagggggtggtgttgcgaggaggggcagtggttctgtgtggcccaagagtagggtttgtgaaagggatggggtaaggatgctaacagggggagagccccagcatcaaggagggccttgagtttcccctgctagttctcctggagagctcttggccaatggagcaggaagcaacagaggagaggggtataggggaagaatcttggcaagaagtagtggccacccctccaaccgcacgtgcattctctcctttaatcatcaccaccacctgtgagggaggtggtgtgatgacccccattctacagatgaggaaactaaggccagagcggagaagtgtcttgcaaaggtcactcagctgggaaaccagggagcgagaggagcagccctggggtctgagcccacactcctggcccactctcctccctagtctcaaccttccccctttcccccgctccactcaccgtggctgtggttaggagttagagggcacaaggcttcctggcccatgtgagtccccaagcctgggttcctgggcagcgaggtgattcctaggggattggggtgagggcaggctccaaggtgccttccctgttcctggatccaggccatcagcagctgtgcaggcctcgtttctactcaggggatgagtgaagcctgctgggcatctccagtttccggaggagtccagctccagttggcttggcccgagggtagctccccaggcatgggccctgcagcaggtagcaggcatggagccagctggggactcacgttggcagtgccctcggaggcccgtgatgcagccagtggctgtggttgctaagcacgcagcttccctgtgggctggtgctccagggtctgggtgaaccgctgagggcagtggcttcagggaggctggcccaaggaggagccaccagggcttggactccagaagctccctggaagaccaagggaggagtgggacacatttcgggagatgacccagggcggaggaagctctggtttcaaacaccgggaggactgtgtcatgaggccgaagcaggctccatttgataaaggacgagcttacccacaggcagaaggcagtggaactttagaattaaacagatcccattcgggtgcatcactgcatggaggagccaaccacctcgccacagtgagcctcagcatgcccatcttaaggtagaaatgttatttaaagtacaggatctctaagaagactcaagatgacaggtgactggtagggcactcatctcctggcataaagggagaggacagtaaatgctgccactgggcttccccagaagggagtaagtgctccttccatgaaggtgtgtaagtatcagcaccttgttagaaacatggtggagtcacctctccctatattagttggaactattatagcatttaaattcttttgtgcacttcccaatcacaaaatgctttttgcctgccctgtcaggtggggcatttataatttccattttatgatggaggtaatggaggttcgagaggagctggacactctcagccagccagtagcacaggcagggtcagagccaagcccccaccccagggcctacctgctttccagggtcttctgtggcattgctgccccctgaccatctccccaggagattttgcagtgttgatgtggaagaggtgggcacggagtcttgggggaattggggaactggccagtaggtctcaaagaaaacagttaggctgggctgcgaatgggagggggaggggggcagcacccagcccctggagggcaccatccttcgtgtgctgatgcagcagaggggagggctgcagaggcccattagtgtgggacactttgttcccctagactcagccagcctggtgggggactcgtctacagagggaagcagcaggagctagaacggggctgggggctgggagtaaggggagagggagaacagctgggtactggtgccccctggaggccagagtgccagccctgccccatcagggacctccaggttgaggaagccagtctgggcaggacagctggagtcaccaaagctggggagggagactgagggtcaacttctgttgaccgtcagcaagttgccaacccaatgcaaccttgtcagtcttgaaagaggaaaagagaaataataacttatatgatggggcaatttctaaagagccagctgccttcgcatagggctttgattgcgttataccattacatgtgtgctacaaagctctgcagtgagcactgtccaggggctgttactatctcccatttgactgacaaagaacctgtagatctgagaagttctgtcctttgctaaaggtccatacggtttggaccctcaaatcgtcactattaaaaatctttttttttttaatttttatttttttgagatgaagtctcactctgttgcccaggctggagtgcgatggcacaatctcagctcactgcaacctctgcctcccgggttcaagtgattctcctgcctctgcctctcgagtagctgggattaaaggcgtgcactaccttgcccggctaatttttgtatttttagcagagatggggtttccccatgttggccaggctggtctcgaactcctgacctcaagtgaaccacctgccttggcctcccaaagtgctgggattacagtcatgagccaccacgcccagcctaaaaatcattttaggtagcatcatactttatgaaacagaaattaataaatggatacattttgatgctgaattaagaccagtttgacagataaagagatgggaagcaagaggacaaattggggaggtgcccaaggagaaggaagtgggtgtctgtgttcctgacggagggaagagaagaaaagagacacccccagacagggtgaaaaggagagacagggcacccaccagagcagggagaagagcagggtgagaggggacaggcagggaggatggaccaggaaagcgagggctccctgctcctgctctcaggccacacagaggccaaggcagccctgaaaccacacacaccttcccctgcagcagcggctcccttggtcctcttcagcttcgcccctgccagcatgtcgcctctataccaccaggcaactgacacccttctcatcgaaaggaccccacttgcggtgatgctgtcttcccccaggggctcctcccacctccctgccagcgtgtccttcgtcttctctgctagcttcaaggcacagccagttctcagcttgtgtctctctctcccttcattcccacattgcaactcacagctctatttgcaggcctggccaatctcagacctcagctccaagcccccacagccaggctccatttctccccctaacccccgcccaccagcccagccctcacccccctggtcatctgaaattcaccacggccaggccagacccagcacctccctcccacgcagcaacctcttcccactgccttgtgtttgtcaacagcgctgccatcctgtcatcctgccaactcccctccccgcttctggaattgtcatctgaatttgtcacctccctctctttcacacctctcttccagtctgtcacccatcagttcttcccagaataaccataataccatttatggtgcttcacatacatcagctcaatttcttccacaacagttagaaatgtgataaaccctgcaacacgatcatacatgaaatcatttgcgcacattgagaaacctaagctgaggtgtatttgttcatgtaaactcagcaccgatgctaaattcagagggaagttcagagcaccaccctggggcaggacccacagctctcccacactggcttgtacccctgcccttcagtgtgccaagccccctaagcctcctccaggtagctgctagctgaggggtctgtggccttggcctgggcctcagggaagcctggaagggaaacagatgagggcaggcaaggtgcaggcagctgtgccgtaagcattgctcctgcagccttggccaggctgcagtgggcaccagaacctgtcagccctcctggtgggaggcggactggaggggggctgcagcccttcctgtgaaatcccacctgagctcctggaccactgctcagctggcacacctgggtgcttctgagacaataacaatcattcattcatccatagctattaactgagagtcgaccttggcactctcctaggtgctgggaataccacagtgaacaaaacaggcatggctctgccttcttggagttttatagcgtagtgggatagacaaacaaatgtgtaacttcaaattataacaagaaccgtgaaagaaaaaagggtgccataagggagagaacctaggaaagaaaacagggtgccatagggggagaacctatcttaaatgggtggtcaggaaggcctctctaatgaggtgacaatttgctgagatctgctggccattctgcaggaacagcatcccaagtggcagggacaccataggcaaagaccctagagtgtgggactgagaagcagaagggaggccagagcagctggagcaccgggggaggtgaagatgtggggaggtagagatcccctgggaggcaggtgggtgagggagtaggaatcccccgggagacaggtgggcggggctgggacaggcctgtcagggccctggagtctcttttccttttgactgtttacttggaaataatcccaaatttacaaaaagttgctcaaacagaaatagcacaaagaaagctacactctggccaggtgcagtggttcacatctgtaatcgcagcactctgggagcccaagatggacagatcacttgaggcctggagtttgagaccagcctggcccacatagcaaaatcctgtctctactaaaagttaaaaaaaaaaaaattagctgggtgtggtggcacatgcctgtaatcccagctgctgcagaggctgaggtgggaggatcgtttgaaccccaggaggcagaggtttcagtgagctgagattgtgccactgcactccagccagggcgacaaaatgagactatgtctcaacaacaacaacaataaaagaacaccatatactctaactcagactcagctatttgctcactctttctctacacggatgcacacgcacatacacacatgcacacatacacatgtgtgctttgtttttctgaaccatgtgagggtcagtcacatacgtcatggccctctacccttaactattccagtatatttcctaagaagggggatattctcttccataaccatagtaatcagcttcataaatttccattaatgcaatatcttcacctgtttatatcttattaatataatatcttaatctgtttatatctgattttctcaatggacccaataatgaccattatagcactcccccccccccattctcccagccccaccaaatacagaatccagtctagagtaaggtattaactttaataccttttgtcatgtcttttaatctggaacatttcaaaggtcttttatgactgatacttttcaagaatacagcctttccccttgttagtaacatgttcctcattttgtgtttgtctgatgttttctcatgattagattgggttctgcagtctcagctagaatcccacctaggggataggtccttttcagggtatcacatgtggaggcatgagtgatattaattttgatcacccagtcaatatgttgcccagtataattactgttattttcttcccctgcaactaataagcagtctataaggaaaccctttaagacaatgcaaacgtcctgtgcatactcaaaatttccccctgcatttagcatccactgattgaatctttaccatgaaaatgatgattttccaactctagcactttttccatatttaagtgtagcctcagcattctactgtaggcaagagccctatctgctacctcatttatttgtttaccaacttattatcagtatgatctcatgagttccttttttaatggttttaattcattataacacataattgctttggtgctcagattgtcccagatttggccagtgggagcccttccatctggcccctgtgtcctgtgacatctgaggttcctatttgtgtgttatgcttttgcaattctctttgcttctcaaagctctttgtcttctgttattttcttggagttgagaaccatgcaacataagcgctgagagggcagttaagatcatcctaatacatccctttagtttggtcgttgagaaaactgaggctctgagaagggaagtggcttgccaaggccacattgtgagttggagaagacttgggtcagaactcagaattaggccatgcctgagtgaacataaacgatgacatctgcccatttagatcacctactatggggtagacactgtgctagatgcttctttacatacacatgtgtgtttaatcctcacaacatctgtgatgtaagcattgcagaagcaggtgccaagccccgagttaaaatacttaactttcccagagtcatccacccagaagatggagtaaccggggtccaaattcaagtctcagggatgcggggatgtgtatctgctggagtcagtggtgggatatggggatgtgatcagctataactgatgtgcttggcctgtccaggctactccttggccggatgagcattgattctccacagcaaaggaacaggattgcggtggagagggcagggcatcatagcctcagacggtctgggctatcgaccttagaccctgtgtgtaacccacacctggccccaaattctgatgcccagctgccacctccagcctgggccagcagagccacccagggaggagggtagaaccaaggagctgccatctctcaaggagggtgtttgggaatctcttggcactacagcccagtggtttaaataggctaaggtgggggcccacctcgggtcccccccagcgcctccctttctagagaggcccttatgaaggaactggaggctctgcccgcagcgttaccttgcccagccccagggttcagatgtgggggtgggggtgggggaaccgggttaggatggtggagcagggagacgcgccagtggcggggaagactgaggggctaccccggccttcctggcccagacccagggctgggacgaaccttcgccagaccaccgagtcccgggctgcactgtccccgcaggcttccaggacgtgcacgtgatggtcttcgtgggcttcggcttcctcatgactttcctgcagcgctacggcttcagcgccgtgggcttcaacttcctgttggcagccttcggcatccagtgggcgctgctcatgcagggctggttccacttcttacaagaccgctacatcgtcgtgggcgtggagaagtgagcgcagggcgggccccgggggcgtggcggactgggagggatggggctgggcaggtgagcctgagggaggagggcgtgcccatcggcgggacccgggcttgaggctggagggcaactcctcctttgggccacactgggcttgcgagacagatcacacacacacacacacacacacacacacacacacacacacacacacacacactctctctctctctctctctctctctctctctctctgtctctctctctctctcacttcgcttcctgatcagcgattctccagggtgggagtcgtccaagtgtcatacataggagggtctcccttcccctacgacaaaggctgcagggacttgaggctagactttcctctgggggcagggtccgaccgggcccggcacatcaaaatcgcccagccctgtgtcctgagagaccgcagcccacgggactctggtgggagaactgggatgtctgcaccagcctcagaggctccttgtgaaggaaacaccgaatggggactccagccaaatggaggtacctctctccctgccttgcttcaccgcccccacccaccccagggaacaggtgctggaaacagctgtgagacaggtgtgggtgtggagtgttagggctgaagccctgccccctcctcagcttccacgggtggagcaccctactgtcacttctcagctccatccttctcatgacttctctatgatgacttggcctgatgagcaccaccagccccttcttgtcaggtgactcagcccctccctctgttctgcagtgacctcctccaagcctcaacacacctccccaacccacaacaccaccaacaggttataaaataaattcacccaaagccaacttgccaaaaaaatcaatggagaaagtggtcagctcactgaatgactcatttatcaaactctctatcccatggcaacttatgaaacctatagcaatttgtgttgctctggtcctactcaagaacctttgggagatttttcctgctttagccaagttttagtttattggaggttcttctttaagtccagtttagacagacttttatttctgtagacatatgaaaaggtcagctaaagaaaaaaaaatgttttcctccattctcccatccttcaagaaaaaaaattaatttgagaaaagtaatcattggtgtgtgaaaatgaacattcattagctcactcataaactgtccacagaaagggcttagaggcaaactggtataaaccacctttaaagggcaaatccctgctgttactcttaggataccaacgaggtatgatagccaggtgtctgaaatctaggacacatgtcaaatatttgcaaaaagttacttcatccaaaccagataattaatccatgaattaagagaaacaggaaagatagttgactggatatgtgttggaaccagtaaacaagtctttttgtttataagacccttgacatgcatatcaccccgaagttcaaaatgcacaagaaattatcattcccaaaaccatagatccaaagtataaaaacacctgtaatatatatcattggccaccacagcaaaatagctatggctaaatgaattttttttaatctcaaaaaaattcaaagggaattattacaaaccgtgagttaacaggcttttggtgaagcagttgttcagcaagttggtcacttgaaaaactgagtttggacaaattggctctcaggagattgatttttcagcacctgacttggagctgatttctggtgcccggggctgggatgagcatattgtccccagacctgaccttgtggatccagagatgtggaccctccccctggcttctggcctgtccctgctgaagagtcttctaagtcccacctgtcactgtagaaagtgcccctcttcaggccctgcccaagcttcctcggccctcctgagatgtggcatctggatctccatctcccaaatgctgatagcccaagggatgggcctttctgttctctctctccattttttttttttttttttttgagactgagttttgctctatcacccaggctggaatgcagtggtgcgatcttggctcgctgcaacctccacttcctgggtacaagtgattctcatgcctcagcctcctgagtagctaggattacaggtgtctgccaccaagcccagctaatttttgtatttttagtagagatggggtttcaccatgttggccaggatggtcttgaactgctgacctcgtgatccacctgcctcggcctcccaaagtgctgggattacaggtgtgagccaccatggccggcctctctctctctcctttctaatggtcacttctatcaagatgaatcttccagctgcagttatgggatcttgggcaaaaaacttagcctctctaattctccatgtctcatctaaatgatgtggctaatgacagtgcctgtcttgtatggctcagggatggcacaggagggcatatacagtacttagtagataccccagagcctagcacttaggaactgccatcgatcatttagccaggccctgcactaggccctggggacacagcggtgaatgaggcaatagtggagtggacagtccagtgaactggccctacaattagtttcattctcactcctcaccccattctctctctcatacacacagccctgagcatggaaggggaagggagtcctttctagatgtgacagacccccacccaccccatcaacaactctcccggcctaagagccacactgagggtcttgccttggaatccagagggcagctttgctgctggcaggggacaaggaggccaggcttgggcaaagtgggcacatggatggaatcagggtctacacaatgtccactcagctgtctgcctcttcatcagccctctgctgggctggcagggtgttcagggtccaggcttgagcaggacctatgtacctgcccctttgcctccatcctccctgctggccttcctgctccctccttccatccagtaccaccccagctccctccttcctgcaggaaggcccccctgtctcttccctggacatagatcctcttcatgggtaaggtaaaggaaagatcccaataacaaggccctggttaccagcagaagaggtgtgtgcagagtgagagataaggatctggaggcagaaactgcatctggttggaggaaacaggaagacttcctgaaagaggaggcagtaaaaggaggttctggaaaagcaggtagaagctacagggcagggaaggaccccaaatatggggcatgttcaacaatagcaaccagaccacatggtgccctgagcccaagctgtctgcaagcagcgggggcctgagatgggctgcatgggaggtgggcatctggtgtgtgctgctgtactagtcctgtctcgtgtggtttcttttcattcttggagtagctctaaatgttaggtgcccattagtgtagatgatgaaactgaagctcagaaaggttaagccacaagcccaaatccatatatgaccaaagtccagggcctccagtgccactttttgctattgccccagcttctccactggcctgtctccccacagcctcatcaacgctgacttctgcgtggcctctgtctgcgtggcctttggggcagttctgggtaaagtcagccccattcagctgctcatcatgactttcttccaagtgaccctcttcgctgtgaatgagttcattctccttaacctgctaaaggtgagcagggctcagaatggggatgaggtggtgggggtgctttgggggacagcagggtatggagaaatagacagctggggagacatgccagcctggcgagtcacttaacttcctgaacgtcactcagttttctcatctctaaagtgggagtaataatatctaccaggcaggtactacagtccacctagcccatcaatccagcacgtggacagagcagggcttccttgaatgttgtttttttccccctcctttctttcccacacatcacatggaatgaataggatatccctgcacatactcttgcacacataccacatttccagattcctctgccaagaaaaggaatccggtgtattgaaggggcaaatctgtaggacaggatcccaggtgaatggccaaggtggccatggtgtgtacgacacagcaccagagctgccattcacatgggccatgacaggagtgctgctccctcggggaggtcaattcagtggctcagataagaggcaccttagacctctgactctatctcagaagcctccttggtgcctttggacagtaggggatctcacgtagaaactgcacccttttcttagcaccctcctcttctacgtttggactctgtctggaactccccctccttggcagggagtgatttaggtcaccctaaattcagtcattcattttgtaatttttttcagctaccagattagtccaagctaccatatctcttcctcctgactcatctccccggctgcattcttgccttccttgcccctaaggaaagtcatcttcagcagccagagtgccctataaataatgcatagagaagaggccaggcactgtggctcatgcctgtaatcccagcactttgagaggctgagacaggcggatcacctgaggtcaggggttcgagaccagcctgaccaacatggagaaaccccgtctctactaaaaatacaaacttaggccaagcacggtggctcacgcctgtaattccagcactttgggaggccgaggcaggcagatcacctgaagtcaggagttcgagaccagcctggccaacatggcgaaaccctgtctctccttaaaatacaaaaattagctgggtgtagtggcgcatgcctgtaatcccagctactctggaggctgaggcaggagaatcgcttgaacccaggaggcacaggttgtggtgagccgagatcacgccattgcactccagcctgggcaacaagagcaaaactccatctcaaaaaaacaaacaaacaaacaaaaaaaaacaaataaataaatagtgcatagaagaccattcacccactgaaaatctatcagcagttttaacatttcattcaggagaaaatccaaacttgttataaggcacttcctgttctggcgccaacttttctctccacatgttgtctactctctccccatcttattgtctactctctccccatcttcctgtgctttgtcatactgtgctgtctgctcttcaggcacaaagctgggtcccacatcaaggcctttgcaattgctgttccctttgcctccaagggtcatctctcagtcctttgcattactgaatctcagtatgcgtatcccctctttttttttttttctgagatggagtctcactctgttgcccaggctggagtgcagtggcatgatctcagctcactgcaacctctgcctcccgggttcaagcgattctcatgcctcggcctcccaagtacctggaattacaggtgcacaccaccatgctcagctaatttttgcattttaaatagaaacggggtttcgccatgttagccaggctggtcttgaactcctgacctcaggtgatccgcctgccttggcctcccaaagtgctgggattacaggcatgagccaccactgtgcctggcttacccctgttttatagatgagaaagctgaggctcagaggggttaaggggctcacctaaggtcacacagctagtagaggcatctgctaggctgggagtcgagaatcccagccctgtcaacaaccagttctatgaccttggatgacacacttacctctctggctgggtttcccccatctaaagtgaaggagtgagtctgtgattctattcatctgaaattggttctaggtggggaggaaggaggaggtaaaagagaaggagaggtgagtgtgagggggacaaacatcaatctggcacctgttaagtgccaggccctcgccaggggcaagttgcctgcatgaatcctgacaacagccctgctaaggcactagcaggtggtgtaaatgcagagcttgtcaaatgagaggcacagaggtggaaaccagtgggtgacaaagcaggtaggttgtttccctcagttctgcctctgccttacctcctccagcagtatgagcaagtctgtctccaggcctgggtttccccatctgggaacaaccaaatctgctgggtgaggacaccctggcattttgctgatgggaatccctaccttctccccattaccagttgattggtccgtgaaggccccaggctccatcctgcaccctgaagagtccgagaaggctggagctctgggcgtgtgtgtgtgtggcaagacagggacggcaatgaggagggagggagagaaggtgccagagtctgacaggccccttgcaccccaggtgaaggatgcaggaggctccatgaccatccacacatttggcgcctactttgggctcacagtgacccggatcctctaccgacgcaacctagagcagagcaaggagagacagaattctgtgtaccagtcggacctctttgccatgattggtgagaactgccatcatgaccgagggccaccatgatgggtgaaggtggccatgatgggtgaaggcagccatgatgggtgaaggccaccatgatgggtgaaggccaccatgatcagacctgatccccacgtggtatggtgcatggctgccagttctttttgggggaagggcaaacagagtttgcctatagatacttctagaatcccatatgtctgtcccccttccccatgaagctgaaagaagttggtcactcatcctgtatttcccctagaatgccccaaggcagacacagtggtaaccaggagctgctcactccatcccctgggctagggcaagatgtgcatttccacttcctgtgtccattcattccagagaagacactgaccacagccattctggtctctcaaaacccagccctgccctccaggagctcctcacagcgtagtggaagagaaagcagtgccatgtggaggatctccctacagtagagaaaagattctccctcctggcgctgtgggaacagggtgggggcatttagcccagaaatgggggtcagggtagacttcctggagtggtgtggaaggctaagtggggggtaaggaaggcagggagggccttccaggaagagcccctgcatgactaaagctgcagaggtggaaacagctgggtgtggggtcatctctagagctaaagggcaggatgcctgcctgagctgtggggctgtatctaatgcctctcctcccgggcccattgggcctgtctggtctgaccaggcaccctcttcctgtggatgtactggcccagcttcaactcagccatatcctaccatggggacagccagcaccgagccgccatcaacacctactgctccttggcagcctgcgtgcttacctcggtggcaatatccagtgccctgcacaagaagggcaagctggacatggtgagcatgagggcgttgggggtgtggctctgactgcctgggcctggagggcgctgatcaccatgccttgccaacacctctgaggggatcatcacacccatcttgcagatgaggttgggggagaaatgatttgttttgagcacatggccagttttcagcagcacccagagcaaggatattctttatcttgtttttttttgttttgttttgttttgtttttttgagatggagtctcgctctgtcacccaggctggagtgcagtggcgctatctcggctcactgcaacctctgcatcccaagtttaagcaattctcttgtctcagtttcccaactagctgggactgcaggtgcaggctaccacgcccagctaagttagctaatttttgtatttttagtagagatggggtttcaccatattcgtcaggctggtctcaaattcctgacctcaggtgatccacccacctcagcctcccaaagtgctaggattacaggtgtaagccactgcgccgaacctatcttataatctgacacaagcgtcttgacgtgggcatatgtgtgctgagacactgtctggagtatcgattatttggggacactatcaccatgcagagaggtggggattcaggcacctggggaagagaatcagacacacagactggcacacctgtgtgtatccacacccacctgcaggaagggacatggaatagggtcaaggacagggactctggggccacacaacctggatcaagacacctttctgcctcttgctagctctgtggtcttggacaagtcatttaacccccctcacctcagtttcgccatctgcaaatgttgcaagataactgtcctcaccttgcagacttgttgtagagatggaaagcgctaacccctacagccagcagcacggtacctggtacaggttagcattcagacagcagcagctggtgcgtgcctatgtctagaccccataggcacttgacgtggacttgcatccatggcaagaacgttcagacatgctagtctgggcacacaggtatacatggtatacataaaacaacagtgtgcttgttgtcagggctcaccagcaagtgcaccagcacatggaaaatgcccagacctactaggcgggatgggtggcatgtgcagagaggcacagggagcagctgtagcaagcctgggtggggctgaagtcctctgcaggctcctggcttgctgaggtgaactcccagccatccccggctcccaggagccaggctgcacccttgcacagccagcaagtgagctcctccaggcccggtgctccagggagaggactgagttcctgcctgctctgcctgccctgcccaggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccgtaagtgccccaggcaaggggctgggggctagagaatgctgaggtctttgtgttcctgacagtgagctgagggttcctagggagggggctgagggctagagaatcctgggtctctggaatcccggcctccccacacccttgatgcagcccccggcctgagcagcacccacctcccgtctccagccattcctggagtcccggctgcacatccaggacacatgtggcattaacaatctgcatggcattcctggcatcataggcggcatcgtgggtgctgtgacagcggcctccgccagccttgaagtctatggaaaagaagggtaaatgtggaggaggtgcggtgggatggagcttcccccttccttctcccatcccttcttcctgctattcctctgggacccgactgcatctttctccctttccttccccactctggaccaattgtttcatgggtctctctccccaaactctgtcccttagagttttagaggccaactgatatgtccggtgtccccatgttgtgggtgggaaggctgaggcccgtggtacccggtcacatttttggggtggcagcaagctgttacttggcctctccatggggccctgacctgccccctgtctccaccccaggcttgtccattcctttgactttcaaggtttcaacggggactggaccgcaagaacacagggaaagttccagatttatggtctcttggtgaccctggccatggccctgatgggtggcatcattgtgggtgagcaggaatggctgagccagagaaggggggtgctgctgtggggctccctgggtggagaagcaaagggcatgcggcacaggtcagcctgagcccccaggaatccctgatctctgcacttctggctacaggactgggacaatttggaactcagcccaagggccccaggaggattttcccagctgagggaaatggctggggtgagcagagagaaggcacttcctgacatcctgtaatctccaactttctgtagggctcattttgagattaccattctggggacaaccttcagatgagaactgctttgaggatgcggtctactgggaggtgagttccagggacttggccccctgaaggagggcagctgcgttccctccctgcctccactgcatcagctgggctggggcctggggacccagatgccgggggtgggggtcagagcctacattaccctacttcttcatcgggggaggctgtgtctcatggaggttgaagactcttccctctagaccccagggcttggagtgggtgatgtgtacctctctttctgcacaccctagagggggtgacagaagcaacctatagtcagggctacagctggagtttactcttgtccctaaagactcagtcagctttattctagagcagtggtccccatggtatggtgcccggcaccatcagcatcacctacagactggttagaaatgcaaattctcatgggtgccgtagctcacaactgtaattcccacactggaaggctgatgcaggaggacagcttgagcctgggggtttgagactagcctgggcaacatagggagactctgtctctacaaaaaataatagaaaacttattcagacatggtggaatgcgtctgtagtgccagctactctggaggctgaggcaggaggatcgcttgagcccaggaggtggaggctaaagtgagccatgatggcgccactgcactccagcctgggcaatagagcaagatcccgagagagacagggagagagagagaagcggaggggaggggagggaagggagaagagaatgagagagagagagagagagcgagagcaagagagagagagagaaatgcaaagtcttaagttcctcagacatcctgattccaaaacaagggggcgggcccagcactctggtttaacaagccccaggtggttctgatgacaaacaagtctaagcaccactgtatttgagcagcggttttcgcgctaagatgcacactggaatcacctagggagctttgacagcattccaaagcccaggccccagcccacagagacttggatttaactgctctggggtagggtctagacattagaatttttttaaagcttcctcggggattctaacacccagcctgggttaggaatcacagtgcagtgctcagcttcagtctccatgagaaccacctggagaccttcccaggcaccaccccagaggttctgattcagtagggaccgggactctgcaactgacaagctcccaggtgattccaatacagaaactgagttctggactgggcgcagtggctcatgcctataatcccagcactttgggaggccgaggcgggcagatcacctgaggtcaggagttcgagaccagcctagccaacatggcaaaaccctgtctctactaaaaatacaaaaaaaattagccgggctcagtgtctcatgcctataatcccagctactcaggaggttgaggcaggagaatcacttgaaccctggggcgggggggcagaggttgcagtgagctgtgattgcgccactgccctccagcctggatgacagagtgagaccaaaaaggaagaaaaaaaaggaaggaaagaaaagaaggaaaaaggaaggaaggaaggaaagaaggaaggaaggcaggcaggcaggaaggcaggcaggcaggaaggaaggaaggaatgaaggaaggcaggcaggaatgaatgaaggcaggcaggcaggaatgaatgaaggcaggcaggcaggaaggcaggaaggcaggcaggaaggaaggaaggcgggcaggaaggaaggcgggcaggaaggaaggaaggcgggcaggaaggaaggaaggcaggcaggcaggaatgaatgaaggcaggcaggcaggaatgaatgaaggcaggaaggcaggaaggcaggcaggcaggaaggaaggcaggcaggaaggaaggaaggcaggcaggaaggaaggcaggcaggaaggaaggcaggcaggcaggaaggaaggcaggcaggaaggaaggcaggcaggaaggaaggcaggcaggaaggaaggaaggcaggcaggaaggaaggaaggcaggaaggaaggcaggcaggaaggaaggcaggcaggaaggaatgaacgaaggcagcaggcaggcaactgagttctgcagcatcccacccctttcagcagttgaggaacattgttctagatatgaaagtggtggaatgtcacagaactcagtttccttaaaaacatgccacaatctgggctttctgtgacttcaggctggcctctccccatgaatcatgattggaggtgcccacctgccattggatgatgcaggatggcaggactcccctcatgcctcctgcactgtcctctcatgacaagggtgaggacccgcctgtgtctgtggctcctgggacaaggggccacccataatgcctttcacttagctctgtatttttaaaaccataccagaagttttaagggtaattttaactactatctactataaggtaacttcatgcacataacgaatgtctcttaaattaactctttaaaaatgtttttaattaaaaatgactaggcgctcattaaagaaaatctggaaatacagtaaaatagaaatcctgtcaccctatgtcaagcaatattaatattttctggtatatttcctttctatcttttttctctgcatagatttttcttacacggttgaaattgtattattcacccaatttagtatccgtctctttctccttaccactctatcataagaattgttctgtgttattacattcctaataaactttcttttctcacaggataattatttctattctatatttaagaaagtcagaacttaaactattttagacaccacaattagaaaccaacagattttacgctaacgaaataaatcagaaatgttatcagttcccccatgtagaagttccctcttggttctgttttgatctttataatttattccaagttcacacctctcagctctatataccttgagcagtacagacgtcccccagtaacctcaggggattggttacaggatctcttgcggggatgctcaagtccctgatataaaatggcatagtatttgcataaaagcctacatgtatcctcccacatattttaagtaatctgtagattacttgtaatacctaacacaatgtaaatgctgtattgttttttgtttttattatttttattgttatattgtcattttttgttgttgctttttctaaatattttcaacctgtgataggtgtaacctgctgatacaaaacccatgggtatggagggctggctgtacctggttgggaataacaaaattctgtgccaatggaaggaacactatcaggcagtccctgaggccctgagtggtttaccttgggagtgaggtggcttctcagaggatggggattggaccagtgttccccaggaccacagatggggcaagggcagggctgacctgccctgcctgccctccacctctctacccacttctggccttccctgcaccttccccaccccattttcggacctgtctgcagtttacagagcttgccatactaccttttaccgcctctgccccttactccaattcatcttttaaaagtgggttcagcacaacttctcagcatcccccaggctgggttataagcctgttgtgtgcatttgcaactcttactgtcactgggtatttcactgcaatgcctcaccattgctctcatggggcaaggacactgtctcctccttgccatgcctcagcacccaggacagtgcctaatatagggtaggggcaggactcctgtgttgaaggaccaccctgctctccgtggcatgtgatccgcacggcgatcacaaggtggcgctcgccacacaccatttgcagctccaggttctagtcaccagggacacccttgcctggactgggacagggccctcagagttgcatcctctctctgtagatgcctgaagggaacagcactgtctacatccctgaggaccccaccttcaagccctcaggaccctcagtaccctcagtacccatggtgtccccactacccatggcttcctcggtacccttggtaccctaggctcccagggcaggtgaggagcaggtgagcatgggcttggcttgggggatgacagggaggttctcccagtgggggcccagctctcagaatcagatgttactagcaaagaggcaaaaagcaaacatcaagaaatgagggcttccacccctcctgcctgaggtgcagtgggcacatggggttggcaggggagcttcttagagtcagacaacgtgcatccaggacagacacaggaacaggtgaaggcacaagggcctggaaggaatatggaaggagacctgggggcacacttggctttgtgactgtgcctgctggtgtgtgactttgagaatctcttcaccccagagactgggcctcgatttcctcatctataaaaatgaagctgacacgtctggttgtattcagttgctcagctcagatgagacccaccctcccctctttctttccgtcaactaacactgtgcctcctctgtggaatgcaccaagcccttgctcatggctttcacatctaaccttcccaagatctctacaaggcaagtagaattactgccctcattttaatagatgagcaaactaaggctcggagaagttcaggttcttcaagatcacacaactagcaagtggagaaactggggtccttgctggtcattgttactgtttttattattgttatttaacttccttggaggccagagcttggcaatagctgggtctggggcctgagtgatgtggcaagagaggatgttagggtgccaggaaagaggaaggtgaggctatgcccagttgcctttaatgtccaccccatccagaaaagaaaatggtgcctgagaggctacagcaggacccggcagtgacccgctgctcttggctgtctccctgcaggctccacagactgtcctggggcccagaggagctggtgctgacctagctagggatgcaagagtgagcaagcagcacccccacctgctggcttggcctcaaggtgcctccacccctgccctccccttcatcccagggggtctgactgagaatggagaaggagaagctacaaagtgggcatccaagccgggttctggctgcagaagttctgcctctgcctggggtcttggccacattggagaaaaacaggctcaaagtggggctgggacctggtgggtgaacctgagctctcccaggagacaacttagctgccagtcaccacctatgaggctcttctaccccgtgcctgcacctcggccagcatctcctatgctccctgggtcccccagacctctctgtgttgtgtgcgtggcagcctccaggaataaacattcttgttgtcctttgtaaaatggtgtgaatgctccaatggggccagtttgagggagaaaaggacccaagagacctgcttctgccccagcccttaccttcatccaagggtaccacccacactgcgaggaaagtcattgcaggctgaacaggcagaacttgggtactagagcctgccttcagcctggggcacccagcagggctcagctctgggctggggtcttgcttcaaggcccctccatcagctactccagaaactcagcccttgagaaagctggcatctctgttgtgccctccatgtggtcctgctctgggcactccagcaggactgcgagaagggagggagggctcctttgggcccatctcctcctccccatcccttcccttctttctctctgccaagccagccttcttttccctggacagtggggtaaggtttcaggagggtagatctcccaggctcaccaccaccctgggcagagtaatacaccttcctgccctcaggggctcacagtctagctgggagacagacctgaccctcagaatccatgctgaactctgacaggtgtggctggacaggaagtctgtacccagttggcttctcaaagcagggccacctgagcagggttctggaggctgaataggagtttaccagaaggatggcaaagaaacagcatgggcacagacccatgggtaggaattaacacggtgaagtctgctactggctagaagagatgtgaggcagaagtgtgccagttggagaataagacttggaatccggatcttttgtggagcaaaggctcctgggaagaaggggtgagggaaaagggaggaggtctctcagcttccaactccgccctccccgcccccttgcaattcacacacacacacacacacacacacacacacacacacacacacacacacacacaccgctgcatgcctcttaccagtgcaggggggaggggaaggagggatctgaaatgcaacctattcatgtacccgcgatgtaacacccctcattttccatgctgggtaaagacaaaaaccctttacaacctgtttctggaacttgtcagcagctgccaagaggagcatgttaattaaacgtcggcaaagatggaagccggagaccctggctctaattggacagtttgcttcaccggattgaaaaacattgtgacaaaggagaaggtgcgcggcgctcggcaggggtgcggcgtggcggggagggagctgtggctttgatttcagctgatctgagccccagcctgcctcccccagcagagccgcttggcccacccccatatgcctatgaagggcctgtggagcgcccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgaagcccacctcccacccctcccaccccaatcccaggcaccaccaggccaacagtattgggcccaacccagagccaggcttttagggctctggggctcacccctcctcctgatcacatgacctgggtcctgggggctgcacagggaggggagggggccagcgctggcttccaactccctcctgtgcaatgtgcaggctacactaagagcctatgcccaccgcgtctgttaccagttgaggatagttgtccaagttcttggcattttgaacaaagaattagaccaaatgcacaaagcaaggcagcaaaagcagagatttattttaaacgaaagtacactccacagggtgggagcgggctcgagcaagaggctcaagagcctgggctacaggattttctggggtttaaataccctccaggggtttcccatctgttcactctatgcacataaagtagtggcccgcaaccagtctgattggttgcgggagggaaccaatccgaggtactttcatttccaactgccaggcagcaactgccatgcagaaaaaggaggggttgaaagggagtagcctc

SEQ ID NO: 15521 - DNA, 76610 bp, Human
gaagcctgagacctcacactgtaggactgagttgggaatggtaaggggcttccatttgtactttttctctggactcctgtaaatattagtagctataatgttgttaagataaacaagtactattgacaaggtctgaagaacatttagttccattactgtaaacctgtttttaactggatgtattttctagaatcagtgtatcactagcttctcagtgtatagtgtctagtcagtgaaccagacggataagatttgctccttagttaaggaagcctgcaccagggtgaaaaaccgttgttgttaatctgaatgaatctgttcttctcttcttttgcatatgtaacacttattaatgcaaatggaaaacacagatgatgcattcgtgcaacaagaggagacaagaaccctgaggcatcaatgccagtgggtagacacacaggcaattcagtaagtacgtctgggatgcgccagtggaggctcggagaggctaatgagcttgttctagctacccagacccacagattcatggctgaatcccagaagcagcctgggagattttgtggggagatgaggcaaagtcatctacttccttggcaaggtaaaggattcctttcaggaatcatcttctacctcaagctgccgtgttttagttaaacatcacagctcagtattgggacagaaatgtagaaggaaaaaaatgctgaagggtcacaagcaaggagcaggtctagacagctgagaggaaccattctcctccaatagctctgtttcttcaataactggccatgtagacccgttctacccccgagggctgggagtcgagtcaggttccagactgaaatgctccctgatcttagcattccttcacttgccatcccacaggcacctcaaatttggtgcgtccaactctgaagggctcatcatcaccccatcatccttttcctgtgctccctgtgttagtcaactgcaggattaactccccgccccccaaccccagtcgctcaagcctgaacattcctcaacaacgcccacaccccctcaaatccggatatttgggcttcctaaatctctacctcctaatctctttcacatgcggtccactcctttctgtccccattgccaaggttgggccaccaccacctatctttgggacaacttacagtcttctaaggggggtcctgccttcggtccgccccacctggctcatctcttttcaacagtttctgcggtcctcacctgcccgagacagcagtctacaatgcgaacacagtcatgtccttccccttcagcggttccccactgcccccaatatgaaaaggagttagaaacccctgccttcccactcccaccgagcaccttcgccttctgaactggccaggggctctgttgcttgctcgttgctctcagaccctttgcgcaaggtgctccctcaacccaaaatagaatctcggcccaccctctgtcggtcttcgccccactgtcagttgttcatttaacaaatattcgctgcttttgccaggctatgcaataaacgctggggttacgcaaggggagcgcaaaacaaaacaaaacagagaacaaacaaaaaccacaactcccaaaagtccattaagacccctagccacagggggcttacatctgaggggttaccgtcccttggcacaaggtggagtatgaaatccgcctctgccttccaggcttttccagtgccaagacctgcggggccaccaattgtgagtcccctcccgcactgactactccctcaacaggacaggagggaagctgaacctgtcgggacaccgcgctgggcacgctcaggtcccaccgcgcgtgctcatcggcggtccctagcgcgagttcggacaggcagcgcccccctccgactgtgagctgggacgctcccgcacgcttcccggcaccccttcagtcttcatggtacaccccgcccgcaggtacccggacggcggaagtgagccgcgggggcggatcttgttgttacgggtaacggaagtgtggcggcgttgggttgagcgggctttttggaagtttgtggcggaggtgaggccgaggtgactgcagagcggctcgcgaggtgctcgggctgtgggactgggcccctgggagggagcggttctgtgggggaaaggaggctcctgtcctgacttggcgttctggtattttctctggcgtggaaagtaggcgcgctccgctgtctcccgccgcctgcctcagctttcgcggttccctcctaggggtgtgcctcagtcggagccccttctgttaaattcttcccccttggccgagggtgagctcttacttctgagaaatttcccttaaccttgctttgcatttgttgtccggtcgcggtctccatcaccagctgcttcgtgttatagtttttgtatttgcgctcacggcttgttaactgaagaacccggaagggaaggccgcggcgtttcccgccggcggggctctgccattctcggatcttggcttcagatctctgatgctccccagcgtctcttggcaaggaatctacttcgcgttcagggaattcacagccacccgcctctggtcttacctctggttttaggatgattttagcaaatgtgcctaggttgatttaaacgtatccccctccgaagccgcctgccccttctggctggacacctttttaggttggtgtgtcctgtttgcatccggtagttcaaagcatgggatcttggagtccggagctggacagactcgggtttcacttctctctctgccacttggtagccttctaatcttgggggaaattccctaatctctgaatcccaaaagttgttcatctaaaatggggctaatattacacctacctagtaggtggtgttgtgggagtcatgttaatgaatgtaaagtgctgggttcagtgttttccctattataggggttcaataatttgttcaacaaacatttgttacctagtttgagctaggtactgtgctaagtgctggagatacaatgataaacaaaaccagctacggcccgtgtccttaggggacttatagtctagtgggagataacatttgttaatctgataattacacatgtaatattaaaaattggtgacagtatgtaagagagtttactggtgccatgagaggatgtactaggggaacgtttaacaacctatactgagcttttcttttcttttcttttcttttttttttgagacagagtctccctctgttgccaggctggagtgcagtggcgcgatctcggctcactgcaacctccgcctcctgagttcaagtgattctcctgcctcagcctcacaagtagctgggactacaggtgcgtgccgtcacgcccagctattttttttttttttttttttttttttttttttttgtatttttagtagagacggggtttcaccatcttggccaggaaggtctggatgtcttgacctagtgatccgcccgccttggcctcccaaagtgctgagattacaggcgtgagctactgcgcctggcctagactgagcttttgaggagatgtggattgagctaagatctgaaggatttgtaggaattagtaataaaagattggggggcagtggatggaagcaggaatatttatttaagttccagatggaaacatgtggaagggcctgtggcagaaagaacttggagatttgaaggactggaagcaattctgcatggctggagcagagtgatgaaagggaggtaggcatgggtcagaacttgcaggacttattttatccttacttaagggttttggactgataaagcaatggaagccactgaagagctttaagatgaggatggcatggagggaagataagtcacataatcaggtttgtgtttcaaaaacatcactttagttgctgcgtagaagggaacaagttaggaaacgattgcagtagttcaggtgagagatggtggtggcttggggtaatgtgtcagtagtggagatggagaaaagtagacagatttgggagatatttagtaggtaacattgacaggacttggtaatggatgtggtgaaggatgaaggcaaagttgttaagaatgttacctaggtttctggtctgagcagctgagtggatgatggtaccatttatggagacgggaaacacaggaggaagaagaggaggaacagattttctttctactaggctgtacttcccccttctattttcatagctactcactgaattctatctgcttcatgtgcctccatttcatcccatcttttctgttctccagtcaccaccctagtacaggtctttatcatttccactaaaataacttccaaatggtctcttagcatttgctgtttcttcttaccttctccccactttaatctgcacaaagatgctaggttctgtttcctcaaacacttgcaatcttgtgagattgtcttttgctcaaattttttaatggttctcagtaatttacgaaatagaatctaaattccttaacctgtttacttccagcctatctttccagacttcctactcactattttcctacttggattctacctcagccattttactcattttcccccaaagaaatttctcatttcccgtatgaatgcctttgttcatgatacccttctccataatgtatacaacctggttgtctggactacctatatttaatctctaagttccagttcaagctttcctctgctgcgaaaccttgacatttaagaacacagttacatcttttaccttgttaacttctcagcttttctttctttctttcttcctttctttttttttttttttttttttttgagacagagcctcgctctgtcgcccaggctggagtgcagtggcgtgatctccgctcactgcaagctcctcctcccgggttcacgccattctcctgcctcagcctcccgagtagctgggactataggcgcccgccaccacgcccagctaatttttttttgtatttttggtagagacgggggtttcaccgtgttagccaaaatggtctcgatctcctgacttcgtgatctgccctcctcagcctcccaaagtgctgggattacaggcatgagccacggtgccggcctctttttttttttttttttaagagacagggtcttaccttgttgcctaggctggagtactgtggcatgatcatagctcactgcagcctcacactcttgggctccccttctcacttgtttttataccatttaattggcacatagcatttatagtgctattggtttattcatttatttgtcaaatactttattacatgcttatggtaatatataatgtattacatacttgatatgctgttaaatggaagctttgttctaggtagtatggtgagtagatggtaacaagtgtgggcaaaaattatgaaaccacttgattagaatacagattcctaataaggcaattccagggaattttcaggattattttggttaggttaagaatcatcttgccactgagcttaagaagaagaagaaaaaagaatcagctacttaaagatagtcctaagtttgttgagcacccattgcataataggtatgaaatattcagttaacagggaaggaaaacaaatcaagtttgtttatttctggaatcttcacccacctctgacgtttttcccttgtagttctgtgatatgagcaacaatggaccagaagattttatctctagcagcagaaaaaacagcagacaaactgcaagaatttcttcaaaccctgagagaaggtgatgtgagtattaggaagcatgttctgctaaaagtaaatgtcaggcatgatgacacattcaaaggacatgtgagaaagaaaaattacgctgcttcttcatctactccccattcactgtaggagacaaggatttatttaataataatttatagatgtaaagaaattggggtgagggaatgagagaaatagactacttgagggcatttgtgaccaagtttaaacctgaaatagtttaagaatagaatgcttttacaactgtatttataaaagcaattagtatacttttatggtcctcagaacaatcctatttgatgataatatccagactatagttactgattgagacattagttttgcattttgatgcttctctgtatttttccgtaaagaaattaagtttataagcggcaaaatattttgaaattattagtaaaaattagggcctctgttttcactataagtgtaggattataaaatgggatagtaattgccttatatgttaggctgtttcttctccctaatgttctttctcagctgatatactgctcctttttccataagtgatctcatcctatccaggtccctgcctggaaaagaatccctcttcaaggtatatgtacaaacaagtaaagacattgagtatcatgggatttttttcctttttctgtcaattgatgagtattatgtttttaagggaatttctttgtgttaatgttgtagttattgaaggaaggtgcatcttagtgtgtgttatctgacatactaactaggaattgatgcagtgttgctctttgatttttttttctttgaaattatccaagattgcctttatagctattttttgagatgacttgttgcatgagttgtaacttgaatcattctatagacaagatttgattgaaactagcatttaaattatttatttaaagtttcatgcctcaaattgaaggcgtgaacactgtcaaattgaagacagtgttccagatgttttctgactctaggatagagtaatgctaatatttccctcatttttccattaatgcaaaatcagctttttggcagcaacattatattgtagtctcattgctcttatatttatttttgtatatgttgataagttgctaagtttcctttatctctgaagtccttttagaatccatgttaaaaactatatataggccaggcatggtgacttacacctgtagtcccagcactttgggaggattcctttaggccaggagttcgagatcagcttaggcaacatagtgagacccagtttctaaaaacaactaccaaaacaacaaactttatatctgttaactgtcaccttttttagattcatcttgttttactccatcaagatcattttgtatgattctgctgaccgtattaatcagctttttatcctctacaaatttgttaagcatgtcagtaatatatgcaggcagttcatttgataaaatgtcccacagaagatgaactcagagtaaaaaattataaaacacataaagaagtcctgtggcaagaaagactcaaacagaaatgggaaaattcatattcaaggatttagagcaatctgaaaaaaatctttaattatttaacacaaatacttaatacagtatttaactttatttatttaaaggtgggatctcacccttgcacaggctggagtgcagtggggcgatctcggcacactgcagcctcaacctcctgggctcatgcgatcctcccacctcagcctcctgagtagctgggagtacaagcatgtgccaccatgtccgactaatttttgtatttttagcagagatggggtttcgccatgctttccaggctggtcttgaactcctgagctcaagcaatccacccacctcagcctcccacagtgccgggattacacgtgtgagccactctgcctgacctagtatttaaaatatttgaagatgtaaatgaaggaatagaactcacaaaataagggatggatttagaaaacaatgaaagacaacttcttgaaatgaaaacctcagtaggtggtttaacagtagacaaaacattgctaaagagaaaattagtaaagtggaatacagagctgaggataactaaataaagcacagattgtaaagaggtggaaaatataaagaatatttaaaatatatgcagagaactttgataagaatatattatcttcttaaacacatagaatgttcataaaaattaatcacatgtcatatactagagcacaaagaaaacatgggtaggtcccataaggtagaattattacaaactattctctgtgatcacaatgcaataaaactggaaatgaaaaccgaaactaaaagtcaaaaagcaaagacacttttacttggaaattaaaataccttctattcaaccattgtggaagacagtgtggcgatttctcagggatctagaactagaaataccatttgacccagtgatcccattactgggtatatacccaaaggactgtaaatcatgctgctataaagacacattcacacgtatgtttattgcggcactattcacaatagcaaagacttggaaccaacccaagtgtccaacaatgatagactggattaagaaaatgtggcacatctacaccatggaatactatgcagccataaaaaatgatgagttcatgtcctttgtagggacatggatgaagctggaagccatcattctcagcaaactatcgcaaggacaaaaaaaccaaaccccacatgttctcactcataggtgggaattgaacagtgagaacacttggacacgggaatgggaacatcacacaccggggcctgttgtggagtgaggggaggggggagggatagcattaggagatacacctaatgtaaatgacgagttaatgggtgcagcacaccaacatggcacatgtacgcatatgtaacaaacctgcatgttgtgcacatgtaccctagaacttaaagtataataaaaatatatatatatataaaaataaaaaaataccttctaaataactcttggaggaaaagagatacaaacaaattacaggatttttgaagaataattacagataacaaaaatactacatgttaaaaatccatggaataatgttaaaaacaagtgtttaacaaatgaaataatgaaatcaatacaaatgaaataatgaaaataaataaattcccaactcaaaaacctagaaaaaagagaaagtaaacaacaacaaaaaaacacaagaaactactaaagataaaagtggaaattaataaagtagagaacagaaaaatagtggatcaaattaatcaaaatcttggttctttgtgggggaaaaaaacaccattaattaatataataatcaaaacagtggagtaaaaacatgcacaaaatgagaaatgacaagggagaaatactgttaatacagagaaaatctcaaaaaatactgtgagactacagtagattcctgtgcaaataaatttgaaaacctagaggaaatggataatttcttaggcacgtacagtttaataaaattgagccaatttgagatggaaagcttaagcagaccagtttccatagaagaaaagagaaagttatgaaggaactacttcgtacaaaaacaccaggcccagatagattggcaggaaacttctgtcaaacctttagagatcaggtagatagtcctaatgctacataaattgttttagagcataaataataaaggaaaacttccaagttctttgaatgaagcaagtataacattgaattaaacaaatataacattgatttttttatgctatctttatcaggtataaccttaaacctcataaagatagcatagaaaaaagaggatatagactaatgtaacttacgaatattgatataaaagtcttaaatattaggggacagattgcaacaccacatttaaaaaaagtacaccatgatcaagtgggatttaatagcaggaatacaaggttggttcagtatttgaaagtatattactataaagattatacgattatcttcatggatcagagaaagcctttgacaaaattcaacactcattcctaataaaaacttgagaaaaatcagaatgggtggctgtttcctttacatcataaaatgtatatatctaaattctagagtcagcatcttagtgggaaaccatagagacatttcctctaaggccgggaacaaagcaatgatgcctactgtctccattactatataatgttctgattggctagcctatgcatttaacctagagaaaacaatcacaggcataataatggaaaaataaaggctgagtgcagtggctcacacccataatcccaacgctttgggaggccaaggtgggcagatcacttgaggtcaggagttcgaaaccagcctggccaacatggtgaaaccccttctctactaaaaatataaaaattagctgggcgtggtggtgtgtgcctgtaatcccagctactcgggaggctgaggcagaagaatcacttgaacctgggaggtggaggttgcagtgagcccagattgcaccattgcacttcaacctgggtaaacaaagtgagattccatctaaaaaaaaaaaaaagaaaatataaaacgtctctctttgtagatggcatgatagtatacctggaaaaccctggagaatctgtgataaaaccatctataaacgaattcatcaaggtagcagaatataaaattaatatgcaaaaatcagtagcattcatacataatagccagttagctcacgcctgtaatcccagcactttgggaggccaaggcaggcggatcacctgaggtgaggagttctaaactagcctggccaacatggtgaaacctcaactctactaaaaatagaaaaattagctgggcgtggtggtgcacgcctgtagtctcagctactcaggaggctgaggcaggagaattgcttgaacccgggaggtggaagttgcagtgagctgagatcacgccactgtactccagcctgggccccatttacaatagcaacagaaaagttaaaacaggaataaacctgagaaatgtccaaaacccatgcgaaaaaaaactatgaaacacttctgaaggacaaagtagaaaactaagaagatatcccctgttcttgattggggagtctcaacatcacgaaaatgtcaattcttccaaagttaatttatcaatttaataccagtaaaaatcccattgagctatatatataagttgactgcaaaattcatatagcaaattgtacacacagggatagttagggaaaagctgaaaagagctctgagagaggattaaccatagcagagactaaacaccacaaaaacttttataaataagagtgcagtactggtacatgagtagataaacagaaacggaataggatacaaagaatagaataggtaatgcataagaatggaaagtctcaaaatagacccaactacaagtaaaatctagtatataataaaattacatcttaaaacactgaaataaagataatctttgacaaatgatattggaacaactggatggacatttggaaaaaatagatgaaattagatgtgtttctcatattcaagagaaagctccaaatgaatcagaaatttaaatgtaaaaaacaaatctaaataaatgttagggctgggcacaggggcttatccctgtaatcccagcactttgggaggctgaggtgggaagatcgcttgagccacgaggttcagattacagtgagctatgattgtgccactgcacttcaacgggtgaaagtgagactctgtctcttaaaaataaataaataaataaataaataaataaataagtatatgttagaagaaaacatggatgaatttctctttaagctcagtgcagtgaaaagctttctaactgtcatacaaagtatagatgcaagaaaagataagtttgtctacatataagttaaaaagtttgtgtggccagaaataccataagcagagtcaaaagacaaatggcaaactgggaaaaaatatttgtaacgtatcacagaaaaaggattaatatccctaattcataaataacttgtgggggtgggggggaagataaactgtattttaaaaaggcaaaaaacatgagaataatcactaaaagatatataaaaatggccttaaacataagaaaatatgctcaacttcactcataataagagaaaaataaattaaaataaaagatagtgatccacctgccttggcctcacaaagtgctgggattacaggcaggagccaccatgcctggccccatgtatatttttatgtgtataaacatgcatacatttcctggctctctccaatgaaagaaccatgaagcaaagatgccatagttgctcggtgcggtggctcacgcctgtaatcccaacactttgggaaactgcgtgggtggatcacttgagtccgggagttcaagaccagtttgggcaacgtggtcaaatcctgtctctataaaaaaataaataaataaattttaaaaagatgccttagtaacaacaaacacacccatcacctagatctttgctgtttcataaccattcctcactcaagggaaccagggctcttcagagaaacggataagtttatgcgtgggcaggatggatacaagatgaacctggaacatcttgctataccagaaagtaaagaagtgctcaaaaaagacagtgggggcgtgtcacaaagacagaagagccagcttgaagggtttccctttggccaaatctgggactatttgagcatcaaaataagttcaataatgaaccattgaaaaatacagagatttataagtccatactcataattaataaataaattactttgggagttcgaggacggaggatcacttgagtccaggagtttgagaccagcttggacaacatagtgagaacccacctctacaaaaaaataatttaaaaaattagcatggcatatcagcacacgcttgtattcctagctaactggagggttgctgaggcaggagaattgcttgagcccaggagtttcaagttatagtgagctatgactgtgccactgcagtccagccagggtgacaaagaagactctgtctctaaggtaagtaaagtaagtaaatgaatacatgggtagaaaggagttctcttgcttacagtgcaggagttggaaaatcattcctttgcaattgtaatggtaaagattgaaccagacaagaaataccaatggatgttaaatccagggggactttaaaaacattgatacgatacaattaatgaagctaagaaccttattccaactctccccagtaattatttcactaatgttctctttatgttccaggatcccactcagcatcctacattgctcttagttgtcatttccccctgatttcctacactctgcaatagttctcagtctttccttatctctgttgatcatgatagccctgaggagtattgattagttgttttgctgaatgtgtctcatttagggcctgtttggtggtgtctcatgattggaccaatgtcttgtatccctggcataaggaccacagaaatggtaccatgccctttttagtgtatcaaatcactgagctcttgatgtcagtgttattcctggtgatactgactttgataacctggtaacagtggtttctgctgggcttttccattttacaggaagaaaattagatgaggagcaagatatttgcatgatcttaaagtgtctccctataaattgcttactggtggcaaagggacagggtgggggaagtaattataaagtgggatcagaatatcaccaatgagggacagatggacatcatgtgcttcctgatgtgatactccgagaatgacatgatatcacctgtgttcttgtgagaccgcataaactcaatctagccacaaggaaacatcagacaacacaaaatgaggaatgttctattttttaaaaactaaaatttatttggattatgctgttaacttggtagttacagtctgccaattaattttaaagccttctgaggtaacagggatacttaaatcttacttgctctatttctgagttttaaaatgtagtaaaaagcataactgaacatggtcaaaagaaagactgaagatcacataagtggaaggaggaagaaggggagtagaggacagagtcaatagaagaaaattaacattcgttgagtacttgtcgtgtgttaggctctgtgcaaattcttctcccctttatctcagtcctttgaggtggggaaatggacacacataacagattaagttgcctgaggttttatagctagtaaatggcatagctaggatttacatccagggcttctgattctggatccagctttttttccctcttcctatgccacactgctttctgttgaaactgaactatttcaaaaagagtcaacagcttctcagccttggcagtgctcacgttttggctcggataaatctttgttgtggtgggctgtccagtgcattgcagaatgtttgatagcatctcttacctctacccactagattccaacagcatccttccagttgtgacaaccagaaatgtttctagacattgtctagtgtcccctgggggacaaaaatcactggttgagaactgctgctctaagggttatgtcaaggaccaagtactctgttggaaggtataggcaagagtagtcagatacttctttattatatatttaatagagagatggactccagctagaaacaccagcctcatgtacttgtggaagagagagtttattgttttattagtcttggcttctgtgacacctctctctcgagattatcctccaatgttattgacttcactttctccattgtctttgctggcagctgcttctctttttaatgactgactcttggtgtttctcttctttatattctttcctggatggtctcatctgtttccattgatgctccacttggcatatttcattgtcatctatttggcacttccacttggatatctcagagtagtggttctgagcctcacagcagacccgaatcataaactgtgggtagatcctggaaatttagtaagctctcagggtgatttagatgcttccttaatcccaaattttcagcacgtaaacagatggtgccactatccaccagctagctgcttaagccagaaatttaggaatcctccttgatttctttcttttttgttgtttttttttgatatggagtctcgctctgtcacccaggctagagtgcaggggcgtgagctcggctcactgcaagctccgcttcccgggttcatgccattctcctgcctcagcctcccaagtagctgggactacaggtgcccgccaccacgcccggctaattttttgtatttttagtagagacggggtttcaccgtgttagccaggatggtcttgatctcctgaccttgtgatctgcccacctcggcctcccaaagtgctgggattacaggcatgagccaccacgcttggccagatttcttttccttcatcaccaccccctacttcccttccaaactaaggaatttctattcttagttctcaaatatttatcttagatctatctacttttcttcatcgcctgtattagtgtgctagggctgctgttacaatgtatcacaaattgggtagcttaaatagcagcaatgtaatgtttcacagttctggagactagaagtgcaagatcaagtgttgtcagggttggttccttttgagggctatgagaatttgttctgtgtctctcacctagcttctggtggtttgttggcaacctttagcattccttggcttgtatcacctgatatctgctttcatcttcacctgacattccccctgtttgtgtttctgtgtccagagttcccctttttataagggcattagtctttggattaggacccatcctaatgacctcaactaatctcacctacaagaagagcccaatttccaaataaggtcacattctgaaatactgggggttagagcttcaacatatgaaatttggggttgtggggaggacacaattcaattcataatgcctctattactttggtctaggccactgtcatctctctcttaaacatggtagcagtctactaacaggtatccccatttcactcttaaacccccataactcattctccacacaaggagcaaggatgatttttgaaaaatctatcatcccatttccttcttttctctttagtaacttccgttgcacttagagaaaagctaaacttcctaccatggcctgtaagattcttcataatctggtcctttcccgtttctcttcaaactcatcttctactactcttttctttattattctccagccatgttgatttttttttttttaagcaaggctttggcctcaaatatgccaagttctttgctgcttcttggacattgcacgtgatcatacttccatctgggatatccttctctaacgcctttgaataattagctccttcttgtccgccaggtctctacttaaatgtcacctacttctgagaagcttccccttactaccctagaggaaatttccttcctttcctcacttattgtctatctcagcctcttatttggttcttttacaatttttttctgccatcctttcccctcctgctctgttatgaactctgagtcaaattactatgtctgttttgttcatctttataacatgcctaaggaaaataacatgctcaaaaagtatttgttcgatgaatgtatgttcccaacttagtgctaagttataaacataaatgtttatagaatgagtaagaatagattttagtcttgacaatccaggatcatattaagatataccctcctctgtctaaaaattatggtgtttgtaatacttggcgtctctgaatgatctgaacgtgacagaagagtactttttcatattgagtgtttaggtcattggggtaaaagactgttgccagagacttgtacctttttctttctttgcagttgactaatctccttcagaatcaagcagtgaaaggaaaagttgctggagcactcctgagagccatcttcaaaggtaataataattaatgtcacttctgtctgtctcctgcattcattggtagatttgtttagttttcgtacttttcttacggtttgaagccccactggaacattttccatgttttgaggattctacagaatcaactacagcagcagtttcctgtctagtggacttaagtaattttactgaagggagtttgaagtggctacctgagattgcgttgctgatttgggggcctataattacagaatgtgcttttcgtaaaatctgctttggtttacttgtgcttttaagattgtggagaagagaacagcaatgtttaatacataatccatgcttagcaaggggcaagtaacctctggggtttaatgaaatggggtatcttaaggtgccttatatagagattcttcatgcccgctgagacgtatttgttttcttgtcttgaacaagggctagtttaaattgttgcagattgtgatttatagtggttttataaattctggtaggataaaattttacaaggcaaaaattaaaagtgtctttggactcttaattaggtatgttaacttggtttatttttcttcccccaagtaaattagatctctgctgcaagggtacaaaaacacatcttcctattcatgaaagaactttcaagattggttgagtcaacctgtatggaaacttgctaaatattttatagaaatatcagagaaaaggaaataattaaagatcaatagcaactgcctacgtacactactactaaatggaagagcaattctatggcttttagtatattcagagttgtgtatccattaccacaattgattttaaaacaatttccttacccctgaaagaaggtttgcatctcttagatgtcacctctccaaacccctagtccattccagtcctaagaaaccacgaatctactttttgtctctacagatttgtctattctggacatttcatttagtggaatcattctatatatggtcctttgtgactgacttctttcgtttataatgttacaaaggttcctctatgttgtaatatgtatcagtactttatttttactgctgaataatattccattatgtggatatacaacatttttccattcatgagttgatgaagacttaagttgtatctattttctggccattataatactactatgaacatttgtgtataaatttttgtgcggacatgttttcctttctcttggatatatatctaggagtggaattgccggatcatgtggaaactcttatgtttaactgagaaaccgccaaactgttttccaatgtggctggattaggatgccaattttttcacatcctcatcaacacttgttattatctttttttttcagttttgatttattttcatcactttttctacatgatccagatattttaaaatgcaaagaaaattaactttaatgatatgttccaggatcggcactaaaaaaaaattttcagactgcaaatgaattatacaaatgaaaatatcaaatggagatccccttatccaaatgaaagcactcaacttattaaaagttcacaagtatttgtatagagcacattaaaaaagtcagcttgctaaatgttttgattttaaagaacgattgcagaagtctgaagaaaatagattagttattaaatttgggttactggacttctcaaaagctgtaagacctattagaaggttacttcatcctgtaattattaaaataataggtagatgaagaaaagatgacattttagtccctttattttggctaaattaagcactttttcaaagcccttaaccattgctgttctaagcaccgtagtaatcagtcgtttgataattctgtttttttgtatttaactacaaacctgttcgtttttcctatttacctgtcaatgttgtaagacttgtttctgaaccccctgtttaaaacaataaggttccccctgctctgaggaagctggaacacttaggagacgtaagatatacacttgttgtatccagttggtggaatcgggggatttgcagaaagaaatagcgtctgagatcataggattactgatgctggaggtaagatggcaaacaaaaacttttatttgggggtaggtttttgagggtttgtaatttgttgagggaaggaaaacttaagtgcccaacctagcatagtccttatttatgagtaagacctgttgttaaaaaacaaagaagcaggccgggcatggtgactcacacctgtaatcccagcactttgggaggctgaggtgaggatcgcttgagctcaggagtttgagaccaccctctgcaacatggtgaaaccccatctctaccaaaaatacaaaagaaaaaaaattagccgggctcgtggcgcatgtcagtggtcacagctacttgggaggctgaggcaggaagatcgcctgagccagggaggcggaggttgcagtgagccgagattgcaccgctgcagtccagcctgggcagcagagtgagaccccgtctcaaaaaaaaagcagatgaatgggttataatccacttaggtgtatatattacatttctggtaccatggacatatatctctttgaagagctggcatatctgaaaacatcagggaaccgatacaggattctaacttttgaagcccttcacaattataactacgtaccagacagagcagaatgattccataaatcccttatgggaccagttctggatctcggtcaattcatttatttcagcaaaagactttatttcttagaaagatttatcaaacattggatttctgcttgagatttcctttatcctgtgaacttttaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtaattttcttccgactttagtggctttttctctatgcacataatcaaattcattgctcagtatattttgcatttctaggtgtactgagtggggaagaatgtaagaaacagttgattaacaccctgtgttctggcaggtgagtcttgttaatatgtataactttcttaggaatacaagtggcggaaaaaaaaccactttatttcaggaatttatgtctggaggttttaagtccttcttttttgttgtttttaatataacactataaaactatttagtctgcaatgaattagtgagaaagaaatgatttactatattctgtcctctaagactgttcatatagttttatttgcttgactgtatcttcttacagcaatttagtgtgttaagatacacataattaaatgttaatttagtgtgtttaatgctccaatctaagcattattggagtctcaaggtcgtgaaggctgggaaagtcaccctgctgctgcatcttttctttttttcttttttcttttttttttgagggagtagaatatacaagtgatgtatcctttaaccagtaattgtatttctgggaatctacattaaagaatgactccaacatacaagaaaatcctcacatatgaacatgttcaacacagaaatttgtgaccagtatgagcatacagtaatagagacatgtaaactatgtaagttaaggtagagccactccatgacatttatacctattaaaagtgaaatgtatacatcaaagatgaaaaattctaaccatataattaacaaagagattactatgttatataatactgtgattgcgtgtaggtttgttaaaaagaacaagaagggaatacccaagattatctaaaccagagataattgcttttatggttccttacataagatcccttacataaatcattttaagcatgtatttgtcaattaatttgtttttaattacacaagagtttattcaatacatactgtaatataccttgcattttttatttaatacaactgtccatgtcagcatatacaactctacatcattctttttaatggtttgcagtaatctattatttggctaatctacaattgtcagattatttggttatttccagtttttgtgctattacaaagagtgttgcaatgaatgtcttttttaattttaaatagagatgggaatcttgctttattggccaggctggtctcttgaactcctggcctcaagggatcctcctactttggcctcccaaagtgttgggataataggcatgagccactgcacctggcctgaacatctttatatatctagatgaccttttataagcatgtacatggcatatatttcaaatagtaaattgggtagatctgtgattatgtgcatttttaaagttgataactactgccagcttgtcatacattccctaaaacggtatgtgaatagagtttgttttccacaatctcaccaacattgggtatcatcagaattttgattttgcgagtcgggtaggttaacaactgctatttcattgttttaaatggtatttatttgatcttgtttctcggtattgcaaaatcaaacttgaattggccctgtttttttgtcctcattaattttacaaagttatatctaaataagttgtaaagaaataaactttgtcattttcttctaccaggtgggatcagcaatatgtaatccaactcacctccatgttcaagtaagcatcatcttttcctttttctttgtatatcctgctttgtgaacttacttgctagaaattaaactatagcaaacgtaaacatcactctctcctgattgtaagaatattagtagttatgttttctgttacagattcacagattccctcctcactcctgcctcctttttggctttacttacttatttaaaacataactttattttttttataagaatgactttgcttaggtaaggttattggttcccttaaaggttcttcattagagaaaaatcaaaagggacagttataataatctattatctctttaattctctgctcccaagtttcatttcttaaaatatgtttaatggaattttaaccactgtaaagccctgaattgaatttctgaaaacaaggcagttagacactgtctatagcctttagaatctttgatccacagggatgtccctctgactgcagaagaggtggaatttgtggtggaaaaagcattgagcatgttctccaagatgaatcttcaagaaataccacctttggtctatcagcttctggttctctcctccaaggtacaaatggaaaattgtttctccttagttctggtggtatgaccagttatgaccattcaacttattcatacccttggtttatatagcagagcaaacatagccgaacatagatgctttcatttcacgtgagcaaacatagccgaacatagatgctttcatttcacatatagtggtttggtctggtaaaaggatcatacttctcatccaaggaaaacatgcattatctcttgtattgccacattttctttgcggaggtaaaagggataaagatctcagaaagggtagactataggccccataaattcttacagtaagaggtatttcaaatcttgtttcaacatgaaagtgttctatacattcttagtttgagtctaagtcatagattatttatttaaatttgtactggagaattctttaagctgaaaactactttgaattcaaattggttattttgctgttaattgggagaccttaccaattttgtattgttttcagggaagcagaaagagtgttttggaaggaatcatagccttcttcagtgcactagataagcagcacaatgaggaacagagtggtgacgagtgagtaatatagtgtagaaataaagatcatttttacaaattcatcttctcattgtgtattttagctatttcattttcttctctctcaccgcctaccttcacctcagcacaaaacttttctaatcttctcttagctactcagtaataaagagaataacatgatctcttcagctctttcattttcacctttccaggaaaataattgtcctataagctgcaagtttaaaacctatttattaggtgtcagctctctgccaggaactgtttagccttggggctaccgtgctgaaccagtcagacaatgtccctgctcttgtagaacttcaattttagtgagaagaggaaagaaaataaataacaagaaaaatgttatagtaaaagtgctatgcaggtaattcaaatggatgatctaccactgacagtatagctactttagattgggtcagggaaaacctctctcagatgtgctattttaactgaagcctgaatgataagatccataatatatagatcagagaacattctcaggtagggaaataatacaaaggcagaagaacagtgtgacatgtctgagaaagaggattttgggttttttttgtttcattttgttttgtttttgagacagagtgtagctctgtggcccaggctggagtacattggcatgatctcagctcactgcatcttccacctcccaggttcaagtgattctcctgcctcagcctcctgagtatctggtactacaggtgcgcaccactacgcccagctaatttttgtatttttagcagagacagggtttgccatgttggccaggctggtctcaaactcctggcctgaagtgattcaccctcctcggtctctcaaagtgctgggattacagacatgagccactgtgcctggccaaggatttttgttttttctttctttctttttttttgagatggggtctcactctgttgcccagactggagtgcagtggtacgatctcggctcagtgcaacctccacctcctgggttcaagagattctcctccctcagcctcctgagtagctgagattgcaggcatgcgccaccacgcccagctaactttttgtatttttagtagcgatggggtttcaccatgttggccaggctggtcttgaactgacctcaggtgatccacctgcctcggcctcccaaagtgctgggatcacaggcgtgagccaccgtgcctggccggattttttgttttttaagcaaacatttgtaggatgttcattctgtgccaggggctattctaagcactttaaacctcacaaccctattttacctctactttatggatatggaaatcgagagacaaagaatttagttagtttggcttgagcaatttattagaggtggtttcttatttcttttttttttttttttttaagagtgtcttgccctgttgtccaggttggagtacagtggcaccatcatagctcactacagcctccaattcctgggctcaagtgaccctccagcctctgcttcccaagtagctgggactataggcacgtgacaccaagcctggctactgttttttttttttttttttttgagatggagtctctgtcacccaggctggagtacagtggtgtgatctcggctcactgcaacctctgcttcccaagttcaagtgattctcttgcctcagcctcccaagtggctggcattacaggcacccaccactatgcctggctaattttttttttttttttttgagaggaagtctcactgtgttgcccaggctggagtacattggcatgatgtcaggtcactgcaaactctgcctcctgggttcaagcgatcctcctgcctcagcctccctagtagctggggttacaggtgcgtgccaccacgcccggctactttttgtatttttagtagagacgggctttcaccatattggccaggctggtctcgaactcctgacctcaagtgatccgcctaccttggcctcccaaagtgctgggattacaggcgtgagccactgcacctggcccaagcctggctaattttaaaaattttttctagagatggtctcactgtgttgcccaggctggtcttgaactcctagcttcaggcgatctcctgcctcagcctcccaaagtgctggaattacaggagcaagctgccacacccagcagagaaggtggtcttagatactaaattagaataagctgacagagaatcagattttggagaaaataattagctcacttttttttttttaattagctcacttttgaccacactaggtttgagatatatattagggtcccataaggagatattaagcaggtactctggagtagtagggagagggctgaactggggataagactggaagggactaaagccaagagactggatgggattatcaagggaaagcatgaagaaaaacctaagactgagttcagaggcattccaccatttcaaggtcaagcactttgggaggccgaggcaggcagattgcttgagctcaggagttcaagaccagcctggatgacatggtaaaaacctatctctacaaaaagtacaaaaatagccaggcgcagtggctcatgcctgtagtcccaactacttgggaggctgaggcaggagaatcacttgagctcaggaggcggaggttgcagtgagctgagattgcacctttgcattccatcctgggcaatgggagtgaatccttgtctcaaaaaaaaaaatttttttttttttttttgagaagaggccagtgatgatgccctggaagctaagagaagaaaatttttcaagaaagaagtagttaattgtgtcagatctgagatgttcattaagatgggactttattgtttttgacaacttggaggtcatttgtgacccttgaaaaaataatctaatgttattgtgggggtgagggtagaaagaggatagaagcctgattgaattggattgtactgggaagagattgtgagataaaaaaggagaaattatgactatacacatttattttacgaaatcttgtaaaaagaagcagagtctgggcacagtgaatcgtgcctgtgatcccaacgttttgggaggctgaggcatgagaatcacttgagcccaggagttcaaaaccagctgggcaatatagtgaaactccatctctaccaaaaaatagaaaaattagccgggcatagtggcacatgcctgtagtcccagctactcaggaggctgaggtgggaggatcgtttgagcctgggaggttgaggccacagtgagctatgatcatgccattgcacaccagcctgagtgacagagcgagaccctgtctcagataaatagatggatagatagatagacagacagacaggagcagaaaattgggcagtagaatttctagtaaacacctgccttcagtgattgtatgagtttagcttgagttggtctacttgctcatcgtagcacctgtccttgtctctcactcaaaaaccatagctcataccttttttttgttgttgttgagacagggtctctctgttgcctaggctgaagtgcaatggcacaatcttggctcacggcaacgtccaccttccgggctgaagcaatcctcccacctcagcctcccaagtagctgggactataggaatgccaccacatcgggctgatttttttgtatttttagtagaggctggtcttgaactcctgggatcaagtgatgcgcccgccttggcctcccaaagtgctggcattacaggcatgagccactgcaccttatagctcataactttctgttgaatcttttaggctattggatgttgtcactgtgccatcaggtgaacttcgtcatgtggaaggcaccattattctacacattgtgtttgccatcaaattggactatgaactaggcagagaactcgtgaaacacttaaaggtagcatcaaacttgtaaggtgatctgggtctcttttgaatgaaagtgtttgaacttaagccactgttatgccagttaatgacaggaaataaatactgtaaaatgaccctgggtgtggaggatctctttttttttttttactttaaaagtggaaaatacatgatgttaccacactcccttttttttaatgtcctcactttagcagtataccacatccttaagcaagccagaaagttctatttaaaaaaaccctcaaaagttctaacgcaaaaaagtgggaaaaaaggtgagaactattcagcaggaaactcaaaatctaattctaagtagattatgtgtcactgtcttatgtgaccttcagctatggcctctgctttctcatttatgaactaggatgttgcatctagtagtatatcgtggagttgtgtgatgctaagtcattcatcatgaagtatttgtaaagcagtaaaataaaactcagaagtgttttaaactatattaaaagtagtgtacagatatatttgttcctccaactttttagtttgaaaattctaactcagaaaagttaaaacactacatagcgtgaagaacacctatgttcccttcacctagattgaccaattattagacactttgccacatttacctcactttttctctcatacatattctttttctgaacatttaaaagtaagatgcagaaacccaaaccctaacacttcaatgcctgaatatttcagcatgctaagaataaggacacattatcacaataccatcatcacatctaagaaaattaacaataattccataatattatttaatttatattccctattcacattttcacagttgtctctaaaatgtcttttgcagctgtgttttttttttcctctgctccaggctctcatcaggcttcatgcattgcatttggttgttctttctttctagttttagactgatttttttgaagcatcagcccacttgtcttgtgtaatgtcccacatttttggatttatctgattgtttcctcacgattgggttcaagttaaacatttttggcaagaatacttcgtaagtgatgtgtacattttcttgcaagggccagatactaatattttacactttgcaggccatgcaggttctgtcacaactactcagctttacggttccagcaagaaggcagccatagacaaaatgtactaacgagtgtggctgttttcccatttatggacactgaaatctgaattttattccgtttttatattgtgggatattattcttcctttgatttgttttttttttttggacagagtctcactgtgtcacccaagctagagtgccgtggcccaatcttggctcactgcaacctccacctcccaggttcaagtgattctcatgcctcagcctcccaagtagctgggactacaagtgcgtgccaccacgcctggctaattttcgtatttttaatagaggtggggtttcgccatattggccaggctggtcttcaactcctggcctcaagtgatctgcctgccttggcctcccaaagtgctgagattacaggcgtgagccactgcactggccttcctttgattttttttttcccccaaccatttaaaaccataaaaaccagtgttagctcatgggttgcacaaaaacaggtagtgggttggatttggccaacaggctgtatgtagtttgccaaccactgttctgtgcattacatcaggaggaacatagtattagctaccttactatttgtgaggctgaatcatttgcttttaagaaaatgaccattgattttcttcatttataggtacatatgtatccctttgtattagaaagaaatctataggatcatagttcgagatagtattcaaaatccttttcccaacaacatttcacagaaggttttcgttttcccatctattgatgattcttggcctaaatcagtaattataccaggaattcaaattttatatcttattttttttttcttttttttgtcctcacaatctgttcccaaggaattctaattttaattagaaaattttaattgcatctttctttcggcattattagctggcattcttctgtaaaaagagcctctcctttccctattgttttgaatatcattatgcactcatgaacctttttaaattcaatgtacttattattcattactgtcattatttgttttgagcacaaaattacccaaatttagccagttggatccttcaagtcagcttatgtgttcttttgatgtgaccccatttagtctttgagcttgtggcatgatatgcccaaggctcaccatagtactttctttgccccatcctgatgctagccatgtctctaaaaagccctgggtcccttctgtaggaaaggatatttaaagaccataatctgagtaggctttaaaacttctttatcttctctgtatctgttcactctttttttaaatttaggttcgtagtaactatattgctggcctttttaccagctttatgtattttgatccagtctgttgttttctttttgttttccatttgattgctgttttattttacattttttttgttttactagtatcttttctaggccttgaaaatgtattctttaaactttttgaggcacaatttacatagcacaaaattattttattctaagcatgcaatccagtgattttttttcataaatttacctagttttgtaactgtcactataatccaattttagaacattttttatcaccctgtaagatcttttatgcccatttaatctgcattagcactcccagtcccaggtaaccactaatctactttctgtctctatagatttacctttcctagatattttgtataaatggaattatatgatatgtggtcttttgtgtatgtcttctttcattaagtgtaatgttttcaggattcacctgtgttgtagcgtatgtcagtatttcatttctttttattgttttgtttgttttaggagacatggtctcactctgtcacctagggtggagtgcaatatcatgatcatggctcactgcaccctcaaactcctggcctcaagtgatcctcccactgtagagttctgactagctaggaccgcaggcgcacaccaccatgcctggctaatttgtaaacaatttttttaagagatggaggtcttgctgtgaactcctgacctcaagtgatcctcctgcctcagcctcctgagtagctgggattacaggtgtgagctaccatatcaggctcatttctttttattgttgaatagtattccattgtgtggatatatatgagttttgtttagcagtctcccagctggtggacatttgaattgtttctactgtttggctattacaaataatgctgccactaacattcaaatgtaagtctttgtgtggacatacattttatttcttttgtgcatatatccaggagtagaactgctggcttatatgagaaatttatgtttatatttttaagaaactgcctgttttccaaaacggtatcattttacattcccactatcactatgtgagggttcctatttctctgtgtcttggccaacatttgttattgtctgtcttttttattatatccattctaatgggtatgaaacagtacctcattgaggtttaactttgcattttcttaatgactgatgataattgagcatcttttcatgtgctcattaactgttctaataccttctttggtgaaatgtctattcaaatcttttgcccgttttttgagtgtgttgtttgtcttcttaattaaaattctttgtatattctactgacaagctcttttttattttttcaataactttgttatgaatggtgacaagttctttatcaggtatataattagcaaatattttttctcagtctgtgacttgtctttttattttcttaatggtatcttttgaagtacaaaagttttaaattttggtgaggtccagtttatcaattttttcttgtagaaattatgcttttggtattgtatgtaagcaatctttacttaatccaaggtcttgaaatttttctatatgttttcctctaaaaatattacaatttttgctcttacatttggatttctgatccattcaaggacctatttttattttttattactattaaaaaatgttttttatgtctctcgagtcataaggacttttttggggggtgcagtggcgcaatctgagctcactgcaaccttcgcctcccagattcaagtgattctcctgcctcaacctcccgagtagctgggattacaggtgtgtgccaccactcccagctaatttttgtactttacaagacagggtttcaccatgttggccagactgatcttgaactcctgacctcaagtgacccacctgcctcagtctcccaaagtgctggcattacaggcataagccaccacacccggccaagggacttactgttaaataggctgttatacttttaagatgtatgtaatgggaccaggtgtggtggttcacacctgtaatcccagcactttgagagaccaaggtgggaggatcacttgaggccaggagtttgagactctcctgggcaacatagtgagacttcatctctccaaaaaaattaaaaattaaaaattaaaaaattagccaggcatggtatagtcccagctacttgggaggctaagccaggaggatccgttgagcctgggaaatcaaggctgcagtgagctatgattgcatcactgcactctagcctgggcaacagagagacccaatctttttttttttaaaaaaaaaaaaaaaagaaaaaagaaaatgtaagtaaatgacttccttttggttgctctcttctaggtaggacagcaaggagattccaataataacttaagtcccttcagcattgctcttcttctgtctgtaacaagaatacaaagatttcaggaccaggtatttttttaaaatgccattttgtttctttctgtagttggtaaaaaaaaaaaaaaaaaaaaaaaatcacagtaatctgtttttgttgtatccgttcctaaacaattttatccccttcctgccagcagcaaagctgcaataagacatgtatgtcccctctgttctctggggattgatggaaaacttttacaggtttttggtttattcctccgtttcctgttgtgtggtaagctaggtagtgaggtgggaataagagtggaaggataccacacagccccagttggaagggacaatttagctggatattcaccagcagttttactatgttgtagctttccaagagtaggttagttgcaaggatgaaatttacaatttttttcttatatgtgttccaggttgtgggtaatatttatattgacttttagccttttttcccccttttttcttaaggaaggcttgtcttcagctccttaaagttcccactgaatgtcataatttttgtaacatcttcatctagttaaaatagttgtcatagggatatatgtgaatggcagctcataggaacagttataaggttaagatttatagcatgagctatataatatttgctttattttcttatttctttcattctgttaggtgcttgatcttttatttatttattttttcatttatttttattaactatactcaaggtgcttgatcttttaaagacttcggttgtaaagagctttaaggatcttcaactcctccaaggctcaaaatttcttcagaatctagttcctcatagatcttatgtttcaaccatgatcttggaagtagtgaagaataggtaagttggtgaaccatatctcaaaaggtttataaggtgtttaatgttagaaaatgcaatgtgatatcatacttgcagcctgtgaggggaaactgatgacttaacagctgttgacgtcacacatcgaggttcattttcttaaaactggtagagcatactttttccctatggaaatatccttgaatctcaggccctggtttcttggccaccttgacagcaagcatacaaaactgaattagttgcttttgtttattccatgatattacaattctctattttccttttctttctttccttttttttttttttttttttttttttttgagacagagtctcactctgtcaccgaggctggagtgtagtgccacaatcttggctcactgcacccttgacctcctgggctcaagcaatcctcccacctgaacctctcgagtacctggtattacaggcatgctccaccatgcccaagtaatttttgcgttttttgtagagacagagtttcgccatattgcccaggctggtcttgaacttctgagctcaagcaatccacctgccttggcctcccaaagtgctgggattacaggcttgagccaccggtcctggccgtttcttttcctttttaaaggaaacagtctcactatgttgcccaggctggagtgcaatggctattcacaggctctattatagcacggtaaagcctcaaactcctggcctcaagtgatgctcccacctcagtagctgggactataggcatgtagccctgtgcctggcttggcctttcttcttttttttttttttttttttttctgaagacgtaggaacttttcactatgttgcccaggctagacttgatcttctgggctcaactgatcctcctgcctcagcctctcaagtagctgggacaataataggtgcatgccactgcatctgactcatggcctctttttaaagtgagtaaaaaacattaagagttttatttactttgttgaaatttggagcgtacagttggaattcaattattgattagccagtttagagaaattcatttaaaaccacatggaaaacatcagtaactgtcctggtttttattttaatttcaggatatacattagctgttgtaacagtctttactatgtcatgctttcactgtgtattaaatatattttaaagtttcataatttaagcataatttatggtaggcctcttctaggcctggaattcttgtttattaatagattgaatttacatgagctttgcagtagggcaaatttgaaattagagtttattgtttgagtgttttacccattgttaggccttaaagctttttaatctttgtatctcattattctttttcctgaggtttatacttgtgtctccagtattttcccaacccaatctcttaaagttgggctaaagaaggaggtactcactaaccaggaaattcctggaaagcttcccatcttctggaaatctcaactgtcataggacttgaaagcatctccatgtataattagcctggagtgggtacttgccactgggtgggaccaaacctcagctgggagagatttggatagccttattagatcctctaaaataactggctggttagttacacatgcttgccccagtcagttaatgaacctttaaataatgcattctccattttatgtaattgaatttttggctcttcagagtatgaatattgttaactctgttaaagtcttataatttatccataactgtctacttcattctgtagtgctgcattataatttgttgcaatttaacaggtagatataatggataaaggttatattcacattatttccactgtggggtataacattaagtggtataaaaccaccaatgattctactcttttacaaaagattatttgtagttttagcttatgctgttgataccagatcactcatccatttatagtataaatatctactgagtgtcttttatatgccacccttgtgctaagcaatgtgggtaaaaatatgactatactatgacctctctcctagagaatctctgtctttggaggggagctaatttgtaagcctctacataagcgttgtcagtgctgtagggtaatagaagaggcagcaatgaacttctcatcatgaaatcttgaataggaatctttaatttttttaatactctctagcttctggattttcccagtattctgtgtgtcattggagaccacttgcctgctgttcccattatggtacatttaggaattcagaattctgtcagacgatgtgtgtaaagaaaaggtttatatgcagagtacgttgattatctaggtcaagtttgggaaatgtataacagggcaatgagtataaaggtaagaatatctcactaagtttttcttttttaactaagctttgtgttcttgtagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaaggtgagacactattttggcaaccactccctaattttgtttaaataatccaagtagggcttggcatttgcctgggagtttggtggacaaggaaatttgagtatgtattagtttgacagaggatatatgacagagattaggataatattgaaacattatagatccagtttgatggaatacttacttacgtattcttctatgtaagtttttcatttattccacttaatccaattgtttctgacctagaagtttgaatataagacagctttttcatgatttttccttcttcttccagaagtaaaccatttctagtttttgttttgttttgttttaatgctgttcctttacacagaagaaatttttttaggtcactgtagagcatcaagcttaaagagtcatgcttaagaatttttactgaaaataaaacaaagaatcatgcttggtcgggcatggtggctcaagcctataatcccaacactttgggaggctgaggtgggcagatcacttgagctcaggagtttgagaccagcctgggcaacgtggcgaaacctcatctctacaaaaaacacaaaaattagccaggtgtggtggcacgcacctgcagtcccagctacttaggtgactgaggtggatcacttgagcccaggaagtcaaggctacagtgagctgtgtttgcaccactgcactccagcctgggtaacaaagtgagatcctatctcaaaaaaaaaaaaaaaaaaagaagaatcatacttattggttcattgtttctgaagaaaccaaaatgggaaatgtacatttttttgacattattaccaaattatcactgacatctcaatcttaattactgaaacagttttcaaaaatttattttctcttgaataaaaaaatgctagatcatatctgaggttaaacaacttttctagtaattcctctaagtcttcttgatgttcaattgtttaatgtagctacacaccaagagtgtctgctgaaaatgtttatttgggaggctgatctaaatgtaaatctagtgttctaatccagaactatgaagtaaatgtcagaatagttcttgagagttatcagtgtatttgatgatataaattaccctgcttaacagtgatattgttaaagacattatcttagagtatgtttttatatttaaattattatttttcaaaactaaagaggctccatttgatttcacatggatgtcggctttatcaaggcatctttataaattgctactaagtcactaacagtctgaggtctgaacgaattagtctgtaccataaagtaatcaagttgaagtaagaattttaactacaattcaagtgaaaattcagaatgggtctttttaacagcaactgctgtgcttctagaaactgagaaaggggttagggaagatcttttaagtttctagaaatcttcatgggcttttacattttaatttttagaataaaagttatgtatactgtcaggaatatggatattgtcaggtaatggatacctaagtagaattgatcctgtttgatgctgaaccttatatgtagcaatagtttaatgtgatctgtacttttaggctaataaacatggtatttatcctactaataaatcatctaagcacagaacaaggggaaagttgagtgattctgtctttccagatgattcacattatattctgattttttgagttttactcatatccaaacggttcttcatgctgcctgacatgcattgatatacttaaaagctgaagggtcacccaggaatattttatttattctgttctttttagatccatgagatgatcagacaagaaattttggagcaggtcctcaacagggttgttaccagagcatcttctcccatcagtcatttcttaggtattcaactttgaaagaatgaataaagtttttagaaatattttcatttcaatgtcataatcatttggtcctgggaaaaaaattttaatgagcatttaaatgcagtatctttgataggatgccaataaaggaaatccatttatgttgtctgggattgtcagttgtcaaaaaggctgtagctgttagtaaggaaagcaacaattaaccaataagtaaaacttccattttgctcaacattttctctttttgttaatacctctcaaatgagtgctgtcctgctgctgccactcattgacttcctagtccttttagccttgacatttggactgcacagtgtttctctctggtaacctctgaatttgctgttttgttgttgttgttgttgttgttgttgttgtttcttttttagacacagtttcactctgttgcctggagtgcagtggcgcaatctcagctcactgcaacctctgcctcctgggttcacgcagttctcgtgtctcagcctcctcagtagctgggattacaggcgcacgctaccacacccagttaatttttgtattattagtagagacagggtttcgccatgctggccaggctggtctcgaactcctgacttcaggtgatccacccaccttagcttcccaaagtgctgggattacaggcgtgagccaccatgcttggcctgaatttgctgtttttaatacataactcctaatgtctaaatttactagccttcatcacaaattttaaaaatttctccgtgtcattcatcactgtttataactcccctgaaactttttaggtaagttctctgattactgtaagagtctgcttcttttcctgcctgtgaccagttttccttttacctcaaatataatacagttcccttcaaacaaattttccttttcattgctcctatttccattatttgaagcatggttctccaggtcctggaggctggaattaccttttattttctcaaacacaagttctgtcatttttctccctcatactgtcattgtttctatctttttattccctcctcctcccaacctcacatccagtgtctaattcctattcttactaccttgaatttagactactgccacagctttctaactggtttcctggctttttcttctccctgcagcaatttaacctgcatattaccacacattagtattcctaaaataccaccttatgactacagaatcatcaatatgttctttagtaaattgtcagctctttttgtttgtttgttttttgagatggagtctcactctgtcacccaggctggagggcagtggtgtgatctcagctcactgcaacctccgcctcccgggttcaagcaattctcctgcctcagccttgagagtagctgggactgcaggcacgtgccaccacacccagctaatttttgtatttttagtagggatggtgtttcaccatgttggccaggatggtctcaatctcttgacctcgtgatccacctgcctcaggcttccaaagtgctgggattacaggcgtgagccaccacacctggccaaattgtcagctctttatcctggcactgaaggtgcttgacaagttgatcccaccctacctttccattgttaaagtcagttatttactttcctggattcttcaccccagcatcattgatttccctaccatcttctgaatatgtcttaaacttacctttctcatacctttactcatacttttccctttatatatgtaggcctttctggtgctttgtgcatttaaatgttccccatcttttagaacctagtttaagttccttctcctcattgctttcctaatatataccaactcataatgagctcttcttcctttgaactcctatttaaactctccctttaccatttggtaggcaataaactatgtttggaattaatagatatttgatattgctctgtgatttacctctttaattctttaaaaaaatttttttacttccaactaaattattaaaatttttgaagaaagactatgttttatacttttatgttcctaataggaccatattacgctggtgcatagtaaaaattcagaaatatttattgatttattttagcttagaagtaagaagatgtgtgctactacttatgtctaggcagtgtaatcggtttcttcctttcttttaggcagtttaatttttatagaaattgaaactatcatagaaaaaagctaaaattatcctggttacattggagaaaaagtatatatagcatcagtagaaatttgtattgcagtatacttgacttatttgagaaaggaaacaaaagacttcacatttctttctccgtatttttcttttatttcagttatctttagttatttgagacaactgattatagattctgtttttcagacctgctttcaaatatcgtcatgtatgcacccttagttcttcaaagttgttcttctaaagtcacagaagcttttgactatttgtcctttctgccccttcagactgtacaaaggctgcttaaggcagtgcaggtaagtcttcagattcccaagtaacttgccaaaactgaggtttaactgtctagtggaagtctgatgcatttttgtataaatatatatgtctaagaaattctattccactttagtctgaaacataaaatttgcattaaaagggcaagagcattgagcaagactgttttccaggtttatttcctatccataacactattctctcaactcattttcaagttaatgaaataattaaaactctcttagaacattattgactacaatagatttacagaggcatttgcaaccagtttcattttagtgtttcagagtatactattgtccttgttaactgtaataaacattaaaacgtatataaaacagaagtaagcttccttatagaagccatatggtaacagtattgggtagaaatgacctaaggctaataagcaaacttgttctgtttttacccactgattctttttcagccccttctcaaagtcagcatgtcaatgagagactgcttgatacttgtccttcggaaagctatgtttgccaagtatgtagcatctttttctatcataggaagacgttgtcttctaatgttggagctaaagttatctctgccatctcctagtaccacctgttcacagtgatcatgagaattcctagccccgcagagcaatttcatcaaataaggcattttgctaagtgctttatgtgcttttttcatttagtcttcagagcaaccctatgaagtaagaattattgcaattcccattttacagataagaaaagttaggcttagagaagatgagtgactttccaaaagtaaaacagtagttggtggtggagcaaggattcaaagtcaggtctaacatcagagcttgtgatgtcaagtactttgctctactacattagaataatcttcagggtaatgttctagtgtcaaatactctgaaacctgagctggcagcagttccaaaggggaaagtaccttagtcaagaagattatacttaagaatctcattttagtgaacatctgaattatgatctagaggctagtagatcaaattaattgttgaggggaatgagttttatttgtagcttagccagtccctcctaacatctcttcctttatttcttagtatataagctagagatgatcttgccatctcctaaaaatataagacagtaatatgtgaaaagcatttggtactttgaggataagatgcccaattaatatcacattggccatattataatatattcatgggtgtccagaggaacaactaagccatatgctattatctttgttctagaattaaaagtttttgttactcctcacccaaaggcatagcgaatagactgagatattacgttgtaacatctttaacatgaattaatcattgcgcctcagtgagaagacaagtgtgacattttctggatggacagtttacatggcatcaaatattacattatcctatgatgaaagagagcatatgaagggaagcactccttcaaacatggcaaaatcagcaatttcttacatttgagtaaccagccaattttacagtctctcagcagtcttcttattcctcacatagacttgagagcaggatagaaggaagtagagtatcatgagttaagtattgaaaaaagtcagttgaatttctgtactataaattgctttgaacagctgataccttattttgagtacataaattcactttgttttgctctacgcttcattgtttatacatatgccttctctgtatgcaactagctggatttttctgacccagaagcatattcctgtgaaatagtactgtttgttaacttctctatttctgagctagccagcttgatgcccgaaaatctgcagttgctgggtttttgctgctcctgaagaactttaaagttttaggcagcctgtcatcctctcagtgcagtcagtctctcagtgtcagtcaggtaaggattatttatgttaacttgcagtgtgtgcgtatcattcatgtgcatcgatgaaatgcacgctgttttcttttattcctgttatggttgtaagaatgatcctagaactaaagagtctgatgatgatgatggtgctgatgatgatgatgatgatgatattggctaacactcattaatggcagatttactgtatgctaaactgtgctatccagtatggtagccactgtcctcagtgtggctattgaatggaacatttgattgaaatgtggctagtccacattgtgttgtgctatacatgcaaaattcataccagattttgaaataaaagaatgtaaaaatctaataatttttaatattgattacatcttcagagagaattttgtatgtgttgggttacagaaaacattaaaatttgactttatctctttctcttttttaatgtggctactagaaaatataaaattacatacatggcttgcatttgtggttcgtattatatttctttctttttttttttttgagacggagtcagtctgtcacccaggctggagtgcagtggcgcgatctcggctcactgcaactcactgcaagctctgcctcccgggttcacgccattctcctgcctcagcctcccgagtagctgggactacaggcgcctgctaccgtgcctggctaattttttgtatttttagtagagatggggtttcattgtgttagtcaggaggtctcgatctcctgacctcgtgatccacccgcctcggcctcccaaagtgctgggattacaggcgtgaaccaccacacccggcccatattatatttcttttggatagcacggtgctagatattgtgccaaaatgctttacatttattatctcatttaatcttcacagcagtcctctgaggctagatactattattatcccattttcttacgtcagtgtatttactttgcacaggaacatatattacaccttgtaatctgggaaaacaaaactttttataataatctggtaatctaggctttggagcaataaaattgtcttcataatttaaatgatgtactataagatttataaataggagacatttatatataacagtttgactaggaatcctcactttattgctttggtataactacataaagctttgtctataacatatagcatagattaaatattaggaacactaggtatcatttgtgtgttattatccccattttaaagacagggaaactgaggctgagccaggttaaataacttgcccaaggttaaataaccaagaaagggtggaagaaggatttggcctcaggcagtatgaactacattactgtgatgcctggagtaaggattaggaattcttggtctataattgctgattttattatgtaatttacacaaaggatgtcagttctttgtcatgtccatttctaaacaaaagactgtcttcctctcaacctttctagaatttgtggaatagtgagattcttctagctattgaagaagtcttagaccttttaaataaaattatgtatattgttactactggattctagtggcttgaaataagcagtgtaccttcctaagcaattgatattgtcaaggaaaccttaaggaatatgaacagttaattttgttaaaatgcttaaaaattctcttattccaaaccagaataagagtgacacttactactgcatggtaatgattatactgtgtgtctcacccctggggtttggcatgtggaggaagctaagttttttcgaccaagaacataggctcatttagctccttattggaaacagctttggtaagatagacgtgaattggcctgtcttcctttcaggttcatgtggatgttcacagccattacaattctgtcgccaatgaaactttttgccttgagatcatggatagtttgaggagatgcttaagccagcaagctgatgttcgactcatgctttatgaggtaagtccgtagaatggaaagaatgtagcaaaaccccaactaataatttttattttagtaatttttttcctgattataaaagtacaatagctatgctcttacttgatgtagtcagcaccagtagctagtgatgtttagtcaaaaagttgtttaaggcagggcacagtggctcacacctgtaatcccaacaccttgtgaggccaaggcaggaggatcaagcaagactctgtctttacaaaaaataagaaaataaaaaacattagctgggtgtggtggcatgcgcccgtggtcccagctactcaggaggctgaggcaggaggatcccagcagtgaggctgcagtgagctatgatcacaccactgccctccaacccaggcaacagtgagaccttgtctctcaaaaaaatttttttaaggtgagaaatcataaaacacagttgatagaccttaaatattttattttaatttgaaatatttaaatatactataaatttgccagtcttaagactaagtcctttttttttgctttgttaatgattacaagtttacttcctgcctctcatacaaacccatacccttaatttattgcctatagtttcaaatttgtgtttacctaaagtggtatgaaaactttaagctacctcagatacagtttagcacaaaaatcttttagatagcttcagttttttctctttttacaattgtgttacctctaatttatcagaaattggtttgagagactgactttccaaacatttttccaaacttagttttttttttttctttgggacagagtctcgctctgtcacccaggctggagtgcagtggcacaatctcggttcactgcagcctccatcctccatctcctgggttcaagcagttctcctgcttctcaacctcccaagtacctgggattacagccatgcaccaccatgcccagctgatttttgtatttttagtagagatgggatttcaccatgttggccaggctggtcttgtactcctggcctcaagtgatccacctgtctcggcatcccaaagtattgggattacaggcgtgagccaccatgcctggcctaacttagtttttataaaagcaacttctttttctttttgcactgggttttcaacagtttactgaacgtctgattaaatcactagttattatgacagtacagctaagagaaatacaactactgacttgtgattagcatataactcacccagaggatattgtggtagcatatgtgaaaacaacattcatctttctgtacatttccatcagagctcttagatgcctaggtgcactatcaatgagcagtaatattttgagaagaatctttttttttctgagcagtaggtctcaacagtgggcttaaaatattcagcaaaccatgctataaacagatgtgttatcatgcaggctttgcttttccatttataaagcacaggcagagtagatgtagcataattcttaagggccctaggatttttggaatagtaaatgagcattgatttcaacttaaagtcagcagctacattaacccctaacaagacagtcagcctgtcctttgaagccaggcattgacttctcctccctagctaggcaagtcccagataaagtcttcttccaatataaggctatttcatctacattgaaaatctgttgtttaatataaccacctcgatcaattatgttagctatatcttctggataatttgcctcagcttctccatcagcatttgctgcttcaccttgcactttttttttttttttttttttttttttttttgagtctcactctgtcacaaggctgtagtgcagtggcacaatctcggctcactgcaacctccgccacccaggttcaagtgattctcctgcctcagcctcccaagtagctgggactataggctcacgccaccatacccagctaatttttgtatttttagtagagactggggtttcaccatgttggccaggatggtctcaatctcttgacctcgtgatctgcccgcctcggcctcctaaagtgctgggattacaggcgtgagccactgcgcccagccccttgcacttttatgttatggagatggcttctttccttaaacctcatgaaccaacctctgctcgcttcagcttttctttggcagcttcctcatctctttcaggctttatagaattgaagagtttggtccttgctctggattaggctttgacttaagggaatgttgtggctggcttggtcttttaccagaccactaaaactttcttcacatcagcaataaggctgttttgctttctaatcattcatatgttcactggaatagcactttaaatttcctttaagagcattttctttgcattcacaacttggctctttggtgcaagaagcctagcttttgacttgcctcagcttgtaacatgccttactaaactggatcatttctagcttttgatttaaagtgagagacgtgcgactcttcctttcacttgaatacttataggtcattgtaggggttattaattgacctaatttcaatattgttttgtctcagtgaatagggaggcctgaggagaggtggagagatgggatgatggcccagtcagtggaaccagtcagaacatacacagcatttatcaattaagttcactatcttatatagacacaattcgtgactcttcaaaccaattgcaatagtaatgtcaaagatcatttatcatagatccccataacacatacaataataaagagaaagtttgaaatattatgagaattaccaaaatgtgacacagagacatgcagtgagcacatgcttttggaaaaatggtactgagagacttgcttgatgtagggttgccacaaacctttaatttgtaaacgtaatatctgcgaagtgcaatcaagcaacttgcaataaaattaggtacgcccatattctgtataaaccacattgtttaaacagttaaggcacagtgagccactcttctttagggtgagctttgtgtcagtgtaagtaactgtttaccagctaaattctcagccaccagctggcaaaggtgcactaaggataggcagtcttagacttcatgtgttaactcttgtgcagtccttgatatgccccttcccccccaaaaaaaatcttcacccttatttagctctaaagtaaaaaaaattaacatgaagtggatcatagacttaaacctattagaatattgctgttcatttattcatcagtcttagtatatcattggtatataaaaataccttatgtagtgataaaacttgtcatatttgttgcaagtgtatgccagattgccatttgctttttttttaatatgatccttttacacttaaataataatttttggttactaaatctattgattttcttcctctgagatgtcttctattacttttttttttttttttaagagacagagtcttcctctgttatccaggctggagtgcactagtgcagtctaactcactgcagcctccagctcctaggctcaaataatcctcttgcctcagccccatccccaaacgattgggaccataggcacaagccactgcacccagctaatttttctgtttgtttttttttttaaccttttgtagagacagggtctcactttgttgcccaggatggtctcaaatgccctggcttcaagcgatcctcctgcctcagtcttccaaagtgctgggattaaaagcatgagctaccgtgcccggcccatctttattattattttatctgtagaaagtccaaatccttccaatgaatattcactaacattttctttgaggtttttttttttatgcatttgtttttgacgtttagctacttaattcatcctgaatttgtatgataatatatatgaggagcttttcccccaagctaaccatttgttcagacatcattgcctccttaatgtgtactatgtatctctgtatgccattttaaaattttgcctgtagatttttgtgccaagacaaagtgtctttttattattattacacattcataaaatattttaattgctgttaggattaattttcctttgttccgttcctttcccctttcccctttttccgttttcctttcctttccgatggagtctcactctgttgcccagactggaatgcagtggtgcggtctcgggtctcagctcaccacaacctccccatccccagtttaagcgattctcctgcctcagcctcccaagtagctgggatcacaggcgtgcatcaccatgcctggctaatttttatatttttagtagagatggggtttcaccatgttgaccaggctggtctcgacttcctgacctcaggtgatccctcctgccttggccttccaaagtgctgggattacaggcatgagccaccgtgtctggcctgtttcttttctttaaacaaaaaaatttttttgatcaattctcatttgcttttactcacagatgaactgtataacctcttttccaggttccagaatgaaagttctccccaggattttttttttttttaagacagagttttgctctattgcccaggctggagtgcactggtgtgatctcagctcactgcaaccttcatacctcagcctcccgagtagctgtgattacaggcatgtgccaccacacctggctaatttttgtattttttagtagagacggggttttgctgtgttggccaggctggtctcgagctcttggcctcaagtgatccgcctgtctcagcctcccacagtgctgggattacaggtgtgagttacttcacctggcttccccaggattttactctgagcagttcttaactaagactaggacattttgggtgggaaaaaaatatggtcatttatattagggcatttaggactgtcaaatatggtctcaataggaaaaaactgagaagaggataaagaaagtgttatttttaagttatgattgtccagatcactagtatctctgttaaagtgcttatttcttctctttgattcctcttaggggttttatgatgttcttcgaaggaactctcagctggctaattcagtcatgcaaactctgctctcacaggtaaaatacatttttatggatatatggaaaacagaccatcaaggatcgagagacagttgatggttttcagacctttcaaaatataaaataattcccaactagtacattagtactttgtgaacatgctgtgggtatgttatgctgttctgggttgtcttatctcggtcaccacttacctgtctgccataataccatcatctagcagttatccttgtgaattaacagtctgtatcctaagtcagaaggacattttgaagaaccatttatataaggaccattgcaactgtatccattatgttatatttctgaaagaaaaaagaaatccaaaacaaatatagcaaaatattatttcttaaatctgggtaatggatacatggatgtcttttacattcctttctgcacttttcagttaacaaatttttaaattagaagattaaattcttctaatcttcaagactagaagaattcatatagagactctctaccaggagggttcctttagacccctagtctatcattttgtttgctgtctctcaatgccattgctttgtgatagttatgaaatttcatttaaaattaaggtctcagatgtgtgaaattattggaagttcccatactgtccatcaaaagcttttcatctggccttaggcttgatcctatataaaatttatattctgtcagctatattgtatctttcaaactgtaatcaacacatctacattcacacgtttaacaaaaatagaaaattatgtttgaaggcatagaatagcgctttctgactcaggttaatatgcaggacagtaaaattctgcagactccaaaagttaaaaggagaaaaataataactcatattttttttggctgtcttatatgccaaatactgtttgaagtactttacatgtattgtcatgtttaatccttatacaatgattattaataatatcctcatttttaagatgaggaatcacggtacagatacttttataaaaaccagtaataagtagtggtactgggatcttggactcagccagtctgactctggatcctgtatttttaacctccaagttaactgaaaatgttgattgcatgtacaagtttaggaatagaaggaattggaataggaaagatgatcctaatctgtacaatatccaaagcaagagcacaggatgtgggtgagccaaagaaataaaaacttggctgcattgttctttgaacagttgggaaatgtgtgttagaaggcattagacattaaagatacctttcacctgagaagttaaaaaagtaaaaagcatttatgagccaagatgtcttttttttcttactatacacagttaaaacagttctatgagccaaaacctgatctgctgcctcctctgaaattagaagcttgtattctgacccaaggagataagatctctctacaagaaccactggtgagacttttattcttccttcaaccattatttttagtattaaggatagggttgaactttgcaaagagatacctttccctgtgaaactctcttcctggttcttccaatgaatgtttacttttaagtcttccctgcttatcatttctgaaccattatcattttggatctattggtaagttatctccatgttagccctttactaaatcaaggcttccatcacttcccccagagaatattttatctcatttatgaatctttgattacattcactaaataaatgtactttagaatggggagagggatgatgtcacctacgaacagatgaacctaggggacctgcttcattagtctagaggaagtatatgatttaggctgaactaggattggcactgttgaaccttcagaggagctaggcctggttgactttctgttcttatctagcctcagaaggacagcgaagaggataaaaatggaaactcccaccccaagtgacttataactcatggcagaagaaaggaggaagtctttcagttgtcatatcttgccttcatttttgtgccttctgtgacatgagatgtcctcagcctagatctaagatgctgtgttggtctcctaaagattccctcaacataaacctctatctttagaatagcctctgggactcaaatgaactagagaagatttaacttcaccacctagctccagggttatttatcagaccagagatagcacatctaatgttgcattttgaggtgtcagccacttaggccaattttcggggggaagcattagaaaaggatgctgctgttcaattaattttcccagttttgttaatttagatggacttaatttgtaacgccaatgaatcattttctttagccttatagataagaattatttgctggttatgaacaactttataagttatccatcaacactcaagagtatttaatttacttattttctcctacaggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggtaattgctaagtcctcagctgtattgaatgatggagttctttagtagcttgttaatttttatcttgtgtcttttaggataaatcagcagatttttctcagagcaccagtattggcataaaaaataatatctctgcttttcttgtgatgggagtttgtgaggttttaatagaatacaatttctccataagtagtttcaggtaaggttttgctataactccatttgtaatttgatgaattctccattttatttacatatttttactgtagcagtattctaggcagtaaacagaccacagacgatgacactgtctcttaaatgagcacctagtctaagactaaactgtgttctttccactagagagcgctgaagtatatgcttaccaggcctataaaatgaaagccttccagcagggtttcacttactcagaatttcccagaccctgaattcaagaactcctaattttaacatggaaattttgattggtggtagtattggactttaatactctgcagggactggtataaataagggaggggaggccaggtgcggtggctcacgcctgtaatcccagaactttgggaggccaagctgggtgtatcacttgaggtcaggagttcaagaccagcctggccaacatggtgaaaccccatctctactaataatgtaaaacttagccaggtgttagtgcctgggaactgtagtcctagctactcgggaggctgaggcaggggaatcacttgagcctgggaggcggaggttgcagtgagccaaggtcacaccaggggaaacaaaacccagatagattgctgtgacctgggagtattatattaatgaagttctattcatttataatgttacgtctaaaatatgacatttaaagaagcattgtgattattatcatatgtaaaagtaaaccacaatattctgatgtttgtccttagcggtctcttttttgttttttacagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcaggtaaggttctgctagagtgcttaaagacagccactccctgaggatcgtatacctacctaggctcacttgtttcacctcgtttggattgtttacagtaagaaataagtcaggaggttttatttttcttgaaataaaagctggacaatcctaggtaggtactttaagtaggtaccttgaattattaaaggacaaatgagaaacagtgggccaataaatgaaaagatagggatgaattccagcagggtgttttaagaaaatctatgtaagtagcttgtacaagataacagatataaaaaggtagggggtgccaggcatggtgcctcactcctgtaatcccagtactttggtagactgaggtgggtggatcacctgaggtcaaaagttcaagatcagccatgaccgatatggtgcgacctcatctctactaaaaatacaaaattagccgggcatggtggtgcgcacctgtagtcccggctacttgggaggccgaggcaggagactcacttgaacccaggaggcagaggttgcagtgagccgagatcatgccattgcactccagcctgggcaacaagaacaaaattctgcctaaataaataaaaaggtagggggggtgactgaattaaaaatacaaagggacaaaaaaaaccaaacctaaaagactaagactgacatttaaattttatcaaagtaaaggatttggggagggagagaaaatgaggaaccactaagaataacgattataaaagggcagccatagcagtgactatagcttgggctgcctagagagtctgccagtcggaacttactggcaagctctgttaggtgctgctgttctgaacaatttctagaaagcttaattccatataccaatagcagtaagggaatcttcctttttctttctctctctctgtctctctctagggatagtatccaaagccaccaagaaagcctttctgttctcaggtccagcaatgagtttatgcgctatgcagtgaatgtagctctgcagaaagtacagcagctaaaggaaacagggcatgtgagtggccctgatggccaaaacccagaaaagatctttcagaacctctgtgacataactcggtaagccactcccaccccttagaaacttattccacttggctgtggtgtctccaagagaacaaactgggaacagaggatgaaggtaatttgaggttggacatattttaggagtgaaagaatataaaacattagccaggtggcaggcacttgtaatcccagctactcaggaagctgaggcaagagaatcacttgaaccaggaggtggaggtcgcagtgagctgagttcataccactgcactctagcctgggtgacagggcaagactctcaaaagaaaaaaaaaaaaaaaaaagccagacatggcagctcatgcctgtaatcccagcactttgggaggctgagccgggtggattacctgaggttgggagttcgagaccagtctgaccaacatggagaaaccctatctctactaaaaatacaaaaattagcctggcatggtggcacatgcctgtcataccagctactcgggaggctgaggcaggagaattgctcgaacctgggaggcggaggttgcagtgagcctagattgtgccattgcactctagcctgggcaacaagagcgaaactccatcttaaaagagtgaaaaaaagtgcagtcattgacatagggtcttttttctagtcttgccttcccctggcgccccccccacctttttttttttgttgttgttgttgttttggctttttttttggctttttttgagagagtctcgctctattgcccagggtggaatgccgtggtgcaatctcggctcactacaaccccttcctcccaggttcaagcagtccttccactgcagctttctgagtagctgggactacaggtgcacaccaccatgcccaactactttttaatttttaattttagtttattttatttactactttttttggagacagggtcttgctctgtcacccaggctagagtgcagtggcgtgatcttggcttactgcaacctcggcctccccggttcaagtgatcctcctgcctcagtctcccaagtagctgggattacagggcaccaccatgccctgctaatttttgtatttttagtagagacagggtttcaccatgttggccaggctggtctcgaactcctgacctcaggtgatccaccaccctggcctcccaaagtgctgggtttacaggcgtgagccactgcccctggcccttattttttttttttaattttctgtagagataggatttcaccatattgcccaggctggtcttgaactcctgggctcaagcgatacgcccatctcagcctcccaaagtgctgggattacaggcctgagccactgtggcttttgttttttcgtttgtttttttgttttgttttgtttttgtttttgtttttgtttttccatttaaccctgagtggacacagcacatgtttcagagagcacggggttgcgggtaaggtcacagatcaacaggatcccaaggcagaagaatttttcttagtacagaacaaaatgaaaagtctcccatgtctacttctttctacatagacacggcaaccatccgatttctcaatcttttccccacctttcccctctttctattccacaaaaccgccattgtcatcgtggcccgttctcaatgagctgttgggtacacctcccagacggggtggtggctgggcagaggggctcctcacttcccagtaggggcccctcacctcccagacggggcggctggccaggtggggggctgacccccccacctccctcccggacgggacggctggccgggcagaggggctcctcacttcccagtaggggcccctcacctcccggacggggcggctggccgggcggggggctgacccccccacctccctcccggacggggcggctggccgggcggggggctgaccccccccacctccctcccggacggggcggctggcctggcgggggctgacccccacctccctcctggacggggtggctgccgggcggagacgctcctcacttcccagacggggtggctgccgggcggaggggctcctcacttctcagacggggcggctgccgggcggcagggctcctcacttctcagacggggcggccgggcagaggtcgctcctcacatcccagacggggcggcggggcagaggcgctccccacatctcaggcgatgggcggccaggcagagacgctcctcacttcctagatgggatggcggccgggaagaggcgctcctcacctcctagatgggattgcggccgggcagagacgctcctcacttcccagacggggtggcggctgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgtggttaggagctggagaccaacccggccaacacagcgaaaccccgtctccatcaaaaaaatacgaaaaccagtcaggtgtggcggcaattgcaggcactcggcaggctgaggcaggagaatcaggcagggaggttgcagtgagccgagatggcagtagtacagtccagctttggctcggcatcagagggagaccgtggaaagagagggagagggagaccgtggggagagggagggggagggggagggggctcgtttgtttttttgtttttgtttttttttcatttaaagagatggggtttgcagtgttgcccaggctggccttgagctcttgggttcccagggcttctagtcttgctttgatatggattgttagtcacatataaaatgttatgctattattggggaaaaaaagagggatattacataatggttaagtgattcaaaatacttaaagcaaaaactgatggaactgaaggaaaaatagacaaatccttaattaatgtaatcagccctctctccatagtcaaaaaacagaaaacaaaacaaaaaaaaaccagtagatagaaaatctactgaaaggaggtagaagaagtgaacaacactgtcacccagcttgatttaattgacacttataagaacactccacagcaccttcaaaatacacacttctttttaggtgcacatggtgtattcaccaagatgagccatattttgggccataaaactcagcaaattaaaaaaaagtagaaattctctgaccaaacagaattaaagaagaaagcagtaacagaaagatatctagataatccccatatattagaaattaaatgcatttttaaatagcccatagtcaaaaagtcgtcagggaaattagaaaacatcttgaatagaatggaaacaaacagacaacatgtcaaaagatatgatccagccaaagtgctattgaggaaattaaagcagttagtgatttaaaaatctcagatctcccatataaacttccacattaagaaaatagaaaaagaagagcaaattataatgaaagtaatcagaaggaaggaaatagacaaaagcacaactatgaagaagcagaaaattaaaatagaaaacattaaaagaaagctggttctttgagaagatcaataaatttaatgaactttagccagactaatcaggaaaagagaagacacattacaaattgcagaattgaggaagaagggacatcactactgatcctacagatgctaaaaaatagataatagaatattaacgattttatgccagtaaacttttaagtttaatggacagatttcttgaaagctcactcaacaaaaaataggcaacctggccgggcgtggtagctcacatctgtaatcccagcacttttgggaggccgaagcaggtggatcacctgaggtcagcagttcaagaccagtctggccaacatggtgaaaccccagctctactaaaaaaaatacaaaaattagctgggcgtggtggtatgcacttgtagtcccagctactcaggaagctgaggcaggaagaccacttgaatctgggaggtgtgagtttgcagtgagatcaccccactgcactccagcctgggtgacagagtgagactctgtctcaaaaaaaaaaaaaaaacctgagtaatcttatctctattcaaaaaaacctgagtaatcttatctctattcaaagaaattgaatttgtggttcaaacttttttcacaaaacttaagatctaggtctattccgtggtaaattcatccaaacatttaagggagaagtaatgtaaattctgtgcaaattcttccaggaaataggagagaacatattccacctcatttaattaatgaggtcagcattaccctgataccaaaccagacccagaccattgcaagaaaactgcatagcaatatccctgatgaatatagagtctgctgtgttaaaggcagactcagaaggctatatactgaatgataaccatttttgtatgatgtttcgtagaaagtaaaaccatagggacagaaattagatcagtagttgcttggaaatgggaggagagaattgactatcagtgagcacaagggaacttttagagtgatagaaataccttgattgtggggagattacacaaccatgtaagtttttttaaacttctagaactgttcacctacagggtaagaattttactgtttgttattttatctcggtgaacctgtctttaaaaacaataccactttctcctgcttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctgggtaagcattgcagtatcaataaataggcttgatttaggtttctccttagctcaaccccttaattccatttgttaacctaccagaagacacttgagaacagtcctaatgttgctaaggagtgacatctagtggattcaggattggtacctactggattacattcaaccacaaagagtggctggaaaatggaatatagtattaagaaatcacaaaattttagaaatttaagtctgcctttagacttttttttggctttcaaaaattttagctattaaaaggccaaaaagtatgagtttatatcaaagaagacaagagtttcttttccattcctagatgtcacagataaggaaggagaagagagagaagatgcagatgtcagtgtcactcagagaacagcattccagatccggcaatttcaggtgagaagccttgcaaagctgctgtactggcctgagaggctttgcaaaggaactgttagcaggggcagctggtaagaatgggcagacagtgaccaagtaggagaagaattttttctgggtcatacaggcaacaggacatagctctcagaatggaagataatgtatttaaaaggaccctagtgaggataggtatttagccaccccaacctgcaatactcattacttctaaggaccactgtttgagttgatgtaaacagaaaggagtcttcaaggcatagagtctgtgtttttgttttctgagtctgtggtataatttggcttggtctgacagacaacgtaaacactggacaataaagtttgttagtttctaaccaatagttgtcaaaatatcaggatgttctatcacaggagttttttatttaacaagtaattctgaagttcctaccatgtgccagaaacagttctaggtgctggggatgtagcagggaacaaaagagacaaaatattcctatccttatggagcttacattatagtagaaagacactgacaaataatcaaatacatagttatttcaggtaacagggaaggtatataagcattgctgggtttggtgccttttctaagcctgagatcaatggataggctccagggagctgtgagccaccagaaattgggtacatagttcattatctacattttgcatggggttggaacggaaagagtcagttttcaggagcattctcagagaggtttatggtcaaaaacagcttaggaaactactgctcaattcaggtgtattttcagattttatcctcttagaattttggtagctttgaattctttctgtcctagtcttaggagtctctgactagatgcctcttcttcctgataggaacgtgtctgctaacattgcttgctgtgtgtgccttcctttctcagaggtccttgttgaatttacttagcagtcaagaggaagattttaatagcaaagaagccctcctgctagtcacggttcttaccagtttgtccaagttactggagccctcctctcctcaggtactagtaccgctcacttaatcccatttagcattcctcagaaggcaaggattattgcatcataaaagtgtatatctaaatgtcctcttgaaattgagcttattttacataatgtgtttaattatacacctgagttaatataagacctataagatgtattctttcctgtgtaatgcgtctaccacagcatacttacatgcagccatacagggcaagaacatactgcttttgttttgtttgttcagggtagagtgaaacaccacagaaagaatcctgtgttgatctttggtgccttcaaccttcttaaacctgtgttctttgccactcttggtgtttacttcttttctaagaagaaaatttgttaattatgaagaaggcagttgacattcagcagttgactttctcagcacagttacctggtactgactttggaggaaattcaaccaaagatgattaattcagaaagtgtaactatagtcccaaagcagaaacacctctgcagagataggttgtatgtatgtttgtgtaagtgtgcacacgtagatgtagagctgtgtacccacatgagcgttcacacacagaagaataagagaaggaccacttgttgggggtctgtaccattcaggagtaattttcctgtaggatgatagagtaccttcaggagcccaggactgtgtgctcctaccacatctacttcctgggcttgagaaagacaatgaagccctgcggtatactcctctttatgtgagcccttgcctcagaagactgtagcctgggagtatgaaggcgtttgggcactagaaagcagagctgcttcctgtcgtcctacttccaggtttgcccaaagaaagtccctttggttacttcatcccagttccaaacagctcacccccactttgctctcatcatcgttctttcatactgctgtttttgctgcaaagaggaaaggactgagaaagaaatagctaattggggcagggggaaatttgagagaaaataaatggatttaggaaggctaaaatgttcaggaaaatttaaaaatttttcttttttaaacttttaaacttttagatttttaaacgttttaccacctaccccttctcccttaacttcaggtagtctctttaaaaaaaaattttttttttttttgagacagagtctcgctctgtctcccaggctggagtgtagtggcgccatctcagctcactgcaggcgccgccttccgggttcacgccattctcctgcctcagcctcccaagtagctgggactacaggcgcctgccacaacacccggctaattttttgtatttttaatagagacggggtttcaccgtgttagccaggatgatctcgatctcctgacctcgtgattcacccgcctcggcctcccaaagtgctgggattacaggtgtgagccaccgcgcctggccaaaaatttttaaatttaattttgaatgggtaataaagtcctatgatttgaaaaccagagattatcaagagatttatggtaaatggtgtcccccacccatgtcctccatctgttcagttcctcctctccccaaataagtaaacacctttagttttttgtgtccttcaaccttctttattcccttccaagtaaatatagagttttattcccaatcctacccctcttcacacaaaaacttgttctgcatcctgcttatttcattgagcacggtattctgaagatcttttaatatcagtttgtagagagctttcagttagcctcttaatttaccttttcctcaacagatcaaaactgcatttttgttagtcatttacacttaagtataacggcatttcggtgcctttgtagctgaaagaactgctgaagcagaaagttgactgtgtgtctggtgatgcagatgcttgctatctgaagaccttaagtctccttcacttagctaagaaaatgctgtctggtttcttgcctcttttatttctcttttttctgcccttctctcttctaacctcctttgttcttttggcttctaaatgctaattctactgttcttatagctaggttttctctttcccacacctttctgataacctaatatcctcaagtggagagtctgggggcatgggaaagaaaagagggcgctttagccctagaccactatggtagaagcagaggaagttcaggtgtaaggaccctaaaacttttggacctcagtaaggacacagacattgagaattaaattatatattattctcataattcttagaattttggacttatttttatgcccttcatcatatattaccacttgagatctaaggacatgttttggcagctgatttgcttagatatggaaaggtctagaactcttctgttctgacaacacctaggtctatctctggcatgtttctttaatatctgaatgatctctaatttagtttgtgcagatgttatcctggacatcaaagatttgcaaggaaaacagccggggtaagtttactgccatgttttcctaaaggctttatataaaatcactatcctccagtggcatttggaaaagaaaaggtattccccattcattacacattcaccagagtggccaaaatgaaacagacacctaataccaagtcgaattgttggcaagaatgtagagtagttggacctttcattcactgggggtggaggtagaaattggtataaccactatggaaaactgttcagcaatatctactaaaattaaacatatgcctatgactcaacaattcgaatcacaacagaaaaatgtggaagaattctcttagcagcactattttagtaggtaaaacaaacctaagtgttcatcagcagtagaaaggataaaagaattatgatatattcacacagtggaatcctatacagcaaataagcatgaacaaactacatgtacacacaacttggagaggatctcacaaatgtactgtaaaacaaaagaagccagacacaagaaagggtacttactgtagaattccgtttagatgaagttcaaaattagacaaaatttatctgtgatgttagaagtcaggatagcagtttccttggcggggcaagttaggagggagtccctagaatactcgtaatgtacttgatctggatgctagttacacagtaatcttaactaatgatgggaaatgtctgccttctttgggcatgtggataaagaggcatcattgcagactagctgcttggctgtagtatgtgtaacactgggatgttgtgcctgagacacgacaagctacctcctgttctggttaggcactccaccccacacaccctgtacacatacctgagggacctgactgggttataacttaacttttttttttttttttgagacagagtttcactcttgttgcccaggcaggaatgcaatggcacggtcttggctgaccgcagcctccgcctcctgggttcaagcaattctcgtgcctcagcctcccaagtagctgggattacaggcatgcgccaccatgcccggctaattttatatttttagtagagacggggtttctccatgttggtgaggctggtcttgaattcctgacctcaggtgatccacccgccttggcctcccaaagtgctgggattacaggcgtgagccactgcacttggccacaacttaccttttaatttgcttttcttcctattcctagaggatgccttgttttgcaagagcttgatgaacttgctcttcagcctgcatgtttcgtataagagtcctgtcattctgctgcgtgacttgtcccaggatatccacgggcatctgggagatatagaccaggtactataatgagccttcagtacaataccctgtgtggggatgggggtcaagggaacaaccttactgtcattaggtctcacctctcttcttttccccaggatgtagaggtggagaaaacaaaccactttgcaatagtgaatttgagaacggctgcccccactgtctgtgtaagtgttgtacctgagccatggggaatagctttgtcattctttccattctactccatgtgaagtgacttgtgtcctatagcggcttgtgtcctgaggcctgtaacccacctgtaggtggccaggtgaccacagttattatattacccccacagctgtgtgtagtgaatcacaccaggcactcttttctttcagttacttgttctgagtcaggccgagaaggttctagaagaagtggactggctaatcaccaagcttaagggacaagtgagccaagaaaccttatcaggtaagataagttcaactgggattccaggaattgacatgagcaaggtcaaaattcatattgggtcggtgcataaaaatggagcccctgagctaaatttcttatttgcctttaagctagattttttcctatgtgatgaaagaagtagaagatcatatgtcttatcacagcacgattaattcactctgcatattgaatgttcgtttttccataaagactttctagttagtagtaatcaatttctaaatctcctttactcttaattagaaaacgaagttgggtttgaatgtgccaattttatttccctttagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatatgtgagtatttgagacaagcagattcgccccaccattctaccccagtgagccaggagatgaggatggggcagcagcccactgctgcagaatgcccctaaacaagagagcatttgcctccatcttggcaggtcatggtttcattttagtttggtcagtaggtggcaggcatctccacaggccagggaaaaacagtttataattctaatctgcttttgggcctgtcacggtggttcatgcctgtaatcccagcactttggtaggctgagacgggcggatcacctgaggtcaggagttcgagaccagcctggccaacatggtgaaaccccgtctctactaaaaatacaaaaagtagctgggcgtggtggtgggcacctgtaatcccagctactcaggaggctgaggcaggagaatcgcttgaacccaggaggcggaggttgcagtgagctgagattgtgccactgtactccagcgttggcaatagagtgagactccatctcaaaaattaaaaaaataaagtaaaaatctgcttttggaggcccttaattctttggcatgtatgtggcacctgattgagaatgaatgcctcttttaaataccttctaaggtttaatctaaactataactatcctagaattaaatctgggcccataatgcatagaaattataccatttctaaccagtctggacacttaaagagatgtttattccttttttcattcctttaacatgtaggtgttaaatgccttatagatcaaatactaaggtggggaagaaaattattttttataaaaatacaaggcataccctgcccttactgtttatgttcctagcaatgatccatattaaatacttagaaaggcacagataatccaagaaagatgtggaccaccccgcatcacagcagtgtggctctctcagaatgtgtagctctagctacatgtggctaagctgctgtagtggaaatactgagagcctcttctctttattggcatctttaaaaggaaaaacagcaaagttgttggttttttacatgcagggactaccagcctgaggaatttttaaagaaatgagcaaatcagaaacaaacccttcattacttattgtctgggaagcttaggagctttggaggagaggaataaggaagcttgtgtcttggcttctctgtgaattttgtttttcctcttcagtcagaatgatgagtcacactccataggctcactgcagcagtcacttgtagtttcataggacagtctactaaatctaggaatctttttttattagtatctccaggtgtgtcagagctccggaggaattccaaaaaatatggaaaagctggtgagttgagaatgcctttcctaggaatgggggaagcacttttactgctggttacattggtttccttctcccttgttgtgcaggtgaagctgtctggttctcatctgacccccctgtgttattctttcatttcttacgtacaggtaagagattcagaggcagtacccaataggtcttcaagaaaggatttcttacatgcccaggggactattgatcacctgaactgagcatatataaacttttttccctgcttaccacaagctggaggcacccatcagagaccaagccaaggcttgagggctttgcagcaaggacatctttatgtaaagaaaactgtttcacttaatttggagaaaggaagcatatatgtttgcatttggagcaaggaaggaacaagcatgctcaggctcaaggacttggtttattcctgggtgactgaaagtccatgccatgaggcatcctctgggaatgtgagcagagtagcagcaagcacatgaagaagggttgtgatgagacggcagtgcagtgagggcactttcagggaagtggaaggacgtggctttgtaagtgtcatttggtcctaaataccatcagattcctgcagtacttgaatctcctttactgtttgcttaaaccagttttttaacctcaccactattgacatgttgcgctagatagttctttgttgtgggacctgttctgtgcattttgggatgttgagtagcatccctggcctccacctaccagatgccagtagcagccccctagttttaacagccaaaaatgtctccagaaattgccagttgtccttaagggacaaaatcacccctggttggaaagaggaagaaacgagagatctactgtctcctaaggccacttagtcatgcagtaaatgtatcacagggctgttactgatctttgaggaatcaaagagaatgggtccactaagtgtcaatctcagccaagattctagaaccaattattaaagcaatggatcgtgaccactttggtagtgatgcttcacttgttttctgcctctgcatcacttacaggcacaatatcattctatcagtaacttgcctcattatgtgtattcagggtgcctcttcccctccctttaagaatcagcaatcagctgggcacagtggctcatgcctgtaattgcagcactttgggaggccgaggcgggtggatcacctgaggtcaggacttcaagaccagcctggccaacatggtgaaaccccatctctacaaaaaatacaaaaaattagctgagcatgctggcgggcacctgtaatcccagctacttgggaggctgaggcaggagaatcgcctgaacctggagggcggaggttgcagtgagcaaagatcgcactgttgtgctccagcctagcaacaagagcgaaactccgtctcaaaaaaaaaaaaaaataaagaatcagccatcaagtgggctgtcatctgggtttagctgaaggagttcttagtaatgggctgatagttgagactctctgtcaccttgcctttgtatcagttttgtgatctgggtcaggaatgcatcatccattttctatatccagccatccagccagtagtcaactgtcataaagctattacttctggtcctctccttttatctcacccaaatgcttgcaggaatgctttctcaaacctcatgcttgtaaattttcatgtgggtgccattcgtcaaacaaatctgttgtctatatataggatatatatctgtccattcccatatttgggttttgagtttcctcatctccaagtcttaatgatacctataaagacacatttcacaaaatatgctatatagactgagacagtcctcaaaaaaaaaaggaattcagcgagagatgctcatactgtatatctctcaccttagagattcgtggtgtccatttgcatattaaaggtgctgagaccagtcatggtggttaatggaggctgaggtaagaagatcacttgaggccaggagttcaagaccagcctgggcaacatagtgagaccccgtctctacaaaaaatttaaaatttaagccaggtgtttgcctatagtcccagttacttgggaggctgaggcaggaagatcacttgagcctaggacttgaaggctgcagtgagccatgatcatgccactgtactccaaggcaacagcgtgagaccctgtctcaagaaaaataaaaacagtgctgagagttccaacagtatgttcattagtagttttcagacctattcaagaacatttttaaaaaaataacaaatgttactatttggcagaataatgttccatagagtacagtttgggaaatactgctgttaaatgctatttactacccttgttatgattcaaaagtcacattgtctaataattttattagaacaggtaatgcttagagaacctctaccttgtgtctgatgtgttaagctcttttcatacatcatctcattcatcctagctataggttatgattagtagttatccccatatgcatgatgagaaaggttaatcagaatgcccaagaacagaccatgagtaaaaggcagatctgagacttgaacccagctagttagactcgatagcaggaattggcacactttttctgtaaagggccagatagtaaatgtgggtcatacagtctctatcacacctactcaactctactattagaacataaaagcagccatagacaacttacaaataaacgagcatggctatgttccaatgaaattttcttatcaaaaacaggcagtgggccagatttatactatgggctatagtcagtcaaccattgctctagagtcatacctggtacttgttgacatgtaaaatgttggaaggttttgattttcgtgtttctgaccccattttcaagcattttcttctgggaatcactactacttcctagactgctattattttcccctcattacacagtaatcagtttcatttcctccctaggcattttcctcctcctccatccatatttgacttaaagccttactgacaagtcagctgatctgcaggcaaacattttacatttttctgtttttgtgagatgtatttaatgagtgccccctgggcaagagcccatgcatggttccattaactccagctcttaactagaaatggggattgcattttccacacctctcagtgaactgttaattctcttgtagccccctcttcatttccccagttccttagatctcaatgggaagaaagcaacgaaaaccattgctgcaactcttagcatcctgcccagaactgtatacctttaaaagatgcttctcaagggtcggacatggtggctcatgcctgtaatcccagcactttgggaggccgaggtgggagaatcacaaggtctggagtttgagaccagcctggccaacatggtgaaatcccatctcaactaaagatacaaaaaatagcagggcacggtggctcacacctgtaatctcagcattttgggaggctgaggcaggcggatcacaaggtcaggagttcgaaactagcccggccaacatggtgaaaccccatttctactaaaaaaaaatacaaaaattagctgggcatggtggcaggcgcctgtaatcccagctactcgggaggctgaggcaggagaattgcttgaacccgggaggtggaggttgcagtgagatgagatcacaccactgcactccagcctgggcaacagagcatgactctgtctcaaaaaaaaaaattagccgggcatggtagtgcgtgcctgtaatcccagctactcgggaagctgaggcaggagaatcgcttgaacctgggaggcagaggttgcagtgagctgagatcgcaccattgtactccagcctgggcgacagagtgaaactccacctcaaaaaaagatgcttctcttctggctctaattttagtcctgcccgcccggatcagttggaatgggcagggaacagggttgatctaaggagttccaacagggccccatcttggacacaacctctgggaagatggttcacttcccacttggtcagtgaggtcgatccgtgactgcttccttgccctcttctgctgccttcaccctcttccatcctctaccctgccttccagggccaaaaacagattactgcataccagcccctctggaatgtctgcagttccttattttccagaacgtggcatgtggaacaagtctcctgtttctctcatggctccagttgcagagcctctctgtattttcaggtctgtttctttattctgttgccctcgtggagcatggtatgttcccttcctaagaaggtttagaactccccttgaggtaaaaagctgcctacatttctgtaccgtaccttacatttgggtggtttttctccccagtctctcctgactcaagtcttgattttcttttgctttatcagaatcttacactttttggttccttttattagttattcatccctctccaggagctctttattacccaataatttacaacacagggaagtgttctgtgacccttttaacccttcttgagcatgataacccattgcacataaaatatatctggttttggctttgctgagtaacgaaaataaaatatatctggtgattgcctgtaagtgggaagactgcagggccctgcagcagcctcctcagcttcctctcctttatgggatccttctagcccactggctaaaatagaaatagaaatgaatattcctgctaccaccttgacagtccccattttaaccattctttagtacctcaccagccccttggctgacccactgcagtaatagtcctgccttcaacttccatgtgccagctctaagaacaacagattgtaaacctctcaacaactaaaaaagaaaaaatatctgaggattacaaagcatccattttttccctatcttctaacatctgttgcacagatagtcctgtttactccagacttggtcctcataccctgtgtaattaccttctaagaaaattgccactagttggtgggcatggtggcttaggcctgtaatcccagcactttgggaggctgaggccggcagatcacctgaggccaggagttcgagaccagcctggccaacatggcaaaacaccgtctctactaaaaatacaaaaattagctgagtgtggtggcacgtgcctgtagtcccagctactcgggaggctgaggcacaagaatcacttaactcggggcgcagaggttacagtgggtcgacatcacgccactgcacaccagcctgggtgacagcaaagctctgtcttaaaaaaaaaaaaaaaaaattagcactagcatgctagctccacagaaaaatcatcaggaataagagaatgtgtttctatttctttagaataagagtaagagcctgaactatacgggagagaaaaaggagaaacctgctgccgttgccacagccatggtaagctgctgacactgaccgttaaaatatgcttgttggtgaacccgaaaacatgaagcggaagaagccagtgacaaaaagaccacgtgttgtatgattccattttcatgaagtgcccagaataaatcatctaaaaaggcaaactagattagtggtagcgtagagctaggtgggttggaagatggggagactggggtgacagctaaaaacggtatggaatttcttttgggggtgatgaaaatgttttagaattgactgtgatgatggttgcacaactctgcaaatactgaaaaaaaagtacattgtgagtgaattgtatggtatatgaattacagctctatcaagctgttagaaaaaattgtgtgtattatatacatggctgcttctcaactcagggattttatgatcagatggagcatcttatttttcctctgaaccaaaaacatgttttattcacgaagcaccagaaaatcttgagttgaaatggaaatagtaaaataacttacgatactcaattgggagaaattatttttaggtaaagttggtgaatgcaaaaggtgctccctaaaagatgtgtaagagtcagcgggggtacaggaaaggaggcacttagtacattgctggcaaaggtgaaaattagtacagcctctccagaggcttagcaatgactactgaatcccattctgatgtagcagtttcacttttaggatatacaggcctgtgtacaggatggtcctcacaacattatttataaaagtgaaatattagaaacaaagatatccattaatagaggactggctaaataggttataatatatttatactggagagatatgaaaaaaataaacatctaaatgttcagctctctggaattatctccaagataatgttaaaaaaaatttgtacagtatcctcatgggttaaaaatacacacacacacacacacacacacacacgtaggacctacaaattacaattcacgttagggggaaagatatataatcacacacacacacacacacacacacacacacacaaatgtaggacctacaaattacagttcacgttagggggaaagatatataatcacagacacacacacacacacacaaatgtaggacctacaaattacaattcacgttagggggaaagacacacatatacacacacacaaatgtaggacctacaaattacaattcacgttaggaggaaagacacacacacaaaaacgtaggaccacacacaaaaatgtaggacctttcgttagggggaaagacacacacacacacacgtagaacctacaaattacaattcacgttagggggaaagatatataatcccagcagtgaaaattcatacccagaccagaacaaggaaatagagctagggccaaaataggcttaagaatttcaagtcagaaaagcaactaaatttctacaagtgatcctgccctcctcagccattttctagataacaacaaatactggaattataaatgaaatggatcagtgcaattatctctactggcatttgggtccttccagattgaactgccaaaaattgtagattactggtatacaagtacaactgcatttgattgggagacagactagttttcccctaaagccatacagttttgtaagtgacagcttcagaggaaaacttcaaaaaccattgaacctgaaatttaagtcttatgttctttgcccttaggccagagttcttcgggaaaccaagccaatccctaacctcatctttgccatagaacagtatgaaaaatttctcatccacctttctaagaagtccaaggtaaacattctcttattatgtgctaccattcccatttaccttcttgacagatctggcaaactgaagcagcacaactacaatggaggaaaagagactctgggccatttgtgtgtttgccatcccccctcccccccccccttttttttttttgagactgtgtctcattctgtcacccaggctggagtgcacattcaagtgatcctctggcctcagcctccagagtagctgggactacagtcatatgccatcataccccactagttttttgggtttgtttttgtagagatggggtctcactatgctgcccaggctggtctcaaactcctggcctgaagtgatccttccaccttggcctcccaaagtgctgggattacaggcatgagccaccacactcagcctctttgctgttcttgatctgatgacctgaaccccagcatacagaaggaagtgggtgcgtgcttgctttaggtagaaatggaaaggtttctcagaggtgaactaaaaatggcttaagctgttctggcaggacctatgagtagggagatgtcccatgcttacaatcttgtcataggtgaacctgatgcagcacatgaagctcagcacctcacgagacttcaagatcaaaggaaacatcctagacatggttcttcgagaggatggcgaagatgaaaatgaagaggtcagtgctggcttctgtctggagcccagccactcttcctagctggttagcagcctatctgggagcagtcacagattagtggaagggcaacagaatgggaaagggctaaaaggtgatcaggcaaagatgagagcaaaggactctcagaagggttgtaaactttggaccacacaaaatcctatgaagttgccccgacttgtttgataaacacttccaggaagcaggtggtaacaaaacaatgtcctgctgtgggtcctcttcctgttaatcttttaaactactggatgatgaccagctatagcagtctggctcagaaactagtttacctctcatgtcatgccctcattcaaaggccactcattagtttgggttaaggcttcttccttcaattcatgccaatgtcttgtccttttcccttgtggtttgttcctctccctttactcttagcaagtgacagtaccgcatccccatccctgcaccacctttgaaacagaacccaatgtttccttacttctagcacctaaaattttcatcttaggtttgtctaataagtagcaaatcagtagcccactcccatttcaaaactggaagtttacatacaagtgccctggatttcagaattttgaacatgcattcttcagatgatcacactccaggctctaatgtacctggccccatccactctctttacccacttggcagctgcactcaggagagtcatgtagcattttgatgtcaatggcttcttctcttgtcgttttgtcccataagtatcctcagtatagcaaaagtcctaaaaggaggtgccactgtcttattactctacactttggaggactccttcctcttcttcaacaacataattacctcctgtgagtgggaaagtggggaaagcatgactaacaaaggctttgatgagaagatagagtcttttttttccttctttttatttccactgccttggagcaggtttatcacgttagagcattaattctttccccttctagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcaccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattatctttaaacatttcttctgtggttgaagtaggggacaggtacaggtagaatatttgaagctctgctgccttcatttctgaaacatcatatcacattcactctggacacagggcaccttataaactgaaattagcctagaatatagcctgagtcaagagtggattctctggggccccaagtttcctgttctccaagacccactttctagtccacctcagatcctatgtgtaatgaggaacaaatgtgttgtgctcaccctggggaatcccgtatctcctttccatcccagttgggttggaaggggttttacaatccatggtcacttccttcctgaggcaccggtcaatatcgactgcactgaaaaaggcgactgactggggcaagtcattcagacccagcttgtaggcaaacatgcacctgaaagagacccaatctcctctcacagtcatgcccctcctgtgaacagatgcatcactcctggagcaatgaccccacaccccttagagcagggcttcccctggaccaacaccccatctgttcacttagctaagtcaagaaaggtgaaggtccagcactgttttccatccagcagcctaacctcccactgagatactgaaatgcaattatggactcaacatacttttttttttttttcccagtttggtacactttattaattaatatacgaaatcacttccaattgggccagagtttgaagcataaatgaggacttttagctttgttaagcataacctcccggagatgatgattaagagggcaatgggaacaatgttgaatattgtaaacatctgttatttacccaataatcaggatagatcatggttcccaaactggttctgagtggcagatcaacatggaacggtaatatttaattcatccatatgaactaggaattttactacaagaaaatacaactcaatatataaaatatataagatatttttaaaaatcacatttgagtgtccccattaacagtgttttctgttagcagtcaaataacaaacttttggcacttacttaagaaagaaaacatttatgggagaaagaaaaacaaacatctcaattttctatgaaatgagaaaaggcttctgtcatttgattttccaaatagaaaagcgtgagtaccacccttcggaacaattcccctaacctcactgcttccctcaatgatcagtcttggtatttcacattttcaaacccaataactctttttttacgaattgaggctagtctttttaggacttctacaactttttaaaaattagaaataaataaataagctgaaacattcacttctagggggatgaaaagtcaaaactgaccagtctggcccaaggaacgctca

SEQ ID NO: 15522 - DNA, 22294 bp, Human
tggtagagatggggtttcgccatgttggccagactggtcttcaactcctgagctcaggcaatccatccacctcagcctcccaaagtgctgggattacaggcgtgagccactgaacctggcctagagtagtgtttctgtttttaatttttttctgtgaaatatgttttattaatttttatttcaataggggtacaggcagtttttggttatatggaagaatagtgtttttaagcacataaaacatgaaggattacaaaggacaccaaaggtattcaaatattaggacaaataggtaaacttattaactaacaggatctagtggcagtctagtaacccctgttattttgaagtacagataagtgcaaacaaattttgaaaaatgtgcagcacttgtaatgcgttatgaaaatatctgtggttgctggaggggacaaagtcacaggcactgttaataccactgtggctgacagcctatgctcataattggaggaaatgccaagtatcagtaggcggttagaagaaacaagatgaaaatgttttccccattcagggactccctgatttaagctgagagcctctccttccagtattttgtaaaagtcaacagttatgtgaaaaaaaaaaaaaaaacagatgaatttctgattgattgtatttttttggcaaaacaaaaaaatcacaaacattaaaacattgtgtatattaagtacatctagaaaagtgtatgcaaaatatttcatatttaaatagaagggaccagggctcaatgctgcttggcccggggcttctctctacctctccacgtggcgggagcaggtgagggtcggcatcagcccgcagggccggcggaggattgtttccctgcaccccactccttaaaaacgcgaaagtcaacttctgaagtccgttcacggtgtcctgggatccacgctggacggtggcggccgactttcagcttgacctgaattttattcctaatcagctgtgtgatctcggttggtcccaaacgtctctgagcctccctttcatctgtgcagctgggcctccagaccccaacccccaggcggtgcttaatcacgtagaccttattctgcgtgcactttaccacagttcaccaaccaccgagcgctgagagctgttgaagcacctggagcaacacaagacggatgcggagactggaaacagctggggaaggggacaagctccagccgcgctgtgggccggaggctagcatctgcgggcaaattcaggttcaacggaaggcaacatttttacccctcagaattgctctggacgaggaggcagcaccggatgggcgagggagggagcctcgctttggctgcgagccccaactcttgccaaccatcaattgagtataaattgagatttctgtacaggatgcccctccctctccactttcctccacctgcgtcggggtgcgagagacctggtacattttagaaatgtgcctccgctgagacacgtaggcgggcaatctcgcagggacttgctgggcgtggttacttccgcggatcttggcgttcccacatctttgaagtgcggtgggaatcggcggcgactacgttcacattgtcccaatacttcgttcctgagggaggaataaactaaaagttagtcataacctccctacgaccgcggcaggactcgaacctgcaatcttctgatccgaagtcagacgccttatccattaggccacgcggcccgtcggttgttaccgtctcttgagcaacttataaaaacgtcacctccgcccaccagctagctcgggaccaatccacctgctccttgagaaggggaggttggcctttggttcgcgcgttccgcagggagagcccacccagaagtcccccttctccccccgcgggcggaccgctccattggcggccctcctattggtcgcgctgggagtctcccgcttgcctctcgggtagccgcgggacctagctgggtgcagacgggaagttgcggctgccagcgaagcggaccggccgggtggaggccacacgctaccccgaggctgcgtaggccgcgcgaagggggacgccgtgccgtgggcctggggtcgggggagcagcagaccgggaagcaccgtgaggaccgaggtttccggcggggtcggcggcggggaggccgggtcgctgagcgacggcgcggcccctccctctccagtcagggagcgaggcccggagcagggcggcggctagtcccagggcgcaccgcggcgcctctgccgggcgcaggcgggcggcggggcgcacgggggtggccgccgactcctcctgcaggacgctctcggccgggtgggccgtggtccgggtgtgggtgtgggtcccgggggacggcggcccaccctgcgggttcgaatccgggcgctggcacctctcgacgctaggcccgcgccggtcgcggtaatggcagccaccatttgccgagcgcttgccaagagcagggccgcacgacataggcgccctgtgtccctcagacagcagcccggtgtgacaggcagaatccgtaatcccattttacagaataggatatcagggcctaaggagctttgcccaaggtcacacagctcgagagagccagaagcggggttcaaaaccgcgtcgccctactccagatactgctctcttactcgctgccctcggcttccccacgtgggttcactgacgaagttgcgtggaccccggttcccccaggaggggtattgacgtttcccaagttttgaggcttaacggaaaatgcaactgaagcgcctggcacagtgttggggacgcagtaaatgctcaaggaatgatgattatggatacacctattacatatatggtaaaataacgctttatatcatctgtctcctttaggatttggggtggaaggcaggcatggtcaaacccatttcactgacaggagagcagagacaggacgtgtctctctccacgtcttccagccagtaaaagaagccaagctggagcccaaagccaggtgttctgactcccagcgtgggggtccctgcaccaaccatgagccgcctgctctggaggaaggtggccggcgccaccgtcgggccagggccggttccagctccggggcgctgggtctccagctccgtccccgcgtccgaccccagcgacgggcagcggcggcggcagcagcagcagcagcagcagcagcagcagcaacagcagcctcagcagccgcaagtgctatcctcggagggcgggcagctgcggcacaacccattggacatccagatgctctcgagagggctgcacgagcaaatcttcgggcaaggaggggagatgcctggcgaggccgcggtgcgccgcagcgtcgagcacctgcagaagcacgggctctgggggcagccagccgtgcccttgcccgacgtggagctgcgcctgccgcccctctacggggacaacctggaccagcacttccgcctcctggcccagaagcagagcctgccctacctggaggcggccaacttgctgttgcaggcccagctgcccccgaagcccccggcttgggcctgggcggagggctggacccggtacggccccgagggggaggccgtacccgtggccatccccgaggagcgggccctggtgttcgacgtggaggtctgcttggcagagggaacttgccccacattggcggtggccatatccccctcggcctggtaagtaggggcagggttggggacataagcaggcatgggggcccagcttaatagtttgtttcagtgaacattttctgaggtcctgttacgtgctgggtgctcacgtagggagcgctgatgtgttgaattaggactagacccctgtttatgtgggactcactttctggtgggaagatcacaggcagtaagcaaatacccaagtaaatgtcaggcagtaaaggccacgcagagaatcacagtagagcgctgtacatgagaccttcgggaggccacttaagatcaccgtgatttggtgcctttaccccctctcctaatagcgtcatgagaagttagtctgaaaagtcatttgaacagtgtttctatttggggagctattaattattttgggcagtagaaagctcccttttgtgggactgtcccaggcagtataggacatttagcatccccagcctttcccataaacgccagaccaacacccccccccgcccccctgcccccgccggcaacgtttccagacgcccccttgaggtggcatctggttgaccacccctagttgagaaacattgcttccttcccccagccttccaagcaggcattttggtcccaaacaagtatatccaatctctcttttctttttaaataactttctaagtgctacccaagtttctttttcaaacaatgatggcagtactgtttctcccctttttttattcttcattccaggattaaaatactatttacaaccttaatgctttcaggcatggccagcaaaaaagttggcagtttctttattcctattggaagctacatctttgtaaagaaagctgcgaaatgttaaatatgcagttgaaaatggtgaaaacatggctaaatagataaggtaggcattaatggctgaaaagagcaaaactagatgattctgcattgattgagttccagttacaatgagaatcacactacttagaatatgtaacttgatggtcaaagtaaaggggaataccggccatcatttgaaaagataaagtaggctttggtggctgaaagaaaattaggaaaccagtgacaagaaagatttgttttttgatctgtcggtcattttaggccaaattacctcaagtccccttttcttttctctttctccttctttctctctttttacctctcctttccctccctgtccttccctgctctgccctcattctcattccattcttgccagtggtactcggggcattgcttagttgacctgatggcagaagtcattgttaaggcctgggctcatgctgggaccttcctcctgggagtctgactggtgggtgggggtgggtgccacatggtgccctaatagcggtccactttgaacctgggcatgcccctgccccttagctgagtaacattaggtacctgaccagcccacaatttacaatgggaggagaagcggtagtcagctatgagcctcccacagggcagcttcttcccaaagggtgttggtaagggcttcggccatcaggctagagggacgtctctctggccatcagcatttttctaagattcacagtaaaactagtattaatggcatggatccctactcatcttaaatttggcttgtttctttttaatcactagtttataatatggcttcatgcacagctgcagagctgcatcttgacaccagtgtggctttttactgtaaccaaagttcctgttaccaccatggcctcaaagatttggcattctttagcctttttgtctgcgttgttttaagggctttgacatgctgaattaaaatgtgggggggtggggatttctttcagtcccttggcttattttcaccatttggagtatgagttcgattttgtcaggtttaaaactaggaacctctttttgctttctctttgaaagaagttagttttatgtgtgttgaatctgttgaggcagatactccctttttcccttccataaaggttgcaaggagctccttcgcagctgtgttgtccacacgtggcctcgtcactcactttgatgctgagtgggccttgattgtttagaataatctgtggcttgcaacaggcatttcctcagtggccattcccctacacctagccttgtggatcttgagcaaactgcagccttttcctgaatcagtgtcgggcccccaacaggcagcactcatcccctatccctcccaccccaaccctgtcacatacacatacattttctcattctggcactttccctggttctcactgagggtggttgcttctccaaggtgtgtgatttgctctttgtcccccagaatcttttcagccgtgagatgattcatcctgtacatgtgtgcagcagcatttgtcattttttttttttttgccaattcaattaaatctccaccttgggttctgttattgtctatctcctttactagtactttgaacagtagctggtttgtgcctgtagacgtgaggggttgataatgttcataaaacctcagagctagatgcagactcagtgaacgctgggcctagcaaacacctcgatagcccaggctgtaatagaatacctgcacgtaggtctaatagcccagtagttccatttttatgtgcagaagtttaaagaagcttttgtagctcttgcccgccagcacacacacccaccctgccacacctgacctgtagctgtttgagttaggagcaccctttggtctcacttgtgtccccagctgccaatgcaccatctggcatgtggcggtaggtgtgcagtggttgttgtggagtggaagtttaatgtctccatggtgaacctgcctgcctctcacctccctcaggtattcctggtgcagccagcggctggtggaagagcgttactcttggaccagccagctgtcgccggctgacctcatccccctggaggtccctactggtgccagcagccccacccagagagactggcaggagcagttagtggtggggcacaatgtttcctttgaccgagctcatatcagggagcagtacctgatccaggtaaggttcctggggccaactgcaggttctggcatgggatgggccaggagccctaatctcagtggttaggggaggtactcctttcctggcacgtgtctctgttgcctttgctgaagccgcaaggcgcatctgttgaccagctgtgcctctggtctctgtgcctagctgttgtatgtccccgggaaagcctggtataggacctaagttgtcacaaagtaataatggccttcgtctctgtggcattttagagcttagcatgggtcttgaaggttttgagccacagcctgggctcacttcctgccttaaccaccgatgactactgtgagcgccttaacatctctaagtcttagtttccttttttataaaaaggcagacataacagaaatctcataggattaataggagggttggaacaatgcctgcatgtcaaacactcagcactctgcctggtgtatagtagtggcaattcttaattttatgaaaagtgttttttcactggatcttcacaacagccctagaagataggccaggcaggggagagcaaccttaccctatagctgagggtgctgaggctcagacagccttgttgacatgctcagggccacagagcttttgagtggcagggttggggccagaccagatagccctgaaggctttattttggccactctgtatctacgttgctcagagctattgttggaagctgagaaggacttgcacattgggattgagccaggcctgcatcttaaagggtggctaggatttgggaaggcaggccccttacaggtgatggggcaagcatgaacaagcatgaggattctgtatttggtgttgaaggctgtgtgctgggaggggaggctgtttgaggagctgaggtggggctggaggtccacaccaccaagcagtggtgggctggccccacagttgcagcctccctccttcccttcccttttctcctcctcctcctcagggttcccgcatgcgtttcctggacaccatgagcatgcacatggccatctcagggctaagcagcttccagcgcagtctgtggatagcagccaagcagggcaaacacaaggtccagccccccacaaagcaaggccagaagtcccagaggaaagccagaagaggcccagcggtgagagcacactgccggtgggcaggagcatagtgcttgggaccccctctcaccagcccgtctggcccgaggccaggctgatctgccatgtcccttgctctggttccccagatctcatcctgggactggctggacatcagcagtgtcaacagtctggcagaggtgcacagactttatgtaggggggcctcccttagagaaggagcctcgagaactgtttgtgaagggcaccatgaaggacattcgtgagaacttccaggtatggtgctggagggggctctggggacatgggctgtggcacacccctagctgcacttggggagatgcagctgccaggcctgaccctgagagctggtggtggtaatgggatggctgcccaccttgcgccttcctgtcaccttgtgccaggacctgatgcagtactgtgcccaggacgtgtgggccacccatgaggttttccagcagcagctaccgctcttcttggagaggtgagggggagcccatgtgggaatctctgggggtcagtgtgttcctggtacccgggcccactgtaatcaggtggcgctggttctatctcaggttggggaccttagcttttctaggctgaaagaatggagcccttctgttcagtggtgtccatctgggccctggactctggatttgacagaggccctggaggggagggccatggagttgtgcttgtgtgtcatgtgcacggtcctggtttactgtgcaccttctctaactagatccttagccaagggcttcacatacagcgtggttatgtttattaatgagtctgtcttatgaagtgacccttgtatgctgaaaattcaggtatatttgtaccaaagatatggaaagaaaaaagaagggaggaaaatttgggtgtaacttttgactccctcagagcttaactactaatagcttgctgttggctagaagctttactgataacataatacatattttttatgttatacgtattatatactgtattcttaaagtaagctagataaaagaaaatgtattaagaaaatcatgaggagaaaatatgtttactattcattaggtggaagtggatcatcataaagatatctatccttcacgttgagtaggctgagggcgggggttgggcttgctgtctcgggtggctaaggctgaagaaaataaatgtgtaagtgaacttgcacgatccagacatgtgttgtttaaatgtcagctgtattttaccacccaagttgtgaggttcaggcatgatgtttttcatgtatgggattattagcacagtgcctggcacagagtcattactccacgtgtggcagccattttcacttttgccatctatatttcccacattacccctgaggatgggatgatattgttcccattttatagatgaaagaactgaggctccgagagatggggttgcttacccagggatgagtaacagtagagctgggatttaatgccgtctgacttttgagctgtgccatgtcagtggctgggttgaggcttgctaaaccagctcagggattgggccagtcttgcctcctgtggtcatttatggcagctcctggtgtttgcctccaaggtgtccccacccagtgactctggccggcatgctggagatgggtgtctcctacctgcctgtcaaccagaactgggagcgttacctggcagaggcacagggcacttatgaggagctccagcgggagatgaagaagtcgttgatggatctggccaatgatgcctgccagctgctctcaggagagaggtagccaggccttgggtgggcaggatctaggcaggggactggcaggtgggcggcctagccttcggcttagccttagccctgccctagtggactggctctgtaggtacaaagaagacccctggctctgggacctggagtgggacctgcaagaatttaagcagaagaaagctaagaaggtgaagaaggaaccagccacagccagcaagttgcccatcgagggggctggggcccctggtgatcccatggatcaggaaggtggggagcatgggtgggaggtagggtagggtaggggttgtctctgggaaggtcctgtgattgagggggtccttcgaaaggattgctccagccttctggagatgagcgggtgggagcagatcttattgagagttccttctcctgctcctgattgtcttcccccaccctcacagacctcggcccctgcagtgaggaggaggagtttcaacaagatgtcatggcccgcgcctgcttgcagaagctgaaggggaccacagagctcctgcccaagcggccccagcaccttcctggacaccctgggtgagccctgcccacccccagcagtgtatctagagtctacccttgctccattctcaggacagccctggtctggggttctggcacagaggcatcatgcacatgtatacttattgacctgctgccattcagtcacactgtcttccagtcctattctcatttgctcactctggaccggctcactggactcattcagcacagtgttgtgagcacctgctgtgcaatggcccgtggcagccaccgggtgtacacactggagcatagctcctcctttccagtagttctttttcctaggaggagccaggcacgtagaccagccagtgcagctagtgtccataggtagagttctgactctgcctcgggaaataaatcaagaaggcttccttgagaaggtgccccttcctttgagcctcatagggtggcagagatgagaaaaagggcagccagggtgagcagcagggtgccagctttgcacctgcaagaccctgagagcaagtgtcctgagtgccttgctagtgtcaccctgggctcaactctggtgaacagcctgcaagagagcacccagaaggactggtgtttctctagaggggtggggagggcagatctgctccctcctctggtcagttaccctggatgaaatggagcttgggaaggagccctgccctgggtcagggtatgcttttgtgtcctggcttctgactagtccagtgggactgacttagtgtctttgcttttgaaatattcttctagaggattccatgggggtcctggctaaagcatcccagaggaggggatggcggctgtaggctggggtcaccagaaagccccagggctttggagggtgggtggggacattgtgagagagagaaccttccccccaacaactgcccttaccatcgtgacactgctgtcttcctgctgggacgtagatggtaccggaagctctgcccccggctagacgaccctgcatggaccccgggccccagcctcctcagcctgcagatgcgggtcacacctaaactcatggcacttacctgggatggcttccctctgcactactcagagcgtcatggctggggctacttggtgcctgggcggcgggacaacctggccaagctgccgacaggtaccaccctggagtcagctggggtggtctgcccctacaggtaaggcttaggcccaggggaggaaggggctggagcctagggaccccttcccctggctggtcagctcaggctagtggaaagagtttgggttcaagagtctgggttcagaagaagggaaaacaggaaaaaaattaacacacacacacacacacacacaccctctctctctctctctttctctctctctcactcactcactcactcactctctcactcactcactctctgggttcagggtttttcttccatggctacccttaccctctggatctcagagctctgggagggagtatgttgagatgttcacagtggggaggactaaaggccctactcttgggcccagaagcatagctgccttcacaggaacatgcggagggctgttacaagtagcagggagatgggcttttaaaaaagtgtgtgtatataatttgagtgataattatgggccaagcagtgcttcccttatttgttccccaaggagtcccatgagctagaatggttatccccatgttgtagttgacaaaggcttggttgacttaagatcacagaccctgagctttaggcaggcaggtgttggggagaaacttacagtggcccagaattaagagtcctggctcttcagggcagcctgagtctcttatggggccatgggaccaaaggggataacactggccttgctcctttgagcccgagggtaggtgagcggacaggagccagcctgcagctgggccttgggtcctgtcctcccgctgctgtgctctcagaacttctcttgagacggcagctctgtagtgtaagaggaacttggatttgagtgagacaaggccttgaaccccagcctgctgccagggtgctgtcattttcagtttgtcaatcaatccctgtctaaaacccgggaaagtgctatctggttctgcctcagagctgattctgaggactaaacaaagggaattgtggaaggcactagcaagctgcctggcccagagtgggcatctggtaatcagcggctgctgctgctactgttctctgcccagagccatcgagtccctgtacaggaagcactgtctcgaacaggggaagcagcagctgatgccccaggaggccggcctggcggaggagttcctgctcactgacaatagtgccatatggcaaacggtgagggcaggctctgaacctgagctttggggaggggaggtctctgtattccacccagggaaggggcagcctttgggtgggaggctggcactggtggctcaccccagactggcctgcagtgtctgagtaccatgcagggaggggctggtggattggggcctacccagtcccctgcttcactaccttggtccttggactgctccaggtagaagaactggattacttagaagtggaggctgaggccaagatggagaacttgcgagctgcagtgccaggtcaacccctagctctggtgagcagtgcgccggcttgggttctctaggtgggtgctgggtggaaagggcttcctcttgcccacctagttcttcccagccagagttccccaggtcttaagggggttggagatgccaccctgcccctgggaggccccacacgtgttggagcaaggagaaagcctgggtgagacctcatggccatcttgtcatttcccagctgatgacgacagtttcaggcccttttcccaccccctaccccatggcccttgctgaatgcaggtgctggagcagggcctgatataggtgtgtggccctcacagactgcccgtggtggccccaaggacacccagcccagctatcaccatggcaatggaccttacaacgacgtggacatccctggctgctggtttttcaagctgcctcacaaggtgtgtcctgggtcatggcctgtcctgtggtgtttcctcattctgctcaaggcccacagcaggccttcagagtgacacacctgagactttcctttttgtgggaatgactagtagtgggacagagtgtgatttcaggcacatactgtcatctctcagcttttgtttttctaatgaaagtcgggtggcaaggggcatggtggtggaattaaatgacatggggcacgtcgtatgtttggtacgacatctggtacgtgataggtttttccgatttgttattatgcagggagccaggtttgcttgtgtctgtgtgtcttagggggcatgtgtgtgcacgtgtgtgtgtgcgtgtgcgcgtgcgcgcgtgcgtgatacaatcagggatttgcctcagactgctgaggttctgggctcagtgttgggaggagtgcaggtactcacgttggttccccacccaggggtctgccacctgcctccagcccctgcttcctttgctctgtccaggatggtaatagctgtaatgtgggaagcccctttgccaaggacttcctgcccaagatggaggatggcaccctgcaggctggcccaggaggtgccagtgggccccgtgctctggaaatcaacaaaatgatttctttctggaggaacgcccataaacgtatcaggtgggccaccatgggaggagtcctgggatgcctttcccctctcttcccacccagggacccctgactaaccctggattcccacagagggccagcctgactatggtctagaggcctggctacttttggtcctggtgccatggaccttgggcaggtctcccctctagcttcagtttccctgttaatgtaaaaagaatggtgctgtaggaccatgagagcccttcgtagctccaacagaacttcttggtgtaactgctggagccgtgggctatggctgaggaccatggagagctggtggcctgtaagccctgttgggggctgggagctgggtcttctagtctggaatggcaaatgtattcatcttgaaggccatttccaaggtggttgtggccatcagcacactggcgagcagagtgggtgttgggatggtgaagtctgcctgtgtgtaggaagaggcattggtggaaggagcgcctcatggatgccccccggagaggagcggaagctcgctcggaggcctggccggttcccagatggtttatgctcttgattggtgtatcatagggccccagttcttggctgagccagggctcaccttgagtccagttagtgaggctgggtaatggagtatagcagtcctggaggtgggcaggtgagggccatggtgggatgtgggatagattctgcttcccatggctgtgctgagcctcacgttgtctgtccccacagctcccagatggtggtgtggctgcccaggtcagctctgccccgtgctgtgatcaggtatggtctgctgagtggttgtagggataggagaactgaggtgaggtggtaggtcctaaggccaaagcaccctgctaagacccatttccttcccctgcaccccaccaggcaccccgactatgatgaggaaggcctctatggggccatcctgccccaagtggtgactgccggcaccatcactcgccgggctgtggagcccacatggctcaccgccagcaatgcccgggtatgtgacctctgtacctctggcccctgctcttcctctcccaggtctgtagaaactgggctctgagggcctttaggtatttagtgaggatcatgaaaaggaccctgtgatctgggtcaggcaggactctagtcaaatctggcttcatgatttctgtccactccttcagtaaatatgttctgggcacctgctcctggccagacagtgacaggcgtaatagctacagctctcatggaatttagataggaccatgtaggtgaggggtctggcatagcgctaggcatagagtagattctttacctgtcacaccaattgctgataggtggccatctctggaactgtggaatttcagcagtgctgtctggcattctctaaagccatcccctcaggaaaggctctagctctttctcagtcaactctggctccaggaatggggtaggaagagtctcatttgggtatctcactcttcccacagcctgaccgagtaggcagtgagttgaaagccatggtgcaggccccacctggctacacccttgtgggtgctgatgtggactcccaagagctgtggattgcagctgtgcttggagacgcccactttgccggcatgcatggtgagcaggagccggggttggggcagcccagcccctcagcatattgacagttctgatgaacattgggcagaatgttcctgagctgcttttctcactcctgcttgtcttccaggctgcacagcctttgggtggatgacactgcagggcaggaagagcaggggcactgatctacacagtaagacagccactactgtgggcatcagccgtgagcatgccaaaatcttcaactacggccgcatctatggtgctgggcagccctttgctgagcgcttactaatgcagtttaaccaccggctcacacagcaggaggcagctgagaaggcccagcagatgtacgctgccaccaagggcctccgctggtgagggtccctctcccatccactttaacacccaggacccgaggcctgctttactgtcctttagtactcccatctgttctatctcctgcccattacttgaactctcacctagcccctctccttccacacctgtgtaacctggttccaggatgatttgtcctattgtgacatttggttgctttatagtcagccttaaacagtttttcctcatgggagtaaagctatacttttggtatactgttaccaagtggtagcatcttgacaattctgattatgctgcataatcaataatacaggggttgcaaactcagatgcctacagggaatgagagcaaatggagtgggtggaagacaggagttgacaggagggcgctgtggcaaactggagcatgtaggctgatgttgatactggagaaagcattaccaggcctccaggttacttagcctagctctccaatttgtttcctctgatcgtactgcatactgtgtgctcagggccttagcagactctctgcagggttccaaaaacattgagggaagagaggtacaacttcctgaggtacagtacactgtccacatttaattagctggctcattgtggaaacttcactttctcgtcaacaactaaaagttaagtatgtgataaatgatatagtggttgatgactataaatgcagggaaggggagctgagtatcgtccagtggataaagtgaggtcgggtaaggctcataccgtgagcagcgtgtgctggtggaggcgagaaaggtggtggggctttagttgtggacacctttgaaagtgtcacaggagtttggactgtgggtgcaggtggtggggaagccatttatgcgagtgacgtgtctctggagccttcaggcgacaagccttgtgaggtctgcaggttagatggaagctgggagttgtctagggttgtggcagttgagaggggtaagccaggcctggctgttgtgttttctgcttcaacaaatgccccctccccttcagggagtagcctattcttacccctatccccccaaatctagagtgatggcccttgctgcctcctgaataaaaggcccgtgttggtcattgggcaattcagtgtctaaagaaacaggacagtaggaatagtggtgcctcctgtgctggagtctttgtcctttattgggctaccatggggtggcccaggctttggggctacaaaagcctgggctgcatctctttctagctccatgatcctaggcaaggcacttagcctctctgagccgtttcttcctctgaataaaagcctttaggggactggcatgatgtcagtgtttttaaaagttgaagtgatatgtgaacattccttgccaaggcactagcgtggcacaggaagcactcccgtggaatgatggtgataacactgcccccaggtatcggctgtcggatgagggcgagtggctggtgagggagttgaacctcccagtggacaggactgagggtggctggatttccctgcaggatctgcgcaaggtccagagagaaactgcaaggaagtaagaaccttctttgtgttaaggatggagggaggggtctgggcttgccccagaagagcttggatgctttgttttttagctttgagatgctgaaagacaaagtctgccctctgtttctggtcccttaggtcacagtggaagaagtgggaggtggttgctgaacgggcatggaaggggggcacagagtcagaaatgttcaataagcttgagagcattgctacgtctgacataccacgtaccccggtgctgggctgctgcatcagccgagccctggagccctcggctgtccaggaagaggtatcttgctacctttggagcatgggcagaggggccccagggagggcagggcagagctccctgtggaccttaccaatgtttgtaggtagggccagagtgaagcttctcttggggcttctaccctggagttaattggtatgtagcatagcccctttcacctctgcccaccttcccttcccagtttatgaccagccgtgtgaattgggtggtacagagctctgctgttgactacttacacctcatgcttgtggccatgaagtggctgtttgaagagtttgccatagatgggcgcttctgcatcagcatccatgacgaggttcgctacctggtgcgggaggaggaccgctaccgcgctgccctggccttgcagatcaccaacctcttgaccaggtatgcggggcccatggcctctagcctggccatgtgctcctatgtggggctttgggtgagcgttccttgggccagactggtcagttttgacttttcatccccctagaagtgaatgtttcagcttatttatttatttctaatttttaaaaagttgtagaagtcctaaaaagactagcctcaattcgtaaaaaaagagttattgggtttgaaaatgtgaaataccaagactgatcattgagggaagcagtgaggttaggggaattgttccgaagggtggtactcacgcttttctatttggaaaatcaaatgacagaagccttttctcatttcatagaaaattgagatgtttgtttttctttctcccataaatgttttctttcttaagtaagtgccaaaagtttgttatttgactgctaacagaaaacactgttaatggggacactcaaatgtgatttttaaaaatatcttatatattttatatattgagttgtattttcttgtagtaaaattcctagttcatatggatgaattaaatattaccgttccatgttgatctgccactcagaaccagtttgggaaccatgatctatcctgattattgggtaaataacagatgtttacaatattcaacattgttcccattgccctcttaatcatcatctccgggaggttatgcttaacaaagctaaaagtcctcatttatgcttcaaactctggcccaattggaagtgatttcgtatattaattaataaagtgtaccaaactgggaaaaaaaaaaaaaagtatgttgagtccataattgcatttcagtatctcagtgggaggttaggctgctggatggaaaacagtgctggaccttcacctttcttgacttagctaagtgaacagatggggtgttggtccaggggaagccctgctctaaggggtgtggggtcattgctccaggagtgatgcatctgttcacaggaggggcatgactgtgagaggagattgggtctctttcaggtgcatgtttgcctacaagctgggtctgaatgacttgccccagtcagtcgcctttttcagtgcagtcgatattgaccggtgcctcaggaaggaagtgaccatggattgtaaaaccccttccaacccaactgggatggaaaggagatacgggattccccagggtgagcacaacacatttgttcctcattacacataggatctgaggtggactagaaagtgggtcttggagaacaggaaacttggggccccagagaatccactcttgactcaggctatattctaggctaatttcagtttataaggtgccctgtgtccagagtgaatgtgatatgatgtttcagaaatgaaggcagcagagcttcaaatattctacctgtacctgtcccctacttcaaccacagaagaaatgtttaaagataatttattctatagagtgcattcttgcactctataggtgacagaaaaacaaactgtgctttaaataccaaacaagtaaatcagaaagcttattttctatttaaaatatatctaagacacacttatataaaaagaaaacagaccctcctaacatgtaacattaccgttcgtggcaattgttctcaacctttcactctccttttgaccttagcattaagctcctttgctcacttctgagctctcagttacagttcttgaggtggcatcctaaccaatttgcactatctttcaggtgaagcgctggatatttaccagataattgaactcaccaaaggctccttggaaaaacgaagccagcctggaccatagcactgcctggaggctctgtatttgctcccgtggagcttcatcggggtggtgcaggctcccaaactcaggctttcagctgtgctttttgcaaaagggcttgcctaaggccagccatttttcagtagcaggacctgccaagaagattccttctaactgaaggtgcagttgaattcagtgggttcagaaccaagatgccaacatcggtgtggactacaggacaaggggcattgttgcttgttgggtaaaaatgaagcagaagccccaaagttcacattaactcaggcatttcatttattttttccttttcttcttggctggttctttgttctgtcccccatgctctgatgcagtgccctagaaggggaaagaattaatgctctaacgtgataaacctgctccaaggcagtggaaataaaaagaaggaaaaaaaagactctatcttctcatcaaagcctttgttagtcatgctttccccactttcccactcacaggaggtaattatgttgttgaagaagaggaaggagtcctccaaagtgtagagtaataagacagtggcacctccttttaggacttttgctatactgaggatacttatgggacaaaacgacaagagaagaagccattgacatcaaaatgctacatgactctcctgagtgcagctgccaagtgggtaaagagagtggatggggccaggtacattagagcctggagtgtgatcatctgaagaatgcatgttcaaaattctgaaatccagggcacttgtatgtaaacttccagttttgaaatgggagtgggctactgatttgctacttattagacaaacctaagatgaaaattttaggtgctagaagtaaggaaacattgggttctgtttcaaaggtggtgcagggatggggatgcggtactgtcacttgctaagagtaaagggagaggaacaaaccacaagggaaaaggacaagacattggcatgaattgaaggaagaagccttaacccaaactaatgagtggcctttgaatgagggcatgacatgagaggtaaactagtttctgagccagactgctatagctggtcatcatccagtagtttaaaagattaacaggaagaggacccacagcaggacattgttttgttaccacctgcttcctggaagtgtttatcaaacaagtcggggcaacttcataggattttgtgtggtccaaagtttacaacccttctgagagtcctttgctctcatctttgcctgatcaccttttagccctttcccattctgttgcccttccactaatctgtgactgctcccagataggctgctaaccagctaggaagagtggctgggctccagacagaagccagcactgacctcttcattttcatcttcgccatcctctcgaagaaccatgtctaggatgtttcctttgatcttgaagtctcgtgaggtgctgagcttcatgtgctgcatcaggttcacctatgacaagattgtaagcatgggacatctccctactcataggtcctgccagaacagcttaagccatttttagttcacctctgagaaacctttccatttctacctaaagcaagcacgcacccacttccttctgtatgctggggttcaggtcatcagatcaagaacagcaaagaggctgagtgtggtggctcatgcctgtaatcccagcactttgggaggccaaggtggaaggatcacttcaggccaggagtttgagaccagcctgggcagcatagtgagaccccatctctacaaaaacaaacccaaaaaactagtggggtatgatggcatatgactgtagtcccagctactctggaggctgaggccagaggatcacttgaatgtgcactccagcctgggtgacagaatgagacacagtctcaaaaaaaaaaaagggggggggggaggggggatggcaaacacacaaatggcccagagtctcttttcctccattgtagttgtgctgcttcagtttgccagatctgtcaagaaggtaaatgggaatggtagcacataataagagaatgtttaccttggacttcttagaaaggtggatgagaaatttttcatactgttctatggcaaagatgaggttagggattggcttggtttcccgaagaactctggcctaagggcaaagaacataagacttaaatttcaggttcaatggtttttgaagttttcctctgaagctgtcacttacaaaactgtatggctttaggggaaaactagtctgtctcccaatcaaatgcagttgtacttgtataccagtaatctacaatttttggcagttcaatctggaaggacccaaatgccagtagagataattgcactgatccatttcatttataattccagtatttgttgttatctagaaaatggctgaggagggcaggatcacttgtagaaatttagttgcttttct

SEQ ID NO: 15523 - DNA, 21080 bp, Human
ttaaaatgttttcagtgagaactagattggaataaagtagatcataatgcttgttttcagtttactatttttcacataataaggttcactaaagttttgtttttttttttttaatcatcaataaaatgccatacatcttgccattctaaggaagtggcatgaactcttcatttactggagaagacttgatagtaattttctcagagattttatttctcctgatgttttcttgagcaatttggttactgtaagagctttaaacatttttggccttctctcacagatcttaggaaataaattgtagtttattttcctcccttcctccctcccttcctctctcccctctcccttctgtttccagaaaagtaattagcatttattgaatattttcgattttttaattgacagataaaattgtatatatttatcatgtacaacatgatgttttgaaatatacacattatgaaatatgactaaatctagctaacataaatggtactttattttcatgtctctgtgctgagacctaacagttggattggatgcccttaaagttggcatttatctttaccataatttggaaagcttcatggtctgtcactgttttttactctatcatttttacaaaaatactttaaaaagcacaaaattttttaggtttctctgattcgtattataggaagtatttagttgtaatatttagccctcaaaatgaaactgtactcagatagtgttacttctgtatcttcatgctgtgacaagttaagattgctcactgagaatttagcacatgtaagaggtaagtaaaacagttagggagggaggtgccacccgttgtatctacataaggagactcattcttcctcttcctttgaagaagaaattactcagaatccaggtattcaggaaggtggtctggcagttgtaggtcacctgtaaggcttagttaatacatttagtgctcatattagatgatgaagtttataacaagccatttcattctgtgatttgtagctgtggtggtgaagaaggaaaaacctctttatctagtggttcctcttgaatagtggggcttgaggcagaatgcagtggaaacaaagtagccaacaacacactgctttccatgctcttagctcctgcttcttgactctaatttatagtgccagtcattatttgtttcacttagtgcttgattttggaagggttgtactaataatataattacaagttgtattggtgtggctaacatgagagattttgaaaaacaatattgtataccatagatgtttagtaatagtatactacaaaagttccttggaaactttcagtgtgctgaattgaatgacagtttaaaaaataagatgtgaggttatatgggaagaattaatgcacattgtgagtcccccaggaaagttgggaaaaagcatgtgccctcttgcccttatttgagcacgaaatccttagtacctgcaggatttgtgttccataaatataccttgggaaaagctttagtagaattttagatgttctcagataaattatatttcaaaagctgctttcaaaatgggaacttgaaaaaatggttatggtcttcacacaaatcaaacatttttgtgtgtgttaatctacttagcaaatattattttctttaattctaggatagtattttaagcataactatccaaattgatagcaactaaattaattttttcatctcagtacttaaatatgagacaagatacagtaatttatttgaattatatattttgtcattttaccgtccagtatttttgcatatgcagttttttttttaacctgttacctgggtagtaatgagaggcaaaaagatgataattgtggaagtttgaagtactctaaaatataaagccctgtcttttttgtttaattatcgtttacaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggtaaggtagatacttagtaattgtcctctcatccatttcataagtagggccacctatattgcatctattgtgcaactttctattgtctattttatgtatcactaaaatggaaaaagtactaattataatttttaaaacttcatttgattataaaatgccagttgattttgcatatattaagatgtgataaaagtacatcttagaatctatgaaatatggcatttaaatgaaaggatttctatcacttatttaaaaggaatatctcacagagatctgtttaatagtaaatcttgatgatgatgatgatgatgatgatgatgtgtgacctctgctctgtgattctctattgctgttagtagcgctcttgatcctcagttctgtggttttcgtgccaagtattaattgagtacttgcttatgtgccgtttacttactgtaacagtaaaatttcagattgtcaggatcccctcagtctctcacttttcttggtcctccctaagactcttttaagtgatcagtagaggagttctttaccttgggagaagctggggtaggtgtggtatatactgtttgaagagaatattaaactacctgggttgttgaggagttctgttagtatcgcagacagtgtcttgggagctaatgtgggcatccattggcgttttgatagaaagctctggcaactccatgaacacagacaaggctgccaggagcaaaagagcagcagagtgctcctgggcctggccaacctggagcctcatttaccacatgattgcttgaggaacccgcttggtgcttctgcgtggcaatagttagtacccccttaagtagttttatctgggttcaagcccgatcatggtagtcagattgcattgcttcaggcagctggcatagattagactacatagttacatcttcttttacctaataaatgtattttagaagggttgtatttagatcttttgttgtgttaagtactttgaaaacgaaacttgctatctaaaggattgctacaattcatctttttattaaagcaaaaattgctcttttaaaaccagattatcacttccttatctggctgttcctgctatgttgaaggtatgaggttttatatatttggttgtcttaaaacagcagatagcataatactgccatttcaaaggatggcttccaggttccaaagtgttctggtcatggacaccttctcctagtctggactgtggatatctagagatgcttttaactgatacatattattctagaactaaagagaccctctactgactgttttgttctgtttatttctctaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggtaagtatgtcagcttaaagtttgtttgaactcatatagaaatctgaaagaatctttgctggttctcactcggggacacaacaagatgcagcacctcctaggtgtcatctagctgtttggaaagaatagaaggaacatttggaaacttaccaggtgctagaaggtgcttagtaacattcaacaacctatattctcctaggattatggactgctggcaatactcacggggaaggttttaaatggcttctcttcccatggtaataacatggaacttctgaaataaacagtcattagctctctgagttctgtctcagcttcaatcttctcttccttatttgaactttaggcatagaaataagagtaagaaggcattttggttaaaggatattttctccttttttaatcttccattcccttagagggagaaagtttatttctagtcagagaacataaaagatatacttttatttaagcaagcctgtggtaaaatccaagtgtataaaacagttaggggaagtactagctttttataagcatttataagaattctttaggctacttcattagttagatgtgacttaaaatatattcactcatttataaaattataaaagtgactattttgtgtaaagttagatacaactaataggactgctctgaggagcaccagagcaggagagaaagaaaactctgacataattaatgagtcttctcacttctagagtggcacactgattcatcatttgtagctttacggattgtttgggactcagattccggtgctgatccttaggcattggcgtactgtgtttgagttgcagatggtgttggatggcattgttttgttatatatttttactctcctgggatggttgctttgtgggtaatggcagtgacttgacattatcctatcttctcccagctgggtagttgtttgttgatgtacgttgctattcccaaaggaccagggctgtgggttttggccattagtctttgtttcttaattcacgttattattcacttttaccagcctgttttcaaacttgacttgtgttttctccaccaggaaaagcactgccaacagaagtacaatgtttcctgtataatgattcttcctcaataccagcgtaagggctatggcaggtttctcatcgatttcagtaaggattatattaatttctcattggtcttttccagtggaccttctctgtgtgtgtgtgtgtgtgtgtgtgtgtgtgtgtgtgtgtgtgtgtgtgtgtgtatatatatatttaaagatttgtaggtgctttgttggctgctagtatcttttgtcatatagctatatgattctttaaaacctaaagccactgctggacactgtggctcatacctctaatcccagcactttgggaaactggggtgggaggattgcttgagcccagtagttcaagaccagcttaggcaacatggcaagaccctgtctctacaaaaaatttaaaaagttaggtgggcatgatggcatgtacctagggttccacctactcaggaagcagaggtgagaggatcacttgagtgcccaggaggttgaagctgcagtgagcaatgctacccctgcattgcaggccctagcctgggccacagagcaagactctgtctcaaaataaaaatggaaataaataaaacctaaagccacacgttccttttattttggttggacacgaatttttttttttttttttgagagacagagtctcgctctgtcacccaggctggagtgcagtggcgtgatctcggctcactgcaagctctgcctcctgggttcaggctattcttctgcctcagcctcccgagtagctgggactacaggcaccagccaccacaacccggctaatttttttgtatttttactagagatggggttttaccgtgttagccaggatggtctcgatctcctgacctcgtgatccacccgccttggcctcccaaagtactgggattacaggcgtgagccaccatgcgtggccttggacacaaaatatttttaaacagctaatattgaataaaattttgtgtgatgtgtagcacatacctttaatttcctattgttcatttacaatggaactcagtttcatgcagtaatactaataatactaaaaacattgtataactacttcaattagagctaataaggaagtactgtgggccgggtgtggtggctcactcctgtaatcccaacactttgggaggccaaagtgggcagatcatgaggtcgggagtttgagaccagcctgcccaacatggtgaaacctcgtctctactaaaaatacaaaaaattagctgggtgtggtggtgggcgcctgtaatcccagctacttgggaggctgaggcagaagaattgcttgaacccgggaggtggaggtttcagtgagccaagatcacgccactgcactctagcctgggtgacgagcaaaactccatctcaaaaaaaaaaaaaaaagtactatacctgccgtatttttgttatccagttatctgagaaaatgtgtgcattttttttagttaggctctacctagtggttaaacatctgcaacacatctttaaatatctgaagaagtgaatgatagagaaaattgtttaatctgagttcaaaagtgatagctcacagttctaaagagatcattgtgggatctgtgtaatttgagggaatattttacctcagatattgctatacaatgatatttagatgaatatatgcagaactaatggttcaaacaaaggattttgattctagtcttgagatgttaattaagccttctcttagctttagactgtccttctgtccatattttattggaagcttgtgctactggttgttttacacattttctggtctttttagatgagcagtaggggatggaactcagattacttcctttaatgttaatatattgttttgaaataggactcatgattagacatgttatatatgccattaaattgcaaagttagggaaaatattttacttttggtgattgggggtgtgtgtgtatggtatacaaacagtccgtgcaataacagtattgtttgtatttacttttcctaatgtaatacgtttccaaattaacattcttagactgcttttatgttttctttaatgacagtaaaaatacctttctctgccatctccattttcgttgcttttccttagaagttaggcctttgtttttcagttcttgagagttgtgcactatagaggacagagtccacagttccacacttatattggcagtcctgcttgcctagagttagaatgataggtaattgtgaggagttttggttgaagtgaaagattgtcatctaattcactgacagaactacaattttaataggattatgtgaaaatgaaggcattcttttgtacttctcagttcagatacagcagttgccatctagtggtccaaataaagcatgcaaggcttgttttccccaggacgttgaacgaaactgttaacagtcctgatttttaacacttcgaatattttaacaaggtgattgatattaactgtagacataataatactaacttagtcttcaatatatataaattatgtattctttctgcagatttgttttgaagtagttttgcaatttgtttctctctttttttttttggaaggaatttacctttggagttattcttggttgtagaagaggggattgttattttggtgaatccagtttttcagagttgctgacctagttctgatttgagttatttgtgattctttaggttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccagtgagtatcacatctttttgtatacctttgaaagataattaggttgaagttttttggatcagccagtcagattattgatgaaagggcattaactaatataaatgatatacttggtgataatgagatatcattttcctttctaggatattttatttgattgactatatatatggtctatatatagtctatatatatgctttttaaactgaattgtttttctgatacccctaatttttggacctaagctactgaatctttcatcttctagtattgggagctctttcacaatacaagaagtaaccactctagaaacagtcattaaataaaatgcccatgttaaattttcatataaatggcacaaagtaaatatagattgaaaggaagaacagacagttcacccttcactaaagtggtcagaaaaaggtcacaaagaaaggaggcatttgagccaaataaatggagaataggaaagagagtgcagaagagcagcagaacttctggagcgggacgtgtgagacagcaggcagtgaaaacagcccgcggccacggtagagagcgaagcatttgtcctgcttcacactcctggccgtctcatgtggtggcacatttctgcattccatcgtcccaggcaggctatctttgcagcacctatcatcttacatgcttcaccaggggtctcatctccacattcatttttatgtacaccttgtacattgttgattgctataaacttttctctggttccagatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtaagggcatgaatagtctctatttttgatgacagaagatatatttttgatttcatgagtatttataataatgtattatgatcatctttcacagaaaagtaaattcacattagaatgtcaagagttttatttcagtggtagagatttcaagaagactggacctggtttacttaagtatttttaagccttggacaattaggaggagaccatcaaatttcttataatgtgttacttgtgagaaaaatatttgttaccagggtgccaagaagcagctcagttttaagctggatagtagttgagaaatctgaattgaatccaaatctgacagtttttaaaaatgaaatggaggttgggtgtggtgtttcatgcctgtaatctcagcgctttaggaggcccaggcgggaggattgcttgagactaggagttcaggacaaccagggaaatatagtgagaccccatctctacaaaaaaaacccaacaacaaaatgaaatggagatacattttccttaaatagaatattaagtaactattgtaaacttgtgtatgttttctgatggggcaccaaaacatcctgtggacacacagatctctttagccgttaaagggttgctggtgaactgtagtgcatgtgtcattgtcagtatttttcttcatgtgatgcatacttttatagctcttttttttaagcagtgcttcatcctttcaacaccggtatcctcctttaataaacataaaaaatcccatgcctctctttagtgcagtttaatttttcaaaatgaaattattcagaataaaagtaaatttaaaaactacataaactttctttcatatttctcaaatgcctccttcctcttgcccatgtctcaagatcctgtctcctccaccctgtttacaaatttttatttctgagaaattttattaaacaatctcatttaacatttaaaagaacaatagtattcactttgcttattgagggtggtactgcagaaagattcagaacataggctctggagtcagactgccaggctttctatcccagcatcttctcttgctcttgcgtgacctggggcagattacttaaatttttttctaccccacatgcctcatttgtaaagtggagttgtagtggtaatacttcatatgattgttggggagattaaataaataatgcatatacagaatttaaagcagtgctgaaacaggaaatatccatgttaaataactgatcattttctttttaaagctcagtttccttttcttctctcaatacttaaaaggtcagaataggtaaatgtaagcaaacaagactgaaaaattaaccagcattgttttattttctaaaatcaggtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaaggtaacgcatttctttccaggtcttctcttcctccaattccagtttatcttacaccttctcgttttagcttacagttctgaaagagtataagttagaaattcctagtgcattgctttataaaccttaagcctctgtatattgtagctcaagatcttcccagtgaacatttgagatgtgtgtgtgtgtttgacttctttgattcatgggaattcacttagaaatcataagcttatttaagggcttcacctcctgggatgcaaacaaacttttttttagcttactggtttgatgttcaaatcatgacttttaggggcttaaagccctaaaatatctttaaaagatatttttaaagtatgtacagattagaagtgtttatattagaaaaggaggccaaaatattacataattaattggaaagtgaacatagtgctgccctatattttggggtactcagagtccagtagctcatcttgggtgctattgttttctctctactctccccacttctcacacatccctccagtggtttaacgtggtctctcttgctttaaaaatattttctaaactatattccatcataatgatagccaattagttattaaataatgtacaatgatgataatgaattctgttaagccgtttaccagaaacatcccaggctatggagtggattttaagcattgccaggaggcagccagactgaagcgaggctgctccctggaagagccactcagccagcttccagccaaagcagcacaatcgttcctttccttacagggtcttaaaaagcaagacaggatcttttgttttgttttgttttgttttaagaataatatcttcagagcagttttacatttacagaattaatgcaaagaaagtacagagagttctcgcataccccagccagtttcctctattattaatcccttgcgttggtgtggtacatctatcacagttactgaaccagtgtagatacatcagtaactagagttcatactttattcagatttccatagttttccctaacgtcctttttctgttccaggatcccacccagcatatcgcattacatttagtagtcatgtgtctttaggttcctcttggctgtggtagtttctcagaatttccttagtttcgatggccttcatagttttgagaatgactggtcaggtattttgtagatgatccctcatgatattagaatggggtaatatattcttgagaggaagaccatagaggtaaagtgccattctcatcacataattaaagggtacctgttggcatatatctatcagtatgtatagggaagctgggcatagtggtcactcttgtaatcctagctacttgggaggctgaggcgggaggatcacttgagctggaggctgtagtgcacaatgattgtacctgtaaatagccactgtagtccaacctgcgtgacatagcaagactccgtctgtaaaaataaaaagaagcaagtatcaaatataagggtattatcaatttgatttttccctattgaagttaactttgatgacctggcttaagatattgtttgtcaggtttctacttttcttttccctttactggaaggaagtcactgtgcatagccacacttaagatttctaccccctcagagtggaggctcagcataaattatttgaatttctgcttgggagatttgtcctttctccctcatctgtttatttatccaagcatttatttatatcattattggcccagatatttacgtgatacttcactttataatccaatactactgctttttaaaatttgttgctcagattgttccagttttgaccattagaagctccttcttttagtttccctcttgggctgctgctgctttttttttttttttttttttttccttccccagatggggtcttactctgtcacctaggctggagtgcagcggcatgatctcagctcactgcaacctccacctcctgggatgcaagcaacgctcccacctcagcctcttgaataacttggactacaggcatgttccatcacgcctggctaattttttgtacttttgatagagacagggtttcgctatgttgctcaggctggtcttgaactcctgagcttgggcggtccacctgccttggcctccaaggtgctgggattacaggtgtgagccaccgcgcctggcctcctgtgtttaacatatatactgttgttgtcattgtggggtctttttgtttgtttttaagcatttcctttctggcactacaagatgcttcaagttcatcttgtatatttcatgcccttgtcctagaatcagccttttctccaaggaccagggccatttttaatctaatttgaaaattacattctcgattgggactattaagtttgaagtagagaaaaattgaacattgactaactgctgttcattgcatgatcatgaagaatagatctttgtcatcctagcacttgtattgccaatttatgaagtaaaacaaatcatgttaaaaaaagaaaaagaacaggcagtaagctcacatgcaaagtaattttgaagttaatgaataaatgctttgactggatgtgtgaacttaagcaagtcctataccctctctgacatctatagaatgaagggattggattagataatctctggggcatcatctcttattttgtgatattagttgtataattttagctatttggtcagtccagtgcaaagttgtgctcagtgtgcccaaatttcagtaacagatttattttacttttgaaatatttcactaacactgagtaaatacatttcagccccatatttctacattccacagctttttatgagtagttcatgaaaatggcatacaactttactgatagttctgcaaaccttcacagtagtgctataagacaaagtgtttttatttctcttttgctcttaagttggaaaagttaagggattagcctctgggtcagttcagtattaaaacagggcaactctctagggtgctaaatttaactgaactattaagagaattataatgtctgctatttggagatggctgcctattcttttacaaagttgtgttcaattgcctaatacctttgtatttataataagtgtattatcttactatagtattttgaaataatattcaaaatattttttggcaaacaacatcctcattttatatgtgctaattctatttggttttaaaactgttttcgtattattaatagaaaagatagtgttcataactgtaaatacttgctttctctattaaacagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatggtatgttttacagaactcacttactgtggtttattgtcttcagatatatagcagtagcagtgacagacccttcagtaaaaaggctgaaaaatgaacacaacccactaagcaagaaaaggaacgtttggcaatctctaaaaagttgtatcaagtatatccatcttgatttttaaatgtgttttcccttcaactcagaacctctattaatttgcctctgcagaaaatatcttactattaggcaactgttcttttttgcccaatcctttctaagcctttatcagaatctttagttaatgggagagttggacttagcatcaggaagatgtaataacccttcactagaatgtgcattctctagacttagtctgttttgctcattgctgtatgctgagtgcttaagcccggcgctcagtaagtagtgttaaatgagtgaatgctaagaagacaattctccagaaagagcagattcatgtaaattggaacttgtgtcacatctgttcaggagtctttcctgaattgtatctctaatgtgtcttacccaactagtagtaaatttctcacaaatggtaacaataactcaaaataaattttatagtatagatacaaatccaactatttacttttaaagcagcctagttgtcatttcttctctagagacactgaaactaggtctcatatatatgagccaggtcagaaacaagtctttttcaccctagcctaaagttttgccagtgtctcatgctgcctgcatctgcagtgtgtttatctcgcatgggctcagaatgagcatttttactttgttgggcaaatttgaagaaatctacttgtccagtcttggtacataaacctttagcttttatgcattaactggttgaactttttaattcttttaaaaattcagtcagtttcaagtctagaagataaacttacattttctccattctcatattttctatataacaaatacttttttattttttattttttatttttttgagatggagtctccctctgtcacccaggtgggagtgcagtggcacagtctcagctcactgcaacctccacctccgggttcaagcgattctcgtgcctcagcatcccaagtagttgggattataggtgcacgccaccatgtctggctaatttttgtatttttagtagagacggggtttcaccatgttggccaggctggtctcaaactcctgacctcaagtgatccacccgccttggactcccaaagtgctgggattacaggtgtgagccaccctgcctggccaacaaatacttttaatatagtgataagatgaatgtgttctttgctctatcatgaatgattctacagagtttaacttgctatgttttgaaataacataactaggaaactaaaaatttattttgtaaatttagcactttatattctgtcttagatcattgtacactaaaatagtacccctgattaagttcccatggacttagatttttgctgatgcagccatttcctttgttgactttcaagttactactactaactgtgcctttttagccgtgcccccactgcatcatgttcttgtcttggtattcttattctttaaaaattaataggcaatgtgagtgtacttaatgccactgaacttaacacttataaatggttaaaattttaagttttatgttacgtatagtttaccatagtttttttaaaatgctaataatataaaatttatttctaatgaatgtaattggtgctttaattttttcttgtttgtctaagtctaaatgtcagtttttgtctaggactaaataaatgctttgcagctattcccatacaaacacaacattaattgaacaactgttcacatacgatggctcagtcatggcctagagtaattggctcatcatactacctgaagtgatgatttgtggaaagtaagaaaatccgagagataaagtaaatcacaagcagaaaaaaaaagaggaaataagctaatttgtaacttttagtagagacaacttgataaaagtactgcttactacttatttgcctctttataaagttcatctccattttacagatgatgaaactgaaatgtagagtaacttcccacagacatgcagctgatgatggtagtcttgaattggttctgactagtgtctgataacataatgttgaccaggattctttcatagttctgccaattcactgtgtgacttagaatatgtcactaattagttttatcctctaggttcttaactttaaaatgaagacaatcaggagtttataaaagtaatgattaataaagtcatttctattgtatatgctagtcttggaagaaggaactagaaaatgtaagaccttgtaacctgtctttgttttttttccttcctgtatagacactcctatcttaaagccagtatctcttttgcgaaaacgtgatgtgaagaattctcctcttgagccagatacatccacacctttgaaaaagaaaaagggatggcccaaaggcaagagccgcaaaccaatccactggaagaaaagacctggtcgaaaaccaggatttaagttgagtcgggaaatcatgccagtttctactcaagcatgcgtcattgagcccatcgtttccattcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagaggagccagagccagaggaggaggaagatgcagctgcagagactgcccagaatgacgaccacgacgctgatgatgaggatgatggccacctggagtccacaaagaaaaaggagctagaggaacagcccacgagggaagatgtcaaggaggagcctggtgttcaagagtcttttttagatgctaatatgcagaagagtagggaaaagataaaggataaagaggaaaccgagctggattccgaagaggagcagccttcccatgacacgtccgtggtgtcagagcagatggctgggtctgaggacgaccacgaagaagactcccacactaaggaagagttaatcgaattaaaagaggaggaagagattcctcatagtgagctggatctggaaactgtacaggcagtgcagtctttgactcaagaagaaagcagtgagcatgagggcgcctaccaggactgtgaggaaactcttgcggcgtgtcagaccctgcagagttacacccaggctgacgaggaccctcagatgtccatggttgaagactgtcatgcgtcagaacataatagccctatctcctccgttcagtctcaccccagccagtcagtccgttcggtcagcagtcccaacgtgcctgcccttgagagtggctacacccagatcagcccagaacaaggatccctgtccgcaccctctatgcagaacatggagaccagccccatgatggatgtgccttccgtatcagaccactctcagcaggtggtggacagcggcttcagtgacctgggcagcattgagagcaccactgaaaactatgagaacccaagcagttacgactccacgatgggcggcagcatctgtgggaacagctcttcccagagcagctgctcctacggtgggctgtcgtcctccagcagcctcacccagagcagctgtgtggtcactcagcagatggccagcatgggcagcagctgcagcatgatgcagcagagcagcgtccagcctgctgccaactgcagcatcaagtcacctcagagctgcgtggtggagaggcctcccagtaaccagcagcagcagccgccaccaccgcctccacagcagccacagccgccgccgccacaaccacaaccagcaccacagcctccaccaccccagcagcagccgcaacagcagccgcagcctcagccccagcagcctccacccccaccccctccccagcagcagcccccgctgtcacagtgtagtatgaataacagtttcaccccagctcctatgatcatggagataccagaatctggaagcactgggaacataagtatctatgagaggattccaggggattttggtgccggcagctactctcaaccatcagccaccttcagcctagccaagctgcagcagctgaccaacaccattatggaccctcatgccatgccttatagccattctcctgctgtgacttcctatgcaaccagtgtttctctgtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctctttttttgggttcattttgttctgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaacagcagaatctcagagaaaagctgtttgcaatccaaatccagcctttggaggaatagagatggtcaattaacaatcaaaaagaggagattaacctcttgtttttttaccacctggtgaatcagccataacgcacacacacgccacccagcctcttgtttctagtatgtactttgaaatgctaactgagggtcttgatgcttgagcctttgactgataaaactcaaatagcagtccccagtgatttgcctcttaggttctttcttaaattgttggtggatgactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaacaccattctctttttttttgtgcaaccagattgcccattctcttcctattacttgctccagggataggtaaaaaaaaaaaaaaaaaaaaaaaaatatacatatatatatatatatccacacacacacacacacacacacacatatatatatatatatattccatcattagaagatggaaactattataccacttggtatgtgcagtcaaatatccaaaagggggaagtactgcttagagaaatatctgtaagcattaaattctctcctttatttgtacattttatatagataaatttttaaagtactaattaggcattaacttttttcaaatgcacaggtttgttggtttttttaatacactttaattgactttctcaagcgtgctaggtagaaacgcagaattccacatcttcccgctctcagctctgagcatgtgcaaggctgtgtaggacccagtttctctgtatatactattccagttcccagtcatctatgtagaaagtgcactgtgctgccatcgccctacatcttcagctgtgtcattgcttcctggttggggtggggacggggtgggtcgggagggaggtatattgggaggagggtgggtcaaggcagaag
